United States Patent 12,642,819 (COMPOSITIONS AND METHODS FOR TREATING INFLAMMATORY BOWEL DISEASE) - sequence listing, part 51

SEQ ID NO: 19 - DNA, 2251529 bp, Bifidobacterium adolescentis
  modified_base (1399222)..(1399316): a, c, t, g, unknown or other
ctaaacccgaaaaatcatcgtgactaaacccgcaacaactaattgaacacaaacagggcggcaccttcgagagcacgttgcgcatgaagtgcaccatgcaccgctggtacttcgcccggggaagcatcgagttcaccgtggagacgagtcccgcgcaccggtcgccgaccacgaggcgcacgcccttcaaaccgcgttcgatcatgcttcgtatgaactgctcccagctggcagcgtcctccctcatgccctccgtcacgccgatgacctcgcggtggccctccgcgttgacgccgatggcgacgaggacgctgacgttctccacgcttccgccccaggagcgcttgtgccacacgccgtccatgaacacgtacgggtattcggattccaacggcctcgtgcgccactggtcgatctccccgtagatccttttgagcttgtcgctcaatgtctgcgagggcatgcggtctccccacagcaattggctgatgtcgtcgacctggcgggtgctcacgcccgccaggtacatgtcgatcagggattcctcgacgctctgctcgcgccgccggtagcgttcgatcaccgcggactcgaacagggcgcccttgagtttcggcaccttcagctcgagcctgccggccttggcggtgagcttgcgttcgtagtggccggccctgtacgccttccgtcccccgctgcgctcgtatctggcggccccggtgatctcgtcggcctcggcgtcgagcatcgcgttgaggatctgcgtcatcttctcggtgatcagccggtcgagcctggtctcgagcaggttctggtcgatctgtatgatgttctcgggcatggttccgtctcctggcttccaatcgcggttttttgttttggcgaatgaaaatcgtacacaggacgcgggccatgccctcttacgtcagggccggaatccgaaagtgcgcaagaattcgggcgttatccatggacagaccgaaaacgacattgttagaaatatgaagcaaattttccaaaaacttggagacgaatatctgaaattcattaaccctaatagcaaatgcatcaaccttccaaacactatagaaaatcgacaaatcatcaagaccctacgcaattggaagccggaactcatatcgcagactgaagaaatcaatgagggagattcaatcaaaattaaacgagaccagaagctctggaatggattcttcaagcagggtgaataatcttgcaacccttagcgtataacgaagatggatggtgggttgggtggttagcagataaatcatctgttaaccacccaacccaccactttcagtcgtctatctcaatcgcatgaatcgtgacttcgtcattttccaaggcattggccttcttgaattccgggcgtagttccataccatcctggtcgaactcaccgttcaagttgcgtaccagcgtatcggccaatcggccacccatgggtttgaacgtcgcataggttatcgccccggaaatggcgccgccgacaacgggcacaaccttggcaacggccttcccgaccgattccttcaccacctgtttgccgaccagtgcgccgattttcttgagcagtggataccaggccgttttcatcagagcctgctgagcgaccttcttgcccatattcttgccgacttccctggcgacttttcctatcagcatcgccgcacccgacgcaccgaacattacgcccaaatagacgagaatgcgcactttagcatcttcgctcagctccgactcgtcggataacagatcatcctcaccaaaaagataggcgattttctgcgccaggttgatcgcaacaccaaaatattgagccacgtcagcgcttccggctgcaacggccatagggccgccagggattcctgccacgaaggcggcgagagtggtctgattcgtcgacttcttaatcaccccatccgcttttcttcgcaacgactccgccgtatatacatgctgtgggccatgctccagaatctcatcgagatattccgaattgacgaattgctgtcgcaggaacgcttccctatcaactctaataaccggaagcttcgcaacgcttccaatcatatttatcgccacatcgtaaagctcttcgtcggttttcttagccatgttctctccactccgataagacgcatcgtgcttaatgcccatggtatctgctcctttatttgttcgatggataacatgcgggcaatccacattcaccatgggccatgttttctccgcgagcgcgacgggctttcaacagataggatctgcttccaggtcagcaattcgtcagaatgcgtccgcgcgccttcacacactctcagcactctcatgcatctacatctcaattacatactttgtcactcatgcggcatgttcaatcgccaaagaatgtacagccttttatatcagtgcccatccaaggctacgtttacgtcctgaaatacggtgggcctccttttctatctcattgctgctacgaatagcagcaacagcttccaagcctcttagcaatgctcaaatccagggtctcttccttttgccaagccacataggcatatataaatcaacattccgccttctctgaactacactgttcctagaagagtttcagtgttgaaaggggtaaccgatgacacgcaaaggtgggtttctgaaggggatcgtcgcatcggcggcgacctatgccgtcaaaacggcggtcgacattgcggccaatccggaaaacatgcagaaggtggcgcagcttgtcagcgaacaacaggtaggcagcaagcttaagcaggccgctgcgaacatgcatctgccggccgcgcttagcccatccgcaagagtcgccaagcagcttgacgccattgaggagacactggagcaatacgccgaccgatttcccgtaaacgcaccagtcgaacgatggaagagtaccctgcaaagccttcgtcttatggacgtcatgaacagatccacaaccggcagcgagcataagaaccgcttagaaaagctccagacgcagaccgaagccctgttcaacgagatcttccaggctctcgactcgggcgatgcccagatcgaagactgaccacttccccaccgctttcatacctgtcccccgccactcccaagcgcaccgacgcgtctgccggtcgtatactgctaccaagtggatttgaggggaataaccatgatcgacgacgattccaacgaactcatcccattcgaaggcggagacggtgatgccgatgccagcaccgggaacaacaatccaaacgacacgcaaagcgtcaccatcatccaagacgaacaaggcatcgtcttcctcggcgacgccgggaccatagatctctggctcaaggacgaaggcttcgattccaaggctttcacggccaaagtcatacagaccgtctcgtcggccagcaaaggcgcacaggcagccggcaacgccatggccgaaagcggacgttgggtaaaactcaccaaagaatcggctgagctggtcgccaaatacggcaagaactgtaagaagggaccgttccaagccggtgttgtacggcaaccgaacgggcgcatcatcaaacatttgaaatttacccagcccggacagctcaaccccgctttactcaccggtgtcagcggcgtcatggcacagatggcactggaacaagccgtctccgagatcaccgattacctgaaggaaatcgatgcgaagctcgatgatctgctacgcgatcagaaggatcagaccgtcagcaagctcgccgggatatcccgcatgatcgacgagaccatgttcatctaccaacaggtcggttcgatcagcgcaaccacatggtctaaggtgtcaggctgcccgcaagacatcgccaccatccaagcgtacgcgatcgccaaaatcaagagcctcaccgagaaggctgaacgcgagcaggatcccaagcaggttcgcccgctgacccagcagattcgtcaggagatccaccagtggctgggcatgctcgcatccgcggtcaagatgcaggatcaggtctcctgcatcgagctcgcgcgcgtatgccaagaggagcctgaacagctcgaagcatacaagaagggcatcgtacttgccaggaacaagcgcctcgaagaaatcgagcaatcgctcaacgcattgggcaagcagctggaggagaaagcgaaaaccgtgggcggacaagtgctactgaacccttacagttcacctcatgccattgccaacatcgaaagtatcgccagcgatctcaatgcattcgccagcacattgcaacttgagcacattcatctgcacgtcgaagacggtcccacctggatcgaagccgcgggcaaagccgtagacgacaccggcaaggccttgcagaatgccaggcagcagaccgcacacgccgtccaagacgtcggcaatgcgatagcgaatggcgctcagagcaccggtgccgccgttgccaagggaatgcaggacgccggaaaccaggccgcgcacatcgcgcaggatgcgggcgacgccattgcgaaaggtgctcaggacgcaggcgccgggatagccgacggagtgcagcagcttggcaaaggaatagcagacggattgaaacagctcccggagatcaaactgcccaagttcgggtggggcaagaaataggttggagaatcacggcgtgagctaggagtatgtccgacttaagagacatgtttccagttcaccttttaatgttctacatgcccttcagtcagtagcttcgttctttgttatccgtagtcgtcctcatcgacacatcatgagcgaaatccgaagcctcccgctcattctcgaacggctctacgacccggcgtgatgactgcaatcgcgcatttagtccttttcaatgcgataatctccaagaaaacgtccacaaccccaatgctcagtagtggtcgcgcacggacaggatgcacaggtcaccaccatcgaccatgtacaccaaacggttcgcggaatcgatgcgccggctccacgcgccctgcaattcccatttgagcggctcaggcttaccgaggcccgtgaacggggaacacatcgtatcacgtatcaacacgttgacgcgtctgagagtcttcttgctctgggtctgccaatacagatactcgtcccacgcatcctcggtccaacgcagcaccgctcactccccgaccagatcgtgcgtggcggtaccaccggaacgcacctgggccattccacggcggaccttgtcgaacaatccgggattctgatagacgcgcagcgtttccatgagcgactcgtaatcgtcggcactcatcaccaccacgttgtcgtgtgggtccttgttggtgaccagaagcatgtctgcatcatcattcacgcgacgcagatacgatttcagatccttacggaaattggtgtacgcaaccgccgtgaccatggcaatctcctcttcaatccgacaacatatgtacagaaaacggtacagcaaaagccgaggagactcaatcccaagattcgccacggtaggcgttcgccatcccttcacagccccacgtgtgccgcatgatcgcgaaccgtgccctcctcatccagactgacagacgggaaaccactcgaatcatcaagaaagtcacagatcagccgccactggcgccggcttatgccaatacgctcgtccggcctcaccatgagcaccggtgccgcaggctccagcgactcgatctgcgttttcgacgtggaataacactcctcgtcatcaatccagacaatcggcaacggctcctcctgccgtcgttcgaaccgaacgcgcgacataatctccgcaagcttgcccgtcaaccttctctcattggtgaccggatcataccagataacagtccgttcaaccccgggatcccagccaagcatggggtcaagcacccttgagcaatacggctgccatgtggtcagccagttcaattcggcactgccggaaagggccagttcatgcatcatgccggcaagctcgcgtgaccagtgcacgcggaaccgcccgcgccccgtacgcacctgctcgttaccggtcagcggaaacgcacgcgtggaatcgtacagttccttacgtgggtcgccttccttcagccattgcgtatggccgacccctccccgccgaagcaccttgtcatcggggaacgcgttcagcacaccgtcaaaatccgtgtagatcaccgcccgaaccattacgcctcctggtaagccctaatcctgcagcgtcctgtaattattcactactatctaccggacaaatcaagccggcctattttcgctagttgctttatttgtggcagccgaacgccgaaacccgaagtatgagcgttggaattccaacgctcatactcgccataatcgccaaacagtgccacaaacaagccaacaagcattttggggaaggcttttcgcgtaatgttgcgctctatcattgataaaggcatccagcaatcgcataccgtaaggaaccacatgcgctatttcacttcggacacgcatttcggccaccctctggtcaccgcactgcgcggattcctgaacaatggcgggctccgcgccgaataccgtgatgtctggcaggcgcaggggcgtgccgccgcgcacacgtggatcaaacaatatgtgcgcgacaatcagacgtcgttcaaagcaatctgcgacatcacacgccatgagaacaccatcatcggcaacatcaacgagaccgtcgggcgtgatgacgagctatggattctcggcgatctctcctaccgttgcaccgtcgagcacacgctcgactgtctacgccgcatcaactgccgccatctgcacctgatcatcggcaaccacgaccgcaacttccgtctccgctccaatgacgcgctatacgagaacgtgttcgagaccatcgacgactaccgtgagatcgacatggagcttcccgttctcgacggaaccggcaagccgacggccgcaaccacacggcagaccataggcatgagccactttcccagactctcggcattgaccgaagaacacggcaactggccggaaaactggaacaagttcgccgatgtggcaccgaccaccgaaggttggctgctctatggtcacacgcatcaaggcattcccgacggcaccgatccgctcagcgtgaacgtggggctcgacgcatgggatttcaagccagtcagcgagcagcagctcctcgcctggttcacattccggcacgccgaccaatcaaagtaaattcccccgagcatgcgtcatcgtccggaggcgaagcgggtgaggactcccgacttggccaaggctcggtagaggacccacgaaccgaacccggcgaatacgaccgcgctcagcaactcgcatgccgtgccgataaggccgcgcgggctgaagaacgagaacgcctggtagtagaagaacagcagatagaagttgtagacgatgccgaccgccagtgccgccaacagtgtgacgccaagcgtccaacggcggtagcggaacagtgcgaacaccgtttcggcggcgagcgcctgcacgagcgcgatcactaccagactcacactgtatttcgtgccgagcaccacttccacgaacgaggcgactaacagcacgtaggccgacgcgcccggtttgcgtacgatcagcaagcccagtgtggcggggaaatagaacaatgcgtgcagcagtgccgcggagcctggaagtatcagagtcagtaaaggaaacaagccataggacatgccatcgaacacccagaacatcacgccggacattacgccgacggccgctccgacggcgatgtcgacgacacgccatttcagggatctgcgtgtttcctccgttgtttgcggagcatgcttcagcatcgggatgcgtggtttttgggtaatcgtttcagaggatggctctgccatgatgaatccttgccttggttgacgccgcgcaccgtgagttggagatcgcggcggtcgccgtgggccgttcctcgacctgcgcggcccgggcaggagcgacgcgcgccattatacggacgccatgttcccatgtccgccagcgtttcgcatatgaaacgcatcagcagcatacacgtcacatttgcgaaagaatcgtctacatcgtccgcatcgcaacaatccgcaaccccattccgcttacgcttgaccatggatttcaagcggcgtataccaccacacgataagaggttggcatgaagacgatggcacggcaaataggaaccgttctgtgcatggcgctggctttgctgtcggcgttctacgcgttcgccgtgatgaagacacattcgggtaccggcttctggaaggtctggctggtcatcgccgccgttttcgccctcctcgcggttggaatcgccgccaattggtgggtggcgctcccccgcatcatacgaggggtcatcatcgccgtggtgtgcatcggcatcgccatattcggcacggtggaggggtgcatcatcagcaacatgcatgcgcggggcgaccagcatctcgattatgtggtggtgctcggcgcgcaggtgcgcaagtccggccccagcaaggccttgcggtatcgtctggacacggcggccgattatctgcggaacagtccggataccatctgcatcgtctccggcggcaagggcgcgaacgagccattccccgaggcacagggcatggccgattatctgaaggcacatggcattgaggaaggccgcatccttcaggaatccaagtcgaaaaccacccaggagaatatcgtcaacagcaagaagctcattgccggagacaacgcgtccgtcggcatcatcaccaatgacttccacatgttccgcgcattgcagatcgcgcatgacaatggacttgacgaagcccaaggcatcgcggccggttcaccgcccgatatgctggtgaacaacatggtccgcgaattcttcgccgaaatcaaattcctgctgtcctagttcctgcaagttccgagcttggatattagaaatcgcttcccccgctggaccaatgtccgaaggtcagctggcgtgcgccgcggcgtgcgtaccacgcggcagccattgccctttcggcaatgcggcgaatgtgggccactgttccgcggcatccgcggccgattcgagacgacgctggaagccgggccaattcggatcggcttccagcagccgtccgagcagcagcgctgtggcatgcgcgtcgctcaacgcgctgtgcgcatcctcattggcgatgccgaagtagtcgcagcagtcggaaagcttgccgcgaccaatcagtgaccgcgacagtttcatcgtgcacagcatagtgctctgatgaacaggtatggaggcgcccatgcgcgagtattcggcgagcaggaaccgcgagtcgaacgacacgttgtgggccacgaacacgcggccggcaagcaggtcacgcagttcatgtgcgatgccttcgaaatccggcgcgtgcagcagatcgcgcgcggtgatatggtgcacccaggaggcaccgacactgcgatccacatgaatcagcgtctcatgctcgtcttcgagcgtgccgtccggagccacgtgcaccaagccgatctcaatggcccgatcgcctttcgccggactcaatcccgtggtttcgaaatcaaccaccgcgaatccctgattcattgttcctccagtcacacactgtattccagtgtaaagcaaggcaaaggaatcatagaaaaaggctggaacccttaggattccagcctttatcgcatgtgctgcgtcaatacaacgcccacaggcggccaatcggtctcacttctcgtcggaagcgagctcgtcagccacggcggcggcagcggaagcagcctcgacgctctcggactcttcgtcttcagctgcggaaccgaggaaggcgctcaggtccagggtctcgccctcggacttgaaggtcacggcgcgcatgccggagagcaggcccttggagcggccgacttcctgcacagcggaaccgatctggccgttgcggatgatggcctggatgaaggcattcggatccatgccgtactgctgggcgatggaggcgaggaagttgaagacctcaccctgggagaccttgacgtccatggtctcggcgagcacgtcgagcaccatctggtcgcgcagttccttctccacggtttcttcggcttcggccttctgctccttggtggccttggacggatccgcggtcacgttcttgagctgctgctcgaccatttcggccttgacgcccttcggcaccggaatctcgaggccatcctcgagcttggcgatgaacgcgtcacgagcggcggtggcctgacggccttcggcgtcctgagcggcgaccttcttcaggtcttccttcagctcgtcgagggtgtcgaactcggatgcttcggaagcgaagtcgtcatcgagttccggcagttcctcggccttgacggaattgaccttgaccttgatcagggccttctcgccttcgtgcttgccggcctcgagagtgccttcgaagctggtttcctcaccggcggacaggccttcgagggcctcatccaggccgtcgagcatggtggcggagccgagctcgtagctcacgccctcctgggagtcgacggtttcgccgtcgatttcggcgttgaggtcgatgttggcgtagtcacccttggcggccggacggtcgacgctcacgagggtgccgaaacgctggcgcagggcttccagacggttgttgatgtcctcatcggtgacctcggccttggcgacctcgatctccatgccgtcaagagccggcagttcgatgtccgggcgacgctcgacggtggcgacgaacttcagcttggtctcatccttggcggattccggcacgtcctgaacgtcgatctccggctgggccatcgggtggatcttcttggtttcgagagccttggaatacagctccggcacgccgttgttcacagcttcgccggcgacggcaccgaagccgatacgctggtcgatgatcttgccgggcacgtggcccttacggaagccaggcacgttgacctgctttgcgatttccttgcgagcctcgtcgagatacgggttgaactcctccgggtcgacggtgacggtgagcttcaccttggtcggctcaagattcctgacgctgattttcacgcttgcgctcctgaaaaatacggttcttcatatttctgccgttaggcaacctctacataatagcgcgacttacggactctgcaactagggagacctgccaatcgcgtgcgccctgttcgccgaggaatcgcgcgacgtcacgcttacgaggttcgtccgtccagcacaggttacgcaaatactgcggtttgatgacgatttccacaggcgtgcgcgtgtcctccgctatctgggagaccgccttgcgcaccctgttgagcacttgcagacgttccggataccgttccttccacacgcgaatcgatttgggagccgaagcggactgcgattcatgacgccgcgcggcgccgccgtccacgtccggccattcgcttggcggcagggcgagcgcgtcctggatgatgttcttccacatgctcggtttgattttgcgttgaatcggcgcgtaccgttcgaacatcttgtcctgttcggaatcggtatggatgcgcacgcgttcgttgatggagcgaatcgaacggaattgcgcagcgttgcgtggtttgcgtttcgccacttcgatgatggagctgtcggacagtagcagggtcggcgcgatgtcgtattcgcgcgcgagttcgtcgcggcgggtccatagcgcgcggacgatggccagcgcctgccggtcacgcatgacttcagtgatgtgtgagacatgcatccagggaatcggatgctccttgcgtggtcccagaccttctttgagcgcgtaatcgaactcttcctgggcccattccatcttgccttggcgtttgagttcggcgcgcatcttcgtttcaagctcgatgagcagttcgacgtccaacgccgcgtaatttcgccagtcgcggggcaacggacgatacgaccagtcagccgcggaatgttctttggcaagggtcagtccaagaaagtgctcggtgacggcggcaagtccgaatcgtttcaatcccagcagacgcgcggcgatttccgtgtcgaacagccgttgcggttccatgccgagttcggcgaatcccggaagatcctgcagggaatcatgcagaatccataccgcatctccgacggcacggttgaaatcgttccaatccgccccggccgcggcgagcgcctgcggatcgagcaggccgatgccggctccgtcgcgtttgaactgcaccaaccagtcctcatgcccataccggaagccggatgcgcgttccgcgtccgcggcaagggagccatgtgaggaagccagctcactgcaatagtcacggaatgccggcaacgtgtcgatcacgttgggcacgccttcgcgcggttccgccagcagcttcggctcgtcagtcaacggggttttcctcctcggattgcgtcatggaccggaggaacgacgcccactgtccgacttgggagccggcgtcaaggcctccatcggcatagtctagtggagtccaagacacccggatctcgcagcccaccctgggcacatcggggtcatggccgaatgctgtgttttgggtgactgtgacggtgccggatacatgttcggaatcgtttggattgagacgttccatcatcatgtcccagtacatgcccggagtcaggcagtcgtcctccttgtcgggcagtggcagggatgcgaaagccacgcaacgccagtgggagtgccagtcctctcggaatttgagcgagtacaggatcatgatccagccggatgcgtatgtttcatcgcattccaacgcgacgccgatgccgaagttcgccatggaattgggcaccggaatctcacggtatgtcatgcctttcaaacgccgcatacggtccacggaaagcaccgcgttccagacttggtcgggaacgccctgcggtcgcataagcatggtctgtggggcttcgccgcccatatccgctcccttgccatcggcgcgcgccacgttgcgcgcatctcgtggaaaatcaaagatgtctgccatagttcaaggctacgacagagaagggcatttcgtagtatttcgaaccactttgccacgcgtcgaatgtgaagatttttcagcgtatgaataaattggtccatgccatcgattcagtcggcggcatggaccaatatgaggcgttccgcatatccagcgaatatggggaagccattgagaggacgggcgtttagtacacggtgaagccgtgcgactggaactgctcgaccacacgttgtttcattgccgcggacgggcctttctgatcctccaacgggtatgggatgttcagcatgtgccacttcggacggccaagctggtggaagggcaatacgtcgatatgttccaacgcgtcgccgaaggtctcgcagatcttcgccacgttctcgacgttttcttcggaggatgtgaggcccggcacgagcacgaaacgcacccagatcttcttgcctgccttggccagacgctgtccgaagtcgatggtcggctgcaggatgccgccggtcaccttatggtaggtctcctcatcgccggatttgacgtcaagcaggcacaggtcgatgtcatccaccatgtcatcggtgtagctcgcaccgaggaatccggacgtgtcaaggcaggtatgcactcccatctgcttggcggcatggaacacgcgggacacgaaagccggctgcatcatggattcgccgccggagaaagtgatgccgccgccggtggccttgaataaatcggcataccgctcgattttcttgaccatggcttcgtagtagacgggcttgccgtcacgcatcttccaagtatccggattctggcagtactggcagcgcagagggcatccgctcatgaacacggtcattctggtgccaggaccatccacggaagtgttgatgtcccacgagtgcacgaaaccgatatcgccgcttttcaacgccttgatgcggtcgagacggtccaagccgattggcgattcgaatccggacaggcctcccatcagcgtctggttgacgtagtccttggaatccctcagcatgtgtctggtcgtggaacggaaaatatgttcagacatcaatgtcccctttcatctgccatcccaatcatatgggaaaacgatatgggaaaagcgaaagggacgaagccacgagctccgtcccttcgcattaccgtcgtttcatgcgacggctttcatttggctgattgtgccgttcagtcgacgacagcgccctggtggaacgtacgggagatcacgtcgagctgctgttccttggtgagcttgacgaagttcaccgcgtagccggagacgcgcacggtcaggtgcgggtacttctccggatgctcgacggcatcctcgagctgctccttgcgcagcacgttgatgttggcgtggtacaggccgtggccattgccggcgtccaggatgccaacgaggttgccgatacgctcttcctcgtcgcggcccagaccatcaggggtgatggtgttggtcagcgagatgccgtcaagagcgtcgttgtagtcgatcttgccgacggagaacatggacggcagcatgccgtgggagtccatgccgttctccgggttggcgcccggagcgtacggggtgcccttcttgtggccggacgggaaggcgccggtggccttgccgtattccacgttggaggtgatggtcaggatggactgggtcgggacggcgtcgcggtacaccggcagacgcttgacctggcccatgacggtggagacgacccacttggcgatgtcgtcggcacggtcatcatcgttgccgtacagcgggaagtcgccttcggtgcggtagccgacgatcagatcgtcatcggcaccttcgacgtactcgttctcgtggcccggcgtggtcttggcgtccttgttgtagatcgggtagaccttggcgtacttgcatgcggacagggagtcggccgcgatcgacaggccggacatgccgcagccgagggtgcggtacacttccttgtcgtgcagagccatctcgatggactcgtaagcgtacttatcgtgcatgtaatggatgatgttcagagccatcacataggtctcggacagccattcgagggccttctcgtagttggccttgaccttctcgtaatccagcgtgccatcggcttccggcttgatcgggtcgatgacgcccttgtcgatgacctgcatgccggtcatctcgtcgcgtccgccgttgatggcgtacagcagggccttggcggagttcacacgggcggcgaagaactgcatctgcttgcccacgcgcatcggggagacgcagcatgcgatggcggcgtcgtcgccccagtgggagcggatttccttatcggactcgtactggatggccgaggtgtcgatggagattcgggcgcagaagcgcttgtaggcttccggcagcttcggatcccagaagatggtgatgttcggctccgggccaggtccgaggtgctcgagggtcagggtgttgagcagacggaacgaggtcttggtgaccatggtacggccgtcgtcgccgaagccagcgtcggaccaagtcgcccagtacggatcgccggagaagatcgcgtcgtaatccttggtacgcaggaagcgcacgatgcgcagcttcatgaccaggttgtcgatgatctcctgtgcgtcggtctcggtgatcttgccggccttcaggtcgcgctcgaagtagacgtcgaagaaggtggagacacggccgaaggacatggcggcgccgtcctggctcttgacggaggcgaggtagcccatgtaggtccactgcacggcttcctgtgcggtctgtgccgggcgggacaggtcgaggccgtactcgttgccgaggttgatcagctgcttcagggccttgatctgctcgtcatgctcttcgcggaagcggatccagtgctcgatctccggctcggtgaagtcgttgcggtacgggatggagtccttgtcgcgctgcttgaacttgatcagcgtgttcacgccgtacagggccacacgacggtaatcgccgatgatgcggccgcggccgtaggcatccggcagaccggtgaggatcttgttgtggcgagctaccttgatctgcttggtgtagacgccgaagacgccgtcgttgtgggtcttgcggtacttggtgaagatcttcttgatctccggatcgggctccttgccggcttccttgatggcctgctcgaccatacgccagccgccgttcggcatcatggcgcgcttgcacggcacatcggtctgcagaccgacaatcacattgtcgacttccggggaatcgatgtagccggccgggaaggcgtcgatgcccgccggggtgtgggtgtccacgtcgtagacgcgctgcttgcgctccacggacagatagttgtcgtccagatacttccacaggtgcttggtcttgtcggtggcgtcagccaagaaggactcgtcgccctcatatggcgtgtagttcttctggatgaagtcgcggacatcaatgtccttctgccagttgccctcggtgaagccttcccaagccttagcctcaagttcctcctgggagaccgccgttgcatcaactgctgccatttccactccttactgggtgtcggttggcgacgcatcgttacgccgtcgctacttcacgattgtaacggcaatcatctgcgaaaagcctgaaaaccactcccgaaattagtgacataaatcacaatcggtcgtggttttcatatggaattcacttttcggaagatgccgagccgtccgctgaccagcgtttccattcgcggtcctgttcctcccatttgagattgcgttcctgcacgatcttccacgcgtcgagcgcgtcctcacgggttctgtacggccccatgcggtggcttgccggagagatcatgcccaattccggctgctcggtgacggtgttgaaataccactgcttttccatatcggcttccttcggctctcgatgttctacttgcgatcgccgattattcgcggaatgcattggtgaccggcagacggcgatcacgcccaaacgccagcgccgtcaccttcggtcccagcggatactggcgacgcttccattcggcgcggtcgaccaatcgcatgaccgtgtcgacggtcgcctcgtcgaagccgtcggccagcaggtcggcgcggccatgagcatgctcgatgtacatcgccaatacttggtcgagcagcgcgtattccggcagcgaatcggaatccttctgccctgggcgcaattcggcggacggcgccttctcgatcgagttgacggggatcatcacaccatccggcagcggagtgcccgcgctcccctgctcgttgccgacgacatgcagaccgccgatgcccatgccggcggcggcagccttgttgcgccagcgggagatctcccacacgcgggtcttgagcaggtccttgattggcgcatagccgccgaccgcatcgccgtagatcgtggaatagccgcatgccagttcggacttgttgccggtggccacggccagcagtcctttggagttcgagtaggccatgacgatgacgccgcggatgcgcgcctgcaggttctcggcggcgacgccttccagttccagctggttttggaaggagacgaacagcggctcgatgggctggatgtcataatgcgcgccgatattgcgcgccagatcagctgcatcgtccttggatccgtcggacgaatacatgctcggcatggagatgccgtacacgttctcgccgcccaccgcgtcggccgccatggcagccacgagcgcggaatcgatgccgccggacaggcccaggcacacgcccttgaaatggttcttggccatgtaatccttcagacccagcacgcaggcggtgtacacttcctcgtccggatcgggtttggctgcgatcgtaccgaccttctgatgctccgcggacgtgtccaagtcgaagaagctcagatcctccatgaacatcggcgagcactcaagcagggtgccgtcggtgtccacaacgaagctgccgccgtcgaagacgaggtcgtcctggccgcccacttggttcaggtagatcatcggggcgttcacttcggccgcgcggcgcaccgcgaggtcgagacgggtgtcggttttgccttcctcgtatggcgaaccgttcatggtcagcagcaggtcgatgttctccttggcgagttcggccacagggccgccgtcctgccagatgtcctcgcagatggccacgccgatgcgcgcgccgttcacgtcgagcaccatggatttgttgccggggctgaagatgcggaattcgtcgaacacgccgtaattgggcaggaaatgcttgtcgtagccggcccagaccacgccgtcgtgcaggacgacgagtcggttgcgcggtttggaggtttcacggtcggtgcctacagtgccgaccaccacatatagttcgccgagactgtcggatgccagttcggtggcgagccagttggctttgttccatgcggctttgcggaaggtggcacgcagggcgaggtcttcgatggggtatccggtcaatgtcatttccgggaacacgacgacctgcgcgccctgctgagcggcgagatgcgcgtaccgcatgaccttgtcggcgttggaatcaaggtctccgacgcaggtgtcgatttgggcgagtgcgaagcgaatgtctgtcatagctgcctaacttaccgttgatttgttggatatgttgtgttttttacgattatgaaaattacgattacggcgttccgcacgtggcgtcacgacagttcgttgagcaccgtcagcgccgcgttggcgtagaattccacgccggcttgcagcgattcgtcaagaccgacgaaatgcgggctgtgccaatccgggcagccttcctcgccgttggaaccgatgaaggcgaacaccggcatggtgacgggcatgaaatcgcagaagtcctcccccgccatcgacgggtggatgggttcgagctgggcgtaatcgcgcacgttgtcggcgactatcttggaaagttccgtatcggagacgagcggattctggaaatcgtcccaatcgatgtcggcggtgatgccgtaaccggccgcaatggactggacctgttgcttgaagcgtttccccaccagttcaccgtcggacttgtggaagtatcgtacggtgccttggaagctcgccttgtcgggtacgacgttccacacgtggccgccgtgcatctcggtgatggacagcacgagcggatggaacggcgatacgttacggctcacgatggtctgcaatgcgaggaccatcgtggcgagcgcctcgatcgggccggtgcccttgtgcggatagccggcgtgtgtgccggtggcgtgcagggttacatggaatttcacgcagccggccatcatcggttcggggccgacggcgatctgtccgggcgagtagttcgggttgttgtgcgcgccgatggcggctgatacgtcggcgagcagtcccgcgtcgaccatggccttcgcgccgaggccaagttcctcggcgggctggaacagcagtttgatggaccccctgatgcgcttgcggcgcttggcgagccagaacgcggcaccgagcatgtacgacatgtgcaggtcgtggccgcagccgtgcatcacgccgtcgttgacggatgagaacggcagaccggtgtcttcctggatgggcagaccatcgatgtcggcgcgcaatgcgatgcgtggtcccggctggtcgccgcggatcagtccgaccacgccggtttcgagcggattgttgagcacttcgatgtcgtgtgcgcgcagcagcttctcaatgtaggcgctggtctcgtattccttgaagctgcgttcggggtgcgcatgcagatagtgcctgatttcgatgatctccggcgtgatttcgatatgttcgctcatggttgacgattgtaggcacatccggccgtttttcctattttcgtggtcgtgttccgtgccgtgcacgacgttttcgcacatatcctcgtaagctggataccgggtttgacatggtttttcatggaggcagcatgactcaggacatcaagacggcgtttttcgacatcgacggcacgttgacgagtttcgtcacgcatgtggtgccgcagtccaccatcgacgcgttgcatgcattgcagcgcaatggcgtgaaggtgttcatctgttcgggccgcgcaccctcctacatgggcgtggtgcttgataccattcccgtcacgttcgacggcatcgtgggacttaacggccagtattgcaccacgcgcgacggtctcgactaccggcatccgatcgaccaggccgacgtgaagctgatcaccgactggcttgaaacgcatgccgacgtggtcgccaactatgcggaaagcgactacgggtatttcaatcgcacgaacgccgcattggaacgcacgtggaacagtctcggcaagaccgcgccgaaaatcgacgtgcatgatccgcgcgaacgcatcgcaaaccattccacgttccaaatcagcccgtatgtggacgagacgatggaagccgaaatcgccagcatgtgcggcaacgtgcgcggcgtcagatggcatcccgctttcaccgatctgattcccgccgatggaggcaaggcggttggtatgcaggtgatgctggagcatttcggctggacgaaagacaacgcgattgcattcggcgacggcggcaacgatgtggacatgctacgattcgcgggaatcggcgtggcaatgggcaacgccaccgacgagccgaaagcggcggccgattacgtcaccgacagcgtcgacgacgccggcatagccaacgcgcttaagcatttcggcgttatatgatggtgtttccgcaagattatttacgattcacaagtctgtttttcgcatattcctgcggttttcgcgccctttataaataattccgataagcgcgcgacgtgttgccgtcacaggttcctctatattggtcaatcgttggcccgcaaccgcagtaagcgtccgggccgtgtagcgaaattgagagagaggaactcaaccatgcgtaacaagaagattctcggcgcactgctcgccgtcaccacgctcgcgaccttcggcctggcaggctgcggcaattccggttccaacgatgccgcctccaaggaggacgacaagaccatcaccgtggccgcctccccgaccccgcacgcggagatcctgaacaaggcggccaaaccgctcgtcgagaaggacggctacaagctggtcgtcaaggaattcaccgactacgtgcagccgaacaccgccaccgaggatggcgaggttgacgccaactacttccagcacaagccgtacctcgacaacttcaacaaggagaagggcacgcatctggtgtccgtggagggcatccacttcgagccgttcggcctgtacccgggcaagaccaaggagctgaaggatcttcaggacggcgccaccgtggccgtgccgaatgatgccaccaacgaggcccgcgcgcttctgctgctgcaggatgccggcctgatcaagctgaaggatccgaaggacatcaacgccacgccgaaggacatcacctccaatccgaagaacctgaagttcaaggagcttgaggccgccgtcgtgccgaccgtcatcaaggatgtcgacatcgcggccctgaacggcaactacgccatccaggccggcttcgacccgaccaaggacacgctagccaccgagaaggccgacggtctggccgcgaagacctaccagaacatcctcgtggtgaaggaaggcaatgagaacaccgccaagaccaaggagctcaagaaggctttgaagtccgacgaggtgcgtgactacatcaacaagaactacaagggcgctgtcgttccggtcttctaagacccgcttcggcagtaggagttcaatgccgcaggtatactaccctgcggcattcttgttatggaacacgattaggaacaggacattatgacgattcagatcgaccatctgcacaaaagctacggcagtggcgccgaagcgcatgaggtgctgcacgacattaacctgaccatcgattcgggtgaggtcttcggcattctcggctcgtccggcgcgggcaaatcgacattggtgcgttgcatcaacctgctggaacgccccacttccggcaaggtgctcatcgacggacgagacatcaccggcgtgaaaggcaaggagctggcggacgtgcgcgccggaatcggcatgatcttccagaacttcagcctgtttcaacagcgcaccgtgctgcgcaacgtgaccttcccgctggaactcaaccacacgccgaaagccaatcgtgaggaacgtgcgcggtatctgctcgatctggtcggtctggctgaccttgccgaccgctaccccagccagctgtccggcggccagcagcagcgcgtggccatcgcaagggcgttggccaacaatccgtccatcatgctgtgcgatgaggccaccagcgcgctcgactccaccacgacggcgcagatcctcgacctgctgcgtcgcatcaaccgtgaacttaatgtgacgctggtcgtcatcacgcattcgctgtccgtggcacgcaacatctgcgaccgtgtggccatgatagacggaggccgcattgtggaaatgggcgatacggaagcgctgttcgccgatccgcacagtgacattctgaagactttgatcgccgacgcgaaggtgacgaaccatcggcatacgcacgaaacggcggatggcgcgaagaatggggcggccgatgattccgcccagaaagaggtgaagtgagatgggacaggtggtttcgcaattcatcgccgattatggcgaactgctggccgaaggcgtgcgtgacacgatcatcatgactgctgtggcgacgctgctggcatatgtgatcggcctgccgatcggcgtgctgctcatcacttccgcgaagaagggcatccgcccgaacgcgccactcaacaccgtgctcggctggatcgtgaacatcgtgcgttccgtgccgttcatcattctgctggtggccatcatcccgctgacccgactgattgtcggcacctcgctcggcgtgccgggcgccatcgtgccgctggtcatcaccgcggctccgttcgtggcgcgcgtggtggaacagtcgctcgccgaagtggacggcagtctggtggaggccgcgcaaagcttcggtgccagcaacctgcagatcgtgttcaaggtgctgctgttcgaaagcctgccatcgctggtgcgcggtgcggcactgacgttcatcaccctgttcggcttctccgccatggccggtaccgtcggcgcgggcggcctgggcgatatcgccatccgttacggctaccagcgttaccagtacgacgtgatgaccgttgccgtgatcctgtgcgtcattctcgtgcagatcgtgcagaccatcggcgacgtggtgtccgaccatatcgaccatcacgagcgttgagccagcacattcgcgttccttatgaaaagcgggtccaaacgtttgttgtttggacccgcttttcgtacacggaaagagacgctgctcgtagacgattacttgttgagctcggccttgaccagaccggccagcttgccgccatcgatggttttgccggcaagcgcggcacgagcggctttgacgacgcgacccatgtccttggggccggccgggttcacttctgccacggcgtcggcgacggctttggcgtagtcctcgtcgctggcggccgccggcaggaaggtttccaggaaatcggcctcggcggtttcgggagcggccttgtccgccagtcccttgtcttcgtacagtttggcggtctcacgacgggtcttgacgcccttctggatgaccttgagcacttcctcgtcggtcgctccgtgaccgttggcgatctccaggttctggatgtccgccaacgtcaggttgatcgggttgagcttggccttgtccttggccttcatcgcggcgatcttagctttcttcagcgcgtccttcatcgacatgttcgttcctcttttcttgaccgttcgaacaccgtcttaatactacgcgtctaccaatccgccgtcctgtatccgtgccgtcggcatccacgccggtctcaagcccatgagacacttggagccatgactacagttatcatgcgcacctcgcatgatacacgtggccggctgtttttggctttgttccaaggttttcgatttttgggaaacatgccgattacgctcgttctccacgaggcacctacaggaacccaagaataatctcattcttctgtgcatatcagcggcttaccgacgcacacgaaagaagcatacgagtgttcccgcgacctatctcagatggcgaagccgctcgatcagatcgacgagcgtctgttcctcctgttccacgcagtctaggaaaatggagcagaacgaatccggcttgccgtccacctgccatgcctccaggccgcgcgcgtatgcccgacccgcatcgtatttgatggctgcgggacggtatccgttccgtagcagcacgaagttgagcagctggcggccggtccgcccattgccatccatgaacggatggatgttctcgaacatcgcgtggaaaccggcggccctgagcagcggatgcgctgcgcagccatccaacccgtcgatcaaggatcgcaggtcgtcgcggatctccagcgggtccgcggtcttgacacgggtcgcggtggtcctcgccagataaccgtacgggcggaacgtgccgcgggcgaacggttggagatccagcgcggtcacctcatggacacgccgaaccagttcctcgtccagcttccgcccctcctcagcatattcgcgcacgtaggccatgccgtcagcgacccctcgcgctgcgaacacgtatctggccggcgagtccgatgggacgaactcgccctccaataccagcgacgtgtcctccagggtcagtgtggatccctcgatggcgttcgagttgtaggtgtagcgcaccagccagtcgcggtcgtaatccgacaatgccatctcctcgacgccatccagaggctccaacgcgcgggcccggcccttcaacgcgtcaatcctccgcagacattcggcggttcccggctcgcgctcaaggccgagcagttcctcgggcaatgcccgtatgcgctgcgacagctcaggattaggcatcatgctcctcttttcgtgttccggttgcaaagtccattattccagtagtgattcgttgcgctagcggtccagatgacggctcaacgcatccggtccggttccgacgcttctggcatccccgtcccgttgtccaaggttcttccgcaacgtctcgccaaacctgtccatcaaatccgttttattgcggatcgggccagaaacacgaaggacctcaccttccctgatcctgcggagcatcccgatacgctttaccaactgtacccggatggcatcgaggcgttcgggcgcgaacatgcgcatgcgcgacaactcatgcgccacctcgtcgggccagtccgacagagcatccagattgaaccggccccaatcctccaccagtttgagctgccgcaaggccgaggggcgtccggtcgccgaatagaacggcttggcgaaccagtctcggccgtccacatcgagctcgccgctccacaggctcgcgccggtgtcgtagatcggagccgggcggaccgcaagggtctcgatgttccggatcagaccgaagttgttgtaatgcctatctgtattgcgcatgaggtagtcgaccacgagccaatcgtccgtggcgtcacgaaccgcccgttcgtctgcgccgaagccgacggcggcgcggatccactggtcatgcgagttgaggccgttgacggccttgacggattggagcacctgccaggcggagaccagctcctcatgattggagagcatgtccgcgcatgtggacaccagacggttgccgttgcgcgccagggaataccggacggccggaacgcccaatcgcatgcagagcctcgaggcgatgacctcgttcatgggctcctggccagtacggcccgacttgacgagcagtctcctgccggtggccctgtcgattgtccagcgtttgggaagatcgccgccagtggacacgtcgggggcgttgaggctgatgtcatgggacgacgagtacgaggtgagcaggatctcgcccagcgcctcgtcgaagggattgtcgaagaagttgacgtccttccattcggccgggtcatcctcgcgtctgacccagtactggtccgacaggctcaaaccgtaggtccggtcgagcagctccccggtcgatgccgcgccaagcgattcgagcacgcggcggatgccgtcgcgggtggaggggatggcgcgggacctccaccattcgtcgatcctcttggcatacagcgcgctcttgccgtgcgtggtgaactccaggggcagacgatcatggtcaaggacctcgccagaggagcacgcgcgaccggactcgggatcgtattcgaacgcaagaaccggatggtccccgcacataatcagcttgcgtggcatgattccgctcccttcaaacttggtctttaaagattctacaggcacgaattacgcgcgagacggcgtaccgtttcatgacgcgatgcatggatatgggccacttccgcaaatcgcaagcctcggcgatgacgccgacaactgatacggtaggcatattggtttcccaaaggtaaagaggcatgaccatgggattgttcgacttcgctaagaactcttcgggtgacgtgccgtccggcttcggcggtcggggcgatatcgccaaccatcttttcaacgaccgatgaaaaggctccggttgaaggctatggcatgatgacacgagcgtggggacatttatgaccgaaggatactcgcataaagcggcacacatcatcgagcacatcgttcttgcgatcgcgctggtctgggccggcggctgcaccctcatatggacgcaaatagacatgccccacagcatcgtgaatgcgaaatccgctgacggcacctgcgaagtgaccatcagcgaactcggctcgcccatattcttcggcccaagcagcatcacggtcaaagtctcttgggacaccgatcccagtgttatcggttccgagaacgtcacggaaatcaaaacggatctgcacaacgacggcaaatcattaggctcgggcaacttcaccgtcacctggcacggcaacatcccgaccgtcaccacccatggcgaggaacagccggaccaaagctacacattcaactggaaataaccgctccgaacatcatgtctctcccgagagtagtcctcacaaccgggcaggtcccacaaggagcatagctcatgcacccaccggccggtctcaagcccatgagacacttaagaccatgactaccatcatcatgcgcacctcgcatgataactgtgatcgactgttttcggctttattccaaggttttctgtccttgggaaacctgtcggtcacgctcattttccacgaggcacctacaggcacccgaaaataatccgggaacactccaccgttctgtcggcgctcagcgtcttcgtcgaccggcatggaaaagaacaatacaccctgtggtttcatgatgttcagcatgggtgacgcccaaaagcattcgtccagcagcacgcctccgcgtcggacaacgggcagaacgatacgcgtcccgcgcaaccgtcccggccgtcacaatggcatcccgattcattcctgcgctatccccacatacctcgccgccgcgccgatcgcgttcaccctcgacgaatatgaggccctgaattccgtcagcaaccggacggccttcaccttgaactcgcccgcgcatcaagtgccctttgccataatcccatcatctcccatcgagctaggggaatgcggaacaaaaaatcagttcatatcactttttctgttccttgaactgagcctggtctctccagcaagtcctactacaataggactcattcctccgcagttcgagaatcgagtcaatatgcgccgaatttgccacattcttgtaggtctcctagtgtgtgccggactcctacgcacagtaagcggctttatttttgactacctacatccagaatacgtgtccagctttccttcatacctttattttttacgagcagttcccttccttatcactgctggtgccgtcgaaactattttattcgtgataaaaaggagaaataaatgaagaaactcaagcaaattgccgctactctagtatctgtaatattggctggaactgtgacagtaaatgcgtcggcagcagaatctatggagactccctataggagtcctaccctatctagctttccgtctaatgcttctctggaagatcttgagaaaacctcagataacgaagatctgagaattatctcatctccttctcggggcgctaattacaaaacgcgcgctgcagaggctgtagctttactgcggatttattccactacaggatctggctcatcatctagtttcacgaatctcggtcattcttggcttatgatcacaaacctgtctggttctacggtaaacattgctgggattaacgttgctgatggtaaatctataacagcaagcacttgggatgaatctgtagatgtcagtagagaacataagggtctgtggctcaatcttgattcgaagcttaattccaatggtattaatcttcagaatgtttccattcaattacccttaaggcaaattgatttaaatacagtaaatactaatattaaaaataacgataaatggggttatcttaccaactgttctactttcgcttcaaaaatttggaattcaattgccagtagcagcagtaaagttgacgctggggccatcaatacaccagccagtctagcaaaaaatattacaaaagttggtgaggcagaatcatacacgttgttaaaatacaatacttcttcaccgcattacgattccgtatattatggttatccgcccataaagagtaataacaataattagataaccaaatctgcctggtaaatccagactagttttatctagaatgagccgcaagtttggcatagcgcttgcggctcatacgcacgatagcaagagccgcagcattcccacccggtctcaagcccatgagacacttaggaccatgactaccattatcatgcgcacctccgaaggtgacatcaaaatcaacctgttcgacgacgaaaccccggaaaccgtggccaatttcctcggccttgccaccggcgagaaggaatggatcgatccgatgaccggccagccttcccatgagccgttctacaacggtctaaccttccaccgcatcatcaaggatttcatgattcagggtggctgcccgctgggcaacggcaccggcggcccgggctacgacttcgacgatgaaattgttcctgatctgaagttcgaccacccgtacctgctggccatggcgaacgccggcctgcgtcgtggcatggacggcaagatccacggcaccaacggttcccagttcttcatcaccaccgtgccgaccccgtggctcgacggccaccacaccatcttcggcgaggttgcggatgacgattccaaggcagtggtcgacaagctcgaagccgtgaacaccgatcgcatggaccgtccgaccgagccggtcggcatcgtgtccgtggaagtgctcaagtaagcgtttcccgcacagccgtacaatatagggaagcccctcgattgaggggctttcttcattttatttatagaggcgtttgcttgcaatcaccggcttatgtgattcgtcaacatcacattttgcgcagtcgcggctccgcggaatccttcgcgccggtgatgcggtacacgtcgaacacgccttcgattttacgcacggcggcgagcagagtgttcagatgctgcggatcggccatttcgaagctgaattggctggtggccacgcggtcggtgccggtggaaatcgagccggagataatgttcacgccgtggtcggacagcacgcgtgtcacatcgctcagcagatgcggacggtcaagcgcctcgacctggatcttgaccatgaacacgcccttggtgctggtccactgcacatccaccacacgttcgggctggcgtttctccagttcgagcatgttctggcagtccacgcgatgcacggacacgccttggttgcgggtgatgaagccgatgatcttgtctccaggaaccggcatgcagcatcgggccagcttgacccagatgtcccccacgcccttgacggagatacccaacgagctggtggtcttcttggtacgctccacctgcttgagcggcaacgcctcctgctcgacttcctcatccacctcgtcgctgcccgcgtcacggaccagatgcgagatgacgttctgcgtggagatctggccatcaccaatcgccacgaacacggcttccgcgttggcaaggttcaactcgtcggcgacgcccaccaatgcttccggagtcagcagcgtggtgattggcaggttgcgcttgcgcatggcgcgcgtcagctcgtcacggccttcctcgacggcttcggtacggcgttccttgctgaaccattgacgaatcttgttgcgtgccttcgggctcttggcgaagctcagccaatcacgcgacggacctgcggattcggacttggatgtcaatatttcaacggtatcgccattctcgagcttggtatcaagcggcaccaatcgtccgttcacgcgcgcacccatggtacggtgaccgacttcggtgtgcaccgcataagcgaaatcaatcggagtggcttcggcgggaagcgagacgatcttgcctttcggcgtgaacacgtagacctctgccgcgcccaaatcctctttgagggagccaaggaattcgtcggaatccggcgtttcgctcgtccagtcggcaagttgctgaatccatttgaggttgtcggcctcgctcagctcctggttttcgccacgcttgcggtcggacttgtcaggcgagctcaacgcgcgtccggcttggccgttctccttgtacttccaatgcgcagcgatgccgaattccgcgcggcggtgcatgtcccacgtgcggatctgaatctccaccggcttgccgccgggaccgaccaccgtggtgtgcaggctctggtacatgttgagcttcggcatggcgatatagtctttgaaacggccgggaacagggttccaccgcgcatgcacggcacccaacgccgcatagcagtcctgaatcgtgtcgacgatgatacgcacgcccaccaaatcataaatgttggcgaaatcgtgcccgcgcacgatcatcttctggtaaatggagaagtagtccttcggacggcccgtcacataggctttgatgtgctgttcgtcgagatcctcattgatttcggcgagaatctgcttcaggtacacgtcgcgttgtccggcgcgacgggccaccaataccacaatctcgttgtagatcttcggatacagaaccttgaagctgagttcttccaactcggttttgatggcgttcatgccaagacggttggcgagcggcgcatacacatccagcgtttcacgtgcctttttctgcgcattcgactgcttgacgtaacgccatgtacgggcgttgtgcacacggtcggcgagcttgaccaccagcacgcgcacgtcgcggctcatcgccaccaccattttgcggatggtctcggcctgggcggaatcgccgtattccattttggaaagcttcgtgacgccgtccaccaggccggtcaccgtgtcgccgaattcggcgcggcattcgtcgagcgtgtagtcggtgtcctccactgtgtcgtgcagaaggcccgctgccacaaccagcggccccatgccaagatcggcgaggatctgcgccactgcaagcggatggatgatgtacggctcgccggatttacgccgttgcgacgaatgctggttgacggcgcgccggtaggctctcgcgagaatgctcatgtcctcgtcgggatggtggtattcgcacatcttgaggattggttcaagcgggtcaagcggattcgtgctgatctcgcagcccaacattctggccgaacgaacctcatgatccatgtcgctcatttcgctcctcctcgcttggaatgtaccctatagtacccgcgcatcaccatatgacggatgtatccggccgcgtgttgcacggccggatacatcctcggtctttgtgtattgcagtcccgtcaggacgcaacgccggttgatccgaagccacgttccgcgcggtcggatccgggcagggtctgcgcctcgatgaattttgcctcgacgtagcgttggatgaccagctgtgcgatgcggtcgcccggatggaacgtcacggcgcgttccggatcgaggttgatcaacggcaccttgatttcgccacggtacccagcgtcgatggttcccggcgcgttaagcaccgtgacgccctgcttgacggcgagtcccgaacgcggatgcaccagcgccacatagccggcaggcaatgcgattgccactcccgtgggcaccagcgcccgctggaacggcttcaacgtcacttcttcggtggtgcgcagatcggcaccggcatctccggcatgggcgtaatgcagctgagccggctgcccgggatccagcgactttaccagaacctcgacgttttccggctcgttgtatgcctcgtcgaacgccatcaggccgcacactccttgcataccggctgtccgtcgtcggtagtgtaggcaagctggctgcgatgcttcaccaggaagcattcggagcagatgaactcgtcgccctgcatcggaatgacggtcaccgaagcgtcctcattgctcaaatcggcgcccggcagctcgtagtcttcggcaatggcgttctcgtcatcgtccatatcgttggaattgttctgagaacccttgctcaaagcctggagcgactcctcgtcctcgtctttgttgcgcggggaatcataatcctgtgccatcgagattcctttcgtcatctatggtgcttatgcgccatagaatacatgacttttcccccgctaggatacacgaattgaaatactcgtaaaatccgacacgtggggcacaatagaattaatagaaaaatctaagggaaagtggtgtgttgtgcctgagaatgcgctcgaagatgcacggttcgatcatgtgagtgaaaccggtgagctcgtctttgtttcaggtgccggcaaattcgccgtcaaggtcgatgaagcgcttgaaagagccattttggaggcaaaacagattcgcaccgaaacccaagaggagcgtcagcagcaagcgccttccacgctgccgatctcccaaatccaatccttgattcgagccggagccaatccgacccgcgtggcggagcgatattcgttgagcgaagcgcttgttcggcgtttctcggcggcggtggaaaccgaaaagcaatatgcgatcgaacagttcctggcggttcccgcgccgaaggaaagccgtgtgcgcacgctttccgaactgatcgaacgcactttcgccgcagcccacgtacggttggaggatgtgcggtggaaggccaccagacgcggtttggaaccgtggaagattaccgcggagttcgattccgcaggtcatgccgcccgtgcggaatggtcttggaacatgcatgacaacgcggtcaactgtctgaacgcaacggcacgcaagctcatcggcgagcaagacacgcctacggaaggacacgccgagaagcaggtcgaccagaattttctcgcatcattgaatttgccgggcgattccgcacgttccgcacgtatcgaacagacggtgtccgcttggaatgctccggaaccggttgcaccacaagccacgaatatcaagaccaccgttgagactcagtcatcggcgaccgttccgctgccgaaccgtccggaaatcgcgacgacgcagtcccccgccccttcaacgacggaacctgcccaaaactcgcaaaacacgcaatccgccggcgagcagcagtccgataagtccaagacggcatcatccgatcctcatagtcagagcaccaccaaatcgaagcgccgtgcaggacgctccgcagtgccgagttgggatgaaattctgttcggtgactgattaacgttccctaacatcccacggcaacatccgttcagacgttcggatcattcgatcaagccacgtcaatcaggcatggaatatcagattccatgtaggtcagcgacccgtgcacgctgggcagatgcatcgccttctccgcctgtgtgcgggaatcgacaatggtggtagagcccgcagcggagacgaccacatcgccgatcatcgacttgacgcgttcatcgactggtccgtagacgccttcctcgattgcctgccggcgggtgcgcacctgggcgcgctcccccagcacgtcacgccaacgagcggcgatgtcctccggattctcgccatcctcgccataaagcatgacacagcgtggttcgccgccgacattcgcgacgccccacatcagctggggttcggacgctatgtcgatgcaggcttccgggtcggcggttatcatgccatgatccgccacgatgacgatcagcgtgttcttcggcacacttcgacgcagcaaagacaactgggcgtcgatacgctcatatgtgccgatccacttgtcggagtcccagccgtaattgtgtccgatcttgtccgcgtcgcgcaggtacacgtatgtcagtccgggcgtgttcgccgctttcgccgcggtcatgatacgtcggcgtggatcgtcattggagatgtagtcgctgccacgtaacgccgcctgagtcaacgcggagaacgcgaatttcggcagtcccgaactggtgacgcgaacgtcctgttccgccaatcgttcgaatatggtcggctgctgttgcagtttcagcggtgcgggcgcgtttttgaaagagatgagctggcagatttcgccattgtcgggattgagctgcgtatatcccgtcatgccggttaatccggggcatgtgccggtgccgaacgtggacattgcggccacggtggtgctgggcatgcatgtggcgattggccgctggttaacgccatccgccatcagcgaccgtagatagggtgaatgccccaatctcatattgatgttccaatatccgagaccgtccaccaggaccacgactgccgaacgcgcgtccggcaggccaagtgcctcttggagtcgtttcggatcggcatggatggccgttggaatcggatgcccgatggcgctggaaatggcgggaagtaccgaggataggtggagagcaccgccgcggccgccctcatccggcagttcgtcgccatatcgtgccggactggtcatggctagcagctggtcgatttcgggcacttcaacactcatggttcccattcaagcaccgcggcagtaccagctggtaatattgctaggttgattaccataacctttccgtgaggagaaccaccgcatggtgtcgcaccgcaaaccggcaaaaccagcctttgacccgcgtacggtcaaggagaacatcgtcgaaacgccgttgaacgaggaaatgagcaagtcgttcctcgaatacgcgtattcggtgatttacgcccgagcgctgcctgatgccagggacggtctcaagccggtgcaacgacgcatcatctatcagatgggtcagatgagcctcaatccggaccggccgtatatgaagtcggcgcgtgtggttggcgaagtgatgggcaagctccatccgcatggcgattccgcgatttacgaggcgatggtacgtttggcgcagccgttcgcgatgcggctgccattggtggacggtcacggcaatttcggttctctcgatgatggtcctgctgcttctcgttataccgaggctcgtatggcgccggccgcgttgggcatgaatgccgatatcgccgaaaataccgtcgatttcacgccgaattacgataacaagcttcaggagccgactgtgctgcctgccgcgattccgaacctgctggtcaatggtggttccggcattgccgtcggcatggccacgaatatggccacgcacaatcttggcgaggtggtggctgcggccaagcatcttatgcgccatcccgacgcgacgttagaggagttgatgcgctacgtgccgggtccggattggccgggcggcggcgtgattgtgggccgcaagggcatccgcgaggcgtacgagacgggtcgtggcgcgttgaccacgcgttccgtgacgcatatcgaaaacgtgacggctcgcaaaaaggccatcgtcgtgacggaactgccgttcatggtgggtccggaacgtgtgttggaacgtatttccgaaggtgtgaagaaccgtaagctggacggcatttccggtgccatcgatttgactgaccggcataacggcacgcgcctcgtcatcgaaatcaaaaccgggttcgatccgaacgcggtgttggcgcagctgttcaagcacacgccgttgcaggacaatttcaccatcaacaatgtggcgttggtcaatggccgtccgcacaccatgggattgaaggaaatgcttcaggtgtgggtggaccatcgtcgtgtggtgatccgccgacgcagtgaattccgcaggaagaaggcgcttgagcggctgcacttggtggagggcttgctgctcgccatggtggacatcgatgaagtcattcaggtgattcgctcttctgatgatgccgaggccgcgaaaacaaagcttatcgccgtattcgatctggacgagattcaggcacagtacattcttgacttgcggctgcgccgtctgaccaagatgagtcgtatcgagcttgaggcggaacgcgacgatctgaagcggcgtatcgaagagcttgaacgcattcttgcttccgatgaggcgcttgacggcgtggtcattgacgaaatggatgacgccgtggccaaatacggcactccccggcgcacggtgctgctggatgaggatgaggaaggcaatttgacgcctgttgtggcgcatggcgatgatggcgtctctgcaaacgcgatggctgccgcgcgcgccgccgcgaccgtatcctccgcagcagccgatgtcgccgcagccgcaaaggccgcaaagaagaccggcgatgagaatgccaccgcatcggctctgcagattgatgacgagccgtgcgcggtgatgctgtccgccacgggcctgatcgcacgcacttccgaggatgcggtggaacgttgggagaatcgttcggcttccgacggacgtgccaaggatgatcagatcgtttcgatgttccgcacgtccacacgttcctcatacggcttggttacttcagcgggtcgtctggtgctggcccatgtggtcgaattgccgaaggtttccgcggatgggccgctcagtgtcacgggtggtgtgaaggccgaggaactgctgggcatgacggagaacaccgatccgatccgcggcgaacgggtgattgctgcgattgatatgccttccacggatgacggcggtcagcttgttcctttggcgttgggcacccgcaacggcgtggtcaagcgttggaaccgtgaatctccgaccacaatggattcgtggagcgtcatcgatttgaaggatgatgacgaagtgcttgccgctgccgaagcccgtgatgaggatcgtctggtgtttgtgtccaccgattcctcgttgttgacgttcgaagcgaagaatgtgcgtccgcagggccgtaccgctggcggcatggcgggcattcgtctggctgaggggtgttcggtggccgcgttcgcggtggtgcctgatggcaaggtgacatggaattacgaagaaggcgagaatggactgttctctgcttccggagccgtggtgttgacggttgccggcgattccgaagcgttgcctggcactgaaaacggtgccgcgaaggtcacgccgttggagatgtatccgacgaagggccgtggtacgggtggcgtgcgttcgcagcgattcctcaaggggcaggatacgttgattctcgcgttcgtgggcgcgtatccgttgcatgcttccacgcaaagtggcgctcctgtggaattgccgaagcctgatatgcgacgcgatggttccggtacggatctgtcggcgccgattgcggtggtcggctgattcgacgaaatcgattggcggggctctggactggttcttcttccggttcagggccttcccgttttgcgcacttgggccgccaggttgaatgagcaggctgggtgaaagtgcctccggcttggttcagccatatagcttcatgccttgtgggctgtccacgaacccggcagcatgcagcaaacgtctgtattcgttgcgttccttcaatgattcaccgttcatttcggcgaagctgacgctgcccttggactgatgctgcaatgcataggcaagttccgtacatgccggctgcaatattcgctcgtcatcggtgaagctgacgattctgtggcttttcggcacggcaaacagcaccggcatgccgtggtcgagcacgatgaccgattccgctctgcgcgccggtttcatatggtgttgttcgggccatgtgatcgcggagcctgtcaggttggccgggtcggtcacgtcgagcgccacgcaggattggctgcgcgcctcgtcgtcgccgcgcaaggcgtccactgtgtcacgtccggcgaattggaccgctccgaatcctttgacgaacatgcctctgaccagattgccgtgttcctccatacgtttgagtaccgggtatagtccggagaatccgcctgcgacctgctccttgtcgattagcggagcggcgatcacgccatatcggtcgagcagcgattcgatcaatgcgatgtcgtattcctcgatgccggctgttggtttgccggcggtatcgttcgcttgatccggtatcgccattggactggtccgggacgagtcgaccgcggaccataatccaccgagcgtcgccggtgtcgaggcgtggatccgtacgcgtctgcgtgcggcagtgcgtggcgcgcgcactgaaaccgtgccttgagtcaaggcccgaacgggagcgaatgaactgttcgtcactttgccttgccataccaaggaccacaaggcttcctcgaactggctttcgccccatgcgggaaggatgatttcccctgtttcaggattcacgttgacttccgcatgttcctgccagatggctttggcggctgtggaaagctgccgcgcatggaaggctcccccattcgataatacggcaagtatcgtctccggcacggtcatggttccggcactataggcattgttctgcgattgttcgccgggtttcgtcagcagccgtgaatcagctggatggaatgcgatgccgccggcttccttggcgttggaaccattgattttggagccgacccataccacgtctccggatgcgagcaattcgtccaacatactcggttggtagtcgcgaacgcgtgcggggaagaccgaggattcccaaacggaggcgttgaggtatatgccttcaagctgttcgatcacacgcatcagcccgtcgacgctttcatatcgggcgccacccacaggtccgacaccttgtctgtccaacaggaacgcctgatagacggccggttccaccggcttgatggctttgcgtgccttggcaagcgaaagcgcgcggatacgccgaaacacgtctttgtggagccattgctggggcgtttgccgaggtgaccgttccgatgctgaatcatcggaaccattggcgtccgctccggccgcatcatcgacgaaatggcctttcagcagttcgcctttggcatgtaattcatccaacatgcgtacgccttggacagcgtccaatcccagttcggcgatcatctgatccgcggtgaatgggccatgcgttttgacatatcgcgccacacggccggcaatgtcggtctcgtccaaatcgttccagaacgtccgtccggcaagctccttcccaacctgcgcgatgacgtcggcatccaacagcgaagccatgtccgtggctcccagaagacgttccagcacttccgggtccatggacagcagttgcgtgctgcgttcggcttgcggcacgtcgtattggtacatgaccgcgcccacgtatccgaacagcatgttttccgcgaacggcgacggcgtttccgtgacggtctcgctcaaagagatgacgccggagcgtaatccggacatcacatgtttcagcgcgggcagatcgtacacgtcctgtaggcattcgcgtgcggtttccaacagcaacgggaagttcttccgagttcgggcggcgttgagcagttgcgccgcgcgcagccgctgctgccataaggggacgcgtctgccggggttggcgcgtggcaggaacagcgatcgcgccgcgcattctcggaatcgtgcggcatacagcacgctttcgccgacttgcgtttcgatgatgcgttgcagctcttccgtgtcgaacagcagcagctcgcggatcggcaggttgccgtcgccgtccgggaggcggatgatgatgccgtcgtcggccgcgtatacctgcccatcgaacccgtatcgttgtttgatacgtgtggtgatggccatggcccatggttcgtgcacgcgtctgccgtatggcgagtggacgatcacacgccaatcgccttcttcatcctggcagcgttcgacgaccagctcacggtcgttgggaatcgttcccgtggcggcgcgctgttcggcaagcaggtcggcaagattgccgatggcgttgtcgtccaatccgtcacgacgtagacgtgcgattgttgtcgtgtcgaatcggctggtcttgtctcctgcgatgccgtccgagacttccgcgcgtagtccttgcgccatatcgcgtatgaatcggccttgggaccgtccgaatgccgcgtcccgcccgtcgccttcgccatgccagaacggcagtcgggcggtacgccctggagcaggaaccaccaccacacggtcccgggtgatttcctggatctgccaggtcgatgtgccgagggtgatgacgtctccaacccgggattcgtacaccatttcctcatccagctcccccactttgcgtgggcccggtccggagccttcttcgggaagcaccacggtgtaggttcctcggtcgggtatggtgcctccgctggtcacggccagtcgttgagcgccagggcgcgcggagatgagacccgcctcttcgttgtattgcaatggaggtcggaaggcggagaaatcctcgccgttgtaggcaccggtcatcatgcccatcacagcatcgaacatggttctgtcgagatcttcgaatggcgcggccttgcgcacggtcacgtaccagtcgtctggtttcagatcatccatcgccgcggcggcgacggtttgctgggcaagcacgtccaagggggtgcatggaatggtcagtgtttcgatgtctccggagcgcatgcattcgatgcttgcggccgtgccgatgatttgctctcgtgtaatcgggtagaacagtgcatgcgagactcccccgaccttgtggtcggcgcgccccacccgctgcaatcccgaggacacggacaatggcggtgcgatctggatgaccagatccactgaacccatgtcgatgccgagttcaaggctcgatgtggcgaccacgcaacgcaattggccgcgtttgagctgctcttcgatctgtttgcgccggtctttggaaacggaaccatgatgcgccatggcgatcgcgtcggcgtccgcatgcgaggagaccagcatggtggtggatccgaccacggaatcgtagtgtttggcgaagccttcacggccttccggggagcccagatccggatacggctgggtggaatcactggctgtggactccggctgggatgcgttgtccgacacactcaagtccgttcggccaagcctacggtcggacagcgcatcccgccctgcgtccgctttgacggcggtttcagacccagttttccgggatgtgcgcaattgcgcatacaggtcgttgagccgtgcggtgagtttttccgcaaggccacgggagttgacgaacacgagggtggtgtggtgtttcagcacttcgtcaagcacgctgcgttcgatggccggccataccgaacctccggtcgaaacccgtgaggtatgttcatctcccccgaccgaagtcagtcctttacgttccgccaatgcctccatggcaggacccaccccggaaatatgcgtggtatggcggttcggaagtttcacggcgcctgccctccgccctgcgtcgtcggagacgggatcgcgcatggccgaaagcggttccaccactttcagatccatgtcggggtgcgattcgggtctgatgacgcgtaccggccgcgtgccgccaaggaaacgtgcggcttcggccggcggttccacagtggcggaaagcccgatgcgttggacagaccggccggcaaggctttccaatcgttccaagctcagcgccaggtgcgcgccacgtttggagcccgcgatggcgtgcacttcatccacgataacggtatcaacggcggaaagtatccgtcgcgccttggaggtgagcagcaggaacagcgattctggcgtggttacgaggatatccggcggatggctgacgattctgcgccgttcctgcggcgtggtgtcgccgcttcgtatgcccacgctgactttcggcgatggcaatcccatcgcctcgcactgtccggcgatgccagccaatggcgcttggaggttcttggccacatccacgcccagagccttcaatggcgaaatatacaggaccttgacgccgcggacgggtttacgtttcttggcattgcaatcggattcagccgtgccgtccccaccgccggacgtccgcaataagtcatcgccctccttcgtcatcagacggtcgattgcggaaaggaaggcgcacaatgtcttgccggagccggtgggcgccaccaccaacacgttctcgccggagcagatggccggccatgccaaacgttgcgcctccgtcggagcattgaacgcatgcttgaaccaggcattggtagcctccgagaacaagtccatgcattcgtacatacgttcgattatggcatcgccttcagacatcatccacaaccggcggaaagctcgtcatccaccgtcgtcggctcattcgagcacaccgcccggctgacacattcgagcgtctcacatatggcgtcgtcaggcggccgcacggtcgccgcacttgcggcgcaaagtctcatgcatggcgaccatcagcgccaggaacaccaccagatagaacgggaacaggttgaccgaaacatgttgcgcgatcagcccgaacagcggcggcatgcacatcgatcccacataggcgcaagccatctgcatgccgacgatggcctgcgatttgtcctcgccgaaataagcaggagtggaatggatgacgcacggatagatcggcgcgcagcccaaaccgatgaccattagtcccgcgatggtgccgatattgtgcagcaacggcaggagcatgatgacgatgccggtcagcaccaacgcctggccaagacgaatcatggccggatcgttcagtttcatggtcaggaaaccgctggcgagacgtccgacggtgatgccgatgcaaaacaggcttccccacatggccgccgtggtcttgtcgatgcccttgccaagcgccatatagctgctggcccacaacatggcggtcgattcgagcgcggaatagcagaagaacatcacgaggatctcgcgggcgccacggatggcgagcacaccgcgaataccaagcggcttgcgccggtcagccgtttccccttccgattgctcggactgcgcggattgcacggaagaggtttcactcgtccgctgcggttcgacggtcttacgcgccttccacaacggcaggctcagcaccagcaccgcggtgagcacgacctgcagaatggagatggtccggtagccccacgcccaaccatggccggcacccaatgcgcttgccatgatgtacgggccaagcagagtgcccaagccccacatggcgtgcagccagctcatgtgacggctttcgtagtggattgccacatagttgttgagcgccgcatcgacgccgcccgcgcccaagccgtacggaatggcgaagagcagcagcatccagtaattcggcgagatggagaagccgaacaatgcgaacgccgtcaacgcaacggacactgccgtgaccttgcctgcaccgaaccgcaaggtcatgcggtcggatagcagcgcggacacgatggtgccggcggaaatcgtcatggaaatgccacccgcccaggaaatcggcgcatgcaggtcgccgctcatcgtcggccatgcggcgccgagcaccgcgtccggcagacccagactgatgaaggcgatgtaaatcacggcgagcagcaaattggccacagtcagctccttgtatgttttatgtttgcggcaataaaatcacgaaaatactccgctattttatccaaagttacctaccaaacggtattttgtatcttgcactatcgaccgacgtttttgcattatcgtgcatacacgaaaagcgggtctccgccgtaacgcaaggcccgccaatcgcaatcgccatgcaatatcaggtgtcgatcttggaacggtcgaaatcgtcggcgttctccacgatgaacgccttgcgcggcggcacgtcatcacccatgagcaggctgaagatgtggctggcctgttcggcgtcctccatgcggatacggcgcagcatgcgggtgcgcggatccatggtggtatcggccagctggtcggcgtccatctcacccaaacccttgtaacgctggatgtcctcgttgtagccgatgtgctttttatcaagctcggcgagtttgcctgccaactcatcatcggaatacgtgtagatgtactcgcccttatgcgtacccgtcaacgcgatacgatgcagcggcggcactgcggcatacacatgaccgtattcgataagcggccgcatgtaccggtagaacagcgtcagcagcaggatgcggatgtgcgcgccgtcgacatcggcatcggtcatcatgatgatcttgttgtatcgggcctgttcgatgtcgaagcttgcgccggatcctgcgccgaccacctggatgatggctgcgcattccttgttggacagcatctgcgcgagcgatgccttctgcacgttgaggattttgcctcgaatcggcagcaacgcttggaaaccggaattacgggcggccttggctgtgcccaatgcggaatcaccctcgacgatgaacagttcggccacatcgtcattgccgggctggcagtcggacagtttcggcggcatggacgcggattcaagcgcgttcttacggcgtgtgacttccttggtcttgcgcgcctgcacgcgggcatgcatttcgccgacgattttctccagcacgcggccggactgttccttgtaaccgcgtttggagccggtaatcatctcaccgaactgcttatcggtcattctggagacgatcggcttgacttgcgcagtgccgagcacgtccttggtctggccttggaactgcggttcggcgatgcggacggtgacaacggccaccagaccggcgagaatgtcgtcacgttccaccttcatatgggaatccttgagattcaccttgagtttgcgcgcgttgtcctcgatggccttgcgcacctgcttggtgatgccttggaggaagccgtccacgtgcatgccgccgccgggcgtctccaccacgttgacgaagctgcgcatggtggtgtcgtagccgttggtccatcgcatggcgatatcgactgcgcaatcacgcgtcaccttctgcgcatgcagttcaccatcgtctccgaccgcctgcgtttcttcaacatacgtgtcctcgccggcgatgcgccaaatatcggagaccgcttcgcctttggacaggaagtcgacgaaatccttcacgcctccggtatggcagaattcttcgacgcgcgcatgcggatatttcggctgcacgggctgggaaacggtttcctgcgattgcgtggcagcatcgttttcttgcgattcggctgactcatcagcttcggctgaatcctcctgcagtatgtcggcagaggttccgatatcatccgtttcagcggacgtgttctcttccgtcacctgttcgatgacattgtcatcgacttccagcatttcgtcaatggactcgtcgccggtttcgggaatgttctcgtcgatgacggtgattttcagccctggcaccaggaaactggtctgccgtacacggtcgatgagctggtcatagctgaatttagcggtgtcgttgaaaatctccggatccgcccaatagcggatgcgggtacccgtggtcttcggactgactttgccgatgatctcaagttcggtgggacgattcttgcgcgtcttcttgaatggcgaatcgggagacgggtgttccggatcaacgtcggaatacactccggggtggccctgatggaaagccatgtggtgggttttgccgtcacgatccacttccacgtcgagacgggagctcaatgcgttcacaacggatgagccgacaccatgcagaccgccggaagcgccatacgaggaattgccgaatttggcgccggcatgcagcttggtcagcaccacttccacgccggtgagcttggttttcggctccacgtccaccggaatgcctcggccattgtccgccacttcaacggaaccatcgtcatgcaaggtcacgatgatgtggttgcaggctcccgcaagagcctcatcgacggcattgtcgatgatctcccacaggcagtgcatcaggccctggctgtcggtcgtgccgatgtacatgcccggacgtttgcgcaccgcatccaagccttcgagcacggtaagactctcagcaccgtaattatccttagccatgttccctttcaattgtcgccttacaagacatgaagtcgagaaaccctgcgttcatgccggtttctcgacttcatttactcgcgtctgattactatcactggtccaggaagtcgcgcagcgtctgcgaacgggacggatggcgcagcttggacatggtcttcgattcgatttggcggatacgttcgcgcgtcacgccatacacacgtccgatatcatccagcgtcttcggctggccgtcctccaaaccgtagcgcatcttgatgacgccagcttcacgcggagacagcgtttcaagcacctgcttgaactgctcctgcaacagcgagaaggcgacggcatcggacggtgcgatggcgtcggtgtcttcgatcagatcaccgaactcggaatcgccatcctcgcccagcggcgtgtgcagggaaatcggctcacgcccgtacttctgcacttcctgcaccttctcgaccggcatgtcgagctcgcgggccagttcgtccggcgtaggttcgcggccgaggtcctgaagcatctggcgctgcacgcgggacagcttgttgatgacttccaccatatgcacaggcacacgaatggtgcgggcctgatcagccatggcacgggtgatggcctggcgaatccaccatgtggcgtacgtggagaacttgaagcccttcttccagtcgaacttctctacggcacgaatcagaccaagattgccttcctgaatcaaatcgaggaacagcatgccacggcccgtatagcgcttggcaagagagaccacgagtcgaaggttggcttccagcagatggtccttggcgcgcttgccgtcgttcgcggcccacttcagttcacgccggcgcttgaaatccatcttgtcggattccgtgtccagcagatgttgggcgtacagaccggcctcgatgcgttcggacaggtcgacttcctgttcggcgttcagcaggttcactcggccgatctgcttcaggtaatccttgaccggatctgcggtggcgccggctgcgatcacacgacgcttcggattgccggacggcgtcagattgtcgtcgtcatcatcgtcacgcaccacgaaagcgcctttttccttgggctcttccggctttttgcgcttgtcttcgtcatcgtcttccagttcggaatcgtcatcctcgtcgatattgtcctcgtcgaggtcgtcatcctccccttcgtcgtccacgtcatcaaggtcatcgtcgaaatcatcaagatcggcatcctcgacgggatcgtcttcaggagcgtcctgctcgatcaggttctcttcttcttccgctttcttgcttttcttggcggcggaggtcttcttcgcggccgtcttgcgcgacgtcttcgtagcggtctttgaggactcgctcttcttggcagcaggcttgcgcgtggaggccttttttccggaggtggtcttttcggtcagatcagtctgttccgtatttaccgtcgtttccttggtggccaaacttatcctcctattgatcccgccggaagcgtataccatatggacccacttctggcaagggcaaatcgtcaactatgtgagttaaccatcttgcgaggacgattattcccgcgtgttgagctcaccatgcgcaagtaccgcttcctttcggcgtgttgctctatgtctcttcggcccatgccggtccgatatgacgatgcgccgcggagcagatgatcgccgcgagcgaacaattctcatccaacgcgagcgcacgcatcgcgcacagcatggcgcgctcatcgcccatccaccacagcacataactgatgatggccaatggctgcacatgataccgttcggggaccatcccgatgatgtcgaacatcatgttgacgccgttgtcgcaacgtttcgtgtcgggttttcttgatgcgtcacggaacgatccgttgagggattcctccagatgacgcgtgttgccgggaagtgtcggattggccatgaatcccatgagaaagtcacgtgacgaacgtcgttcatccacgatgatggagaccagcagcgcgtcacgcaccgccatggtctgctgcatggcgatggcaagtgctcccgcaccgtttctggacagtctgcattctggcgatgaatcgtcacctcccgacgattcatcggccagctcatccatccattccgagaatggctcctgcaggaaatcgcgtatgctctccgccatgcccagcgatttgcaatcctccaccaattggtcttcaagccgttccatctcggcttcgcatatcggcatgggctcgtcgatcgtcttcatgtctcgtcctccttggcgtatcggagcggtcgcttgatgcaggccgctttgttggaactatgcatcatccggcaatgcaatgaggcgtttcggcacccctgtggtcggagaacgtgaagctcggcgtgtcacgaaacgtccggcaccgtctcacccgctgcaatcattatgttttcctcttgtcgaatgtgtgtggataaccttgacccatgactagctctcccgatttggaacagattgaaacgcgcacgctctcgctggtaagggatttttcgttcctgcatgcggacgatccggtggcgaattcctgcaaagccgtcgctgatgcggtggcgcagcaggcggtcacgtcaagtgagggcggcaaacgtctgcgggcgttgctgacgttggatgcgttccgtgcgttcgcgccgcaggatgtggcggaacgtgatatggatgcggtgttggatctggcatgcgcgatcgaagtgtttcagaccggcgcgttggtgcatgacgacatcatcgacgattccgatctgcgccgtggcaagccgtccgctcatcgtgcgcttgccacggatacccatagtgatgccatcggccatggtttgggcatcatgttgggtgatatgctggccaccgcgagcgtggatatcgccaataaagcggcttgccggcttggctccgggtcttccgtggtgtcggccttcctgaatatgcaccgtgaagtggaaatcggccaagtactcgatttggccgtggaactcaatacgttagacgatcctgaagagctggcgtcggcctctttgaatgtcttccgttggaagaccgccagttataccactatcgcacctttggaattcggtatgcttgccgccggcctcgcccctgcggacgcgcgcaggctcgcactggcgattggattgcctcttggtttggcgttccagctcgcggatgatcttctggacgtcatcgggtcgagccgcaataccggcaaaccggtgggcggtgatatccgtgaaggcaaacgcacggtgttgctggccgatgcgattgaggctgccggcgatgtcgaacgacgtgaactcatcgacatgtgggaagccgaatcacgtgacgaggcacatgttaggcgtgccatcgcattgttcgagtccactggtgccatcgcacgttccaaggaacggatcgccggtctgtggctcgagtcgaaggccgccatcgagacgcttgaactatcgcaggatcgcaaagacacgcttaccgaagcatgcgcacgtttcgtaccgattgtgcgggaacagggctgatgccaccgcactgtgaaagacccgtgttcatcgcatcttccgcaaaccattccttgtagactacaagtgaacacatctttgtcgcgaaacgttttttgaagaaggaatcgtaccgattagccatgagtgaagcccagcatgcccccgaaggccaggtcatcgaaggccggtaccgagtcgtcagcagaatcgccgatggcggcatggccacggtgtatcaagctgttgacgagcgtctgggacgtaccgtcgccattaagatcatgcacacgcagctggcacagggcccacaacgcgaccagttcgtggaacgtttccatcgcgaggcccgttccgcagcagcaatagccaatccccatatcgtgcaggtgtatgacaccggtgagttcgatggactggattttcttgtcatggagtacgtgcatggcgtgaacctgcggtacgaaatgaaccagcaagtcacgttcagcgttcgtgagacgctacgcatagtcggtgagacgttggacggcttggcttcggcgcatcgcgcaggcgtggtgcaccgcgatatcaaaccggagaatattctgctcaatgaccgaggacatgtgcagatcaccgatttcggcctggccaaggcggtgtcgcaggccacgctgtcctccaccggcatgctgctgggcacggccgcctatctggcgccagaaatgattcagcacaatcaggcaacgccgcagggagacctgtattccgtaggcatcatggcttgggagatgctggccggcaaggtgccgttcaccgcggacaatccggtgacgctggtgttcaagcacgtgcatgaggatgtgccggatatcacgaccgcttgtccgggcatcaatgcaggcgtggccgcattcctcgcccgtcttacggcgcgcgcggtcgaggaccgtccccaggatgcgtccgtggcattcgacgaattgcagcagttgcaatcgaacctcaccatcgacgactggcaataccgtctgtcagccgtttccccggccgcaaacgatgccgccgacaccatgcccggcgatggcacccggcagatgccgctaccgcccgctcccccagcaccgcctgtgcgtcagaacgacgatcgtacacgacagttcaatccggaaaacccgaacaaaaccaccgtcatgccggcgcagcaggcagatccggaggcaaccacccgcttggctttggaaaagaacgacgtccccgccaacaacgttccagcttccccctcgaacggtccggtcagtggtggacagccgaaacgcagtggcaagcgtgcacctgtcatcatcgccgtcgtagcagccatcgtgcttgcctgcgcaggcggtggaggctatgcctggtggtatttccgaggaccgggcagctactggaccatgcctcagccggcagatctcacatgttccgattcggagccctgccgtatttccaacatcaaatggaacgcctatgaggaactgctgaaattctccaacatcgagtacgaagagaccgaggcgttcagtgattccgtcaaggctggcaatgtcatctccaccgacccggagaatgtcggttcgcatgtgagcaaacgtcatcatcagaaggtcaaggtggtagtgtccaagggtattaagcagggcactgttcccacagacattctcgatgccaccagtgcgaacggcaaggatccgatcaacgcgttgaagcgtgccggcttcgacaacatcgaacagactccggccaatgatgacgcgtattccatggacgtacctcagggcgcgttgcttgatttaagcgtggatcccggcgcgactctgccccataacgcgaagattaccgtcacgctgtcccaaggaccgaaaccggttaccatgccggacgtcgtgggcaaatcgaaggatgaggcgcagcagacgcttgatgcgctcaagctcaccgtcaactggaccgagcaattcgatgacaagattccgcaaggacaggtgatttccgcttccgcgaagaccggagacgagttgcactggggcgatagcgtcaatgcggtggtgtcgaagggaccggaaaccgtaacgctgccgaattatgtcggacagaaagccgccgctgccaaagccgcattggagaagctgggattcagtgtgaagatcagctcgcaactgacacttgactccagtcaagacaagaaggtcgcttcgcaggatccggtaggaggcaccgaggtgcgactgcgtcaggaggatggcacgccgaataccgtcaccttgaaaatgtattcgtcgctgttcgactgattatcctgattccaaaccaatcaggggtgtctgttccgaaaacattcttcggaacagacacccctgattggtttggaatgaacctcgctgaaaacttatgccttcttggcagcggattcggcttgtgcctgcgcttcggcctcctgctgggctttgagctcggccttgaccttctgcgcgtattcgtcgacgtattcctgtccgctcatcttctggatctcacgggtcacgcggtcggtaagcgaacgcaaatcatcgtgggtaatctggtcggcggatttcttctcgacttcaatcggcttgccgtaaatcaccttggacttgcctttgttcggaatgacctgtcctggcttctgcagttcacgcgaaccgatgatggcggccggaataatggggcaaccggtttcgaatgccagacgcgccgcgccggtgtgtcctttgtaaagacgtccatcggggctgcgagtaccttcgatgtgaatgccgaacagatgtccgtcctcgatgatctcacgggcgtggttcagtgcgccaagtgatttggaaccgccggaacggtccacggggaacacgccgactgacgtgaaccaccatttcttgaatttgcctttgatgcctttgccttcgaaatattcggccttgcccatgaaatgaatcatgcgcgggcaggtcaacggcagcaacgcatcgtcgatgacggcaagatggttggctgcgataatggcgccaccttcgtgcggaatgttctcaagtccttgcgcggtcggtcccaaacggtggatggcgataggtcccaagcctttaacgaaaaaccaatagagcattcttcacaatcctcccggcggattggcgtccgcccgattagagtataagtatgactgacctcaacaatagcaatgacgatgaagaacgcccaaatgacgcgtcgcatggtggcggctctccaatggacgacttggatgcggcttgggccgagtttgcggattcgcatgctgacgatttgaaggccgtggaacgttcgcgtagtgcgaaacgtttcgagaagcatgcgcaacgtcgggaaaaagaggctttgctgtccatcgatgacttggatcagggcacgttcaccaatgatgcgccggcgaatggtcgtgggccgcgcgatttcactggttcgagctggcttgacacggatcgggtcatggaccgttacggtgacgacttcgtgccgccgaatcctgaaatcggccatgtgaaactgtcaaaactggtgttctggatattgctggtggccggcgtcatcggcattatcgcttccgtgttcgttccggcgttggcttcgattcttggttcgattttcggtttgtgtgcgctggtcggcgccgctggcctcatcgtgcagcataaagggcatcgtgaaacgcgtaccgacgaattcgatgatggagcacgcgtctgacgattctttggcgacaaactgaatacatccatctatgtgaaggccccggcggttattgaactgcgccccgtttgttggacgttgttaattgggatacagggtcagaccgcgagggacatgctccggaactcctccggggtgcgtccctcgagtcgtatctggcgtcgtctggtgttccaatggatgatgtaggcgtccagctcgcgtttgaactgttcgtacgagtcgaacacacggccgcggtagaactcgtccttcaagtggccgaagacctgctcggccgccgcgttgtccaggcagttgcccttgcggctcatggactggcggatgccgaggcgttcgagctcgtcccgccaccattggtgctggtactgccatcccatatctcccgtaccatcggctccacgtccggcctggacacgtgcgccgggcgcgacaggtggtggtagtacgtggatttcggcaacccggctatcctcaggaggtggccgagccggtgtccccgccctgcgagcagtcggacgacggcgcttcgctcgcgccgcgtgacttggacgcccgcagggcccggagtttttccaggtacgcgaccttcgccttcaggtacgcgacctgttcggcgagctcctgctcgcgcgtcggttcgggcttcggtttggatttcgcgcctttcggcctgcccttgggtttcggcctgagcgcctccggacctccggaccggtagtcgcggcaccagcgctccagggacgcgatgctcgcgatcccgtgcctggccatggcctccgtcttggtcagaccgttctcgacgtggtcgcgcgccgcggcgaccttcgtctcccagtcgtagcgtctgctgccgccgcctcccatgaccgcctcctcgccgttgaacctgtacagcctgatccagtttctcgcggtatacaccggtatggcaagccttctgacgagcgcgtccttgccggctccggacttgatgagctccagcgcctcgcgccggaacccgtcgtcgtaacgtctccttcgatcctcacgcatacgaaagaaccgcacctccgatcatcgaatctgaatttcttcagtccaacaatcggagtgcggttcatatttacgccggggccttcacatacacatacgttgtcagcgttttcaggctttcttcgcagcttgggcggtggcgatccacttgtcaagcagcgccgtggccttgccggagtcgacggtctgctccgcgatggcgtaggcggctttgaaccggtcagccaagcttgcgtcgcccggcaccaaatgaccgtcggcgacgattgcggaagcggcgttcagcagcgcggtggtacggaacgacacatccttgcctgcgaagaagtctcgtgccagctgcgcgttgagcgtcggttcgccacccttcagatctgcgatggtgactttggcgaggccgagttcgacggtcggatcgaatttgttttcggtaaccttgccgtccttgaattcccaaatggagaccggaccggtcggtgccatctcgtcaaggccctcatgggaagtgtagaccatgccgatctggccgttcgccgcatatacggcggccatgatcgggctcatcttgcgattagcgcagccgacggccatatgcttcgggtttgccgggttggtcagcggaccaagcacgttgaacacgcatggcacgccgagcgcggcgcgaatcggaccgacaaaacgcatggcggggtggaaggtgcgtgcgaaagcgaatgcgatgccgcattcgttgccgacttcgctcacttgttccggagtcaaatccatgggcaggccgagcgcttcgaagcagtcagcagtgccgcacttggatgaggccgcacgattgccgtgcttgacgacttttacgcctgcggccgcggctacgacggcccccatggatgacaggttcacggtggaggctccgtcgccaccggtgccgacgatgtcggtggtttcgccgtcgatgtgcagcggaatggcatgggccaccatggccttcgccgcgccacgcacttcgtcgggggtcagccccaactgctgctgggtggcgagtaccgcgccaacggccgccggatcggcattgccgttcatgaggtcatcgacgaaccactcggattcctcggcgctcaagtggtcccctccgaccagcttggtgaggatcgacttccatgtgatttcggccatgatgccctccttggcgctgtcgcacgcctttattgttgttctgatgccgccaattgtaacgattggacgtttccccacgtccgcacgtccatatcacgaaacggcccatcgaagattcttcaaaaaagaaaacctcccccgattacggtcgggggaggttatgtcatgagcaagtcagcgactcagcgaatcactgctcgttctggccatggcacatcttgtacttacgaccggaaccgcacgggcactgggcgttcttgccggttcccgggaaggtgcggccatccgcccacggggagtgcagctcctcgctcttcggacgcttgttggccggaaccttgccttcggcgtggctgatcggctgcatgccgacgatgcccttctcgttcttctgctcgtcagccagttcatcgatggtggtcttttcggcctcgtcatcggtctccggctctgcaggagcggattcgccggtcgcggcggcttcgccgtccagacccattacggcctcggcggcgttcacggcctcatcctcatcggattcggtctcctcgtcctcggtcatggccacgcgttcgatgtccacgtggaacagcagctggatggtttcctccttgatggcttcgatcatggagttgtacatctggtagccttcacgctggtattcgaccagcgggtcgcgctggcccataccgcgcaggccgatgccgtccttgaggtagtccatctcgtacaggtgttcacgccacttgcggtcgagtacggcgagcaccacgcggcgctcgagctggcgcaagccttcgctgccgagcttgtcttcgaaatcggagtactggtccttggcgtcggagacgatgagctccttcagggcctcaacggccttgtcgcccttgagcttgtcgacggcgtccttggccgcttcctgctccacggcgatcgggtacacggaggagatggccttgaacagaccgtcccaatcccaatcgtccggcttgtcggaaccgttgttggcgcccttgatgtagctcagcacggtgtcgtcgatgaacttgaggatgtcctcgtggatatccgcgcccttcagcacagcctgacgctccgcataaatgacggtgcgctgcttgttcatcacgtcatcgtacttcagcacgttcttacggatttcgaagttacgcgattcgacggccttctgcgcggtgcgcacgcccttggaaacgctcttggcttcgatcggctcgccttccggcatacccttggccatgacacgcgccaccagctgggtgttgaacagacgcatcagatcatcttcgagggacaggtagaaacgggattcacccggatcgccctgacggccggaacggccgcgcagctggttgtcgatacggcgggattcgtgacgttcggtgccgagcacatacagaccgccgagcttgacgacctcctcatgctcgtccttgacctggtccttgatctcggccaaagtgcccggccaacgcttctcgtactcgtccggagtgtcatccggggagtagccttcggacttgagcttcgcatcggcgaggaactcgacgttgccgccgagcatgatatcggtaccacggcctgccatgttggtggccacggtgacggcgcccttacggcctgcgacggccacaacggcggcttccttgtcatgctgcttcgcgttcagcacctggtgaggaatcttggccacgtcaagcagagaggacacgacttcggaggattccacggatgcggtacccagcaggaccggctggcccttcttgtggcgcttggccacatcacggacgatggcggcgagcttttccttcttggtacggaagatcagatcgtccttatcctcgcggatcatcggcttgttggtcggaatcggcagcacgcccagcttgtaggtgcccatgaattcggcggcttcggtctctgcggtaccggtcatgcctgccagcttgtcgtacatgcggaagtagttctgcagggtgatggtggcgaaggtctggttttcggccttgacctccacgccttccttggcttcgatggcttggtgcagaccctcgttgtaacggcggcccggcaggatacgtccggtgtgctcgtcgacgatgagcacttcgccgccggtcacgacgtagtcgcggtcacgcaggaacagctccttggccttgatggcgttgttcagatagccgatcaatgcggtgttgttcggttcgtacaggttgtcgatgccgagatagtcctcgaccttggtgatgcccggatcaaggatgccgacgaccttcttcttctcgtcgacctcatagtcctcgtcacggttgagcttcagaaccaggcgcgcgaactggcggtaccagcgggtcacgtcgccctcggccggaccggagatgatcaacggggtacgagcctcatcgataagaatggaatcgacctcatcgacgatggcgtagtggtggccacgctgtacgagatcggacttctcccacgccatgttgtcgcgcaggtaatcgaagccgaattcgttgttggtgccgtaggtgatgtcggcgttgtactgcttgcgacgctccggcggcttctggttggtgatgatgcagccggtgctcatgccgaggaagcggtagacacggcccatcagctcggcctggtagctggccagatagtcgttgacggtgacgacgtggacgccctgaccgtcgagtgcgttcaggtaggccggcagcgtggccacaagggtcttgccttcaccggtcttcatttcggcgatgttgccccagtgcagagcggcgccgcccatgagctgcacgtcgaagtggcgcaggcccaaggttcgcttggaagcttcacgcacggtggcgaaggcttccggcatgagcttgtcaagggactcgccgttttcgatacgctgcttgaacttggcggtctggcccttgagctcctcgtcgtcaagcgccgcgatctcgtcctccaaggcgttcgtcgctttggccacgttctcaagcttcttgatctgtcggccttcacccatgcgtagggctttgtcaacgatatctaccacaatcactccctttgtgtatggtgactttcctcgattgaggatagtcgctttctcgcgatttccgaaaagctccgtccattttacgtaagttttgacgtatcttgtttttcgcataagaaaagaggcccgcatgtatgacatgcgagcctcttatcgttcagttttcagccattagccattacttcttggccacattctccggagtgtcgatttcgaagacgccgtagctccaaccgtgacggtggtagacgacggacggacgaccggtttccttgttgacgaacaggaagaagtcgtgaccgatcagctccatctcgtacagggcctcgtcaatggtcatcggctcggcgatgtgcagcttgcggcggatgacgattggggtgtcgccgacctggacctcgacggattcgccagggccgagatcagcggaaacggcgtcggccgggctattgttcggcgcttccggctccggctcctcgacgacgaccggctcgaccgggcccagatcgaccgggaccggatcggtgtagccacgacgatggtccttgcggcggtcgcgggtacggcgcagacgaagcgtcagcttgtcgagagccaaatcgagcgcgctgaactcgtcggcgctggaggcttcggcacgcaccacggtacgacctgcgatgacggtgatctcaacgcgcttggcggtgtcggcctgacgcggattgccctcgtgggacagcacaatctggacacgctgcgcatccggggcgatagcggtcacacgattcatcttgctttcgacaacgtcacggaacctttgcttgatctgcgtatgacgtccggtaacgacgatttccatgtggacctccctagactcaagcggtgttaaccgctatatacggaccaaccagctgcatcgctgcttggtagtcatcattgtatccataagattggtgatttgctggaaaactccccgagaaaacaaaagtttttttacgctttgctttcgacgattctcttgctatagttgtgcgtttgagacctcttgatggccgcgaccgattttgtcggttgaggaacttccgggctccatagagcacgatggcggataacgtccgcccagggcgacctgagagatagcgcagcagagaatagaccgccttaccggtttcggccggtgggtaagggtgaaacggcggtgtaagagaccaccgggccgctggtgacagttggccgcatggcaagcctcatcgggagcaaggccaagcagaaggcgttcgaggactgctcgtccgaagccttcgggtaggctgctagagcctgacggcaacgccaggtcgagatggatggccatccgtgccgttggcacgacagaacccggggtataagaggtctcactctccactctttatgttttgaggatttctttacaccagcctctttatgaaactgacgtcacgcccttggtcaacggtcgccgtcaatcaaacagttcctgtgcgatttggcgcagaatctcaggattatggccttttctgccgcccgcgctccagaagcggcgcctacgtgcatcgcgttccagaccggcggtttttctcgcggttctacggcctaattcccatgcggcttcagtaaacacgccgtaggattccgcctcatcacaaacctgttgggccagcctacggtcgacgcctttccgtgtaagctcagcgaccgcgcccctacatcccataagacgggtcgcacagtagcgtaccgcggattgcgcgtaggcttcatcgtcaatcagttgaacccttgtcagtctttcgatgacgtcgtcaaccacttcagaggtatagcccttaccaatcaggcgctcacgcagtgcgccggaaggtcgaggcgcagcgtccagcaatcgcaatgcggcttccctgcatgcgtcaagatcatttggatcctttgcggcagtagaatcgccgttcccgacacgcccagcgtgtcgcgcgtgtcgtggcgttttcgtcgcatttgcgcttccagcgaacaaactggaacggtcaggtttcgttcgacggttccacctctgaacgttcgtgcgttctggatcctctgaagaaagggcaaggcccccagtatcggccgacgccggctgaaggccctgttccttaaggaaacgttcggcgctgatcatatgtcaggctttggcggcttttgaagttttagacgtcttaccatcatccggcgcgcccgcggcgtcctccgccccatcgtcctcggcgaactggtcggtaggtttgatcagaccgaatgccgccttgaccttgttctcgatttcctctgtgagttccggattgtccttgaggaactgacgcacgttttcgcgtccttgccccagctggtcgccctcataggtgaaccacgagccagactttttgacgacgttggcctgcaacgccatatcaagcacggaaccttccttggagatgccctcgccgtacagcacatcgaattcggcggtcttgaacggcggagccatcttgttcttaacaaccttgaccttggtacggttgccgacagcctcatcaccgttcttaatggtctggatacggcggatgtccatacgtacggacgcgtagaacttcaatgccttgccgccggtggtggtctccggattaccgaagaacacgccaattttctcacgcaactggttgatgaagatggcggtggtaccggcttgcgccagcgcaccggtcatcttacgcaacgcctgactcatcaggcgcgcctgcagaccgacatggctgtctcccatctcgccttcgatttccgctttcggcaccaaggccgcgacggaatcgataacaatcacgtcaagcgcgccggaacgaatcagcatgtcggcgatttccaatgcctgctcgccattgtccggctgagagacgatcaacgaatcggtgtcgacgcccagcttacgggcatagaccggatcgagcgcatgctcggcatcgatgaatgcggccacaccgccggccttctgggcattggccaccacatgcagcgccaatgtggtcttaccagaggattccggtccgtaaatctccacaatacggcctttaggcaggccgccgatgcctaatgccatatccaaagccaaggatccggtcggaatgacctcgacatcctgttccgggcggtcgccaagtctcatggccgatcccttgccgaagcttttctcgacctgcgcgagcgctgtgtcgagcgcggcctgacggcgcggatcgattccattcgcggacttgttctgtgcggcgttctttgccgcgctcgtctgtgccatgactactccttgttgttgaccgagacgaatgaatggattcaccgtaaaaccgcatcatccatctacgcaagttcaatcggccattgtggtcgaagaacatgcatttcgacacgccgaagaccgctttcccttgaaattccagcattctgaaacttcgcggcgagccgttgacgacctgcccaatccgtgcttctgtggataactataccccattatccgaacatctgttcgaaatcggtgttttgcgatagccgaactccgcctaacgcaccggcattggtggcgcgttatggtcctttccccaacgtttggagtcaggaatgttcatctggtcgcacagaacgttccataccacgcggggctcctcccccatttcaagcgcttcgacggctgtcagaccgttcaatcgatcaagcacttggtcgcgtgcgagcgcgcggccatagctacggccgagtacctcttcaagcaactgccaaaattcacgttcctgcacgcgcccaagtgtacacagcaagcgcaaccaaaagaaaacgcccgacggaacaagccgccgggcgttagacgtccaacaggaatcagattgcgacggaatcgagataatcggcgaccatgcgcagcatctgcgccgtggagacgcccaacgattgcgcaatcgagctcagcagctcggagctggcctctttttggccacgctccacttcggagaggtagcccaacgacactccggccttttcgctcacctcacgcaacgttttgtggtcatgggtgcgcagatcgcgcagtacatggccgatggcctcgcgaagcgatacctctctgggttcgtcggtggtttccgtggctgccgacatggatcgtgcggaaacgcgttccgcgtcttcctcccgccatatgcgggtcaatgcggcctggcgctcgtctttggcctttttggccgcgcgggcacgcagcacctgctgctgggcgaacatcaccgcgcggcgctgggctggggtgagttccctgacgcgggcgttgccgctttgcaccgtgggaaccatcgccttgagttccatctgttccttggtgagtgtcatcgtgtccatgccgccagcccctttcgcttttcatacgtacgtccactatggtcaacacccatattcgtggattattcctgtgaaagtgctgaaagagtcctcagtttttccagaatacattgcacggtttcgtgccgcacggctttccgatcacccttcagacgcagctcataagcagctgtttgacgcgcacgaatgccattgaagccacagggcagggagcagccgatgtacaccaggccggcaggtttgtcaccatccggtcctggccctgcaacaccggtagtggccaagccgatgacacagtctccatcctcggtctgtcggtatagttgcgcggttcccgcagccatctgccgcgccacttcggggtggaccgccccttctcgggccagcaggtcggcattcacgccgagaatcttcgctttggcgcgaatgtcgtaggtcaccgccgagccgaggaacactttcgatgcgcctggtatgcgtacgaaggcgtcggcgagtagacctcccgtcagtgattcggcggcggcgattttgaaatggttggcttcgcaatagcgtaaaacggctgcggccagctcatcgcattgcgattggctggccgcggtcgacgaattttcggattcgctcatcgggatttacttggtttccttttcggattttgcggtcttcttacgtccgccgaacgtgttgacgaggtattcgccgcccgaatacaggcatagaatcaacgccaggtaaatcagggcgtacgtgatcgtgtaataaacggtcatccacagcggagtggtgttcatgccatcagcgaggctccacatcggcagcatgagcatggcaaggccgatgcactggcacagggtcttgtacttgccggcttgggatgcggcgatgaccttgccgccggtgtcgatgacgaagaaacgcatgatggtgatgccgatctcacggatgaggaacagcgcggtcacgacccagccgagcactgcgttgccgaattcgttgaagatggcggcgacgatcagcgtgccgcaggtgagcagcttatctgcgattgggtccatgagcttgcccagttcggtgacctggttatatttgcgggccatccaaccgtcgagcttatcggtgcaggcggcgatgatgaagataatcgccgccacccagcgcatagtcgtgtttttggtaccccatgcgcctgccatgacgtacaacgccaggaagatgacgaccaggacgatacgagagaaagtgacgatgttcggcggggcgttccacccgtcaagcagggacgatttgcgttcttcttgcttttccataccgttcacgttaccccgataccactacttggcgcaatgcgtgcggttgtcgcgttccatcatcgcgtgtccgcagcgtcggccggctgggtagaacctgcggtaagcgatgaggtttcgcccttgatgaaggcgagcacctgcggcagatcctgcggttggacgagcacttcgcgagctttggagccttcggacggaccgaccacaccacgcgattcaagcagatccatgagtcggccggctttggcgaatccgacacgcagtttgcgctgcagcatggaggttgagccgaactgcgtgctgaccaccagttccgccgcctgcaacagcacgtccatgtcgttgccgatgtcctcatccggctcgatggccttcttttcggcctccttggccatctcctcgatatcctcgcgataatgcggcttgcgctgggttcgcacgaactccaccgcgcgacggatttcggactcgtcgacccatgcgccctgcacgcggatcggcttggcctggcccatcggcaggaacaacgcgtcaccttggccgatcagcgtttccgcaccggtggcgtcgaggatgactcgcgaatcggtggcggatgaggtggcaaaagcaagtcgggacgggatgttggccttgatcaagcccgtgaccacgtcaacggacgggcgctgcgtggcgagcaccagatgcacgccggcggctcgcgcgagctgcgtgatgcgctggatggagctctccacgtcgttcttggccaccatcataaggtcggccatttcatcgacgaccacgaggatatacgggtatggtgcgaccttgcgtttggagcctgcgggcgcatgcaccttgccagcgcgcacggcagcgttgaagtccttgatgtggcggaatccgaagaattcgaggtcgctgtatcgtgcgtccatctccttgaccacccattccaaagcctgtgcggccttcttcggatcggtgatgatcggggtgagcaaatgtggaatgcccgcataggcggacagttcgactcgtttaggatcgaccatgatcatgcggacctggtcaggcgtggcgcgcatgatcacggaggtgagcatggagttgatgaagctcgacttgccggagccggtggcgccagccaccaacaggtggggcatcttggtcaggtcggcggtcacgaaatggccttccacatccttgccgacgccggtgagcatcggattcggatcgttccgggccttgtcggagcgcagcacgtcgcccagcaccacggtttcgcggtcggagttcgggatttcgatgccgatggcggatttgccttcaatcaccgacaggatgcgcacgtcggagctggccaccgcgtaggcgatgttcttctgcaggttggtgaccttctcgaccttgacgccagggccaagctccacctcatacatggtgacggatggtccgcgcaggaagccgatgaccttcgcatcgacgttgaactgttggaaggtaccggtcagcgcgcggatcacacgatcgttctccggagtgtgcgcggcgtgcggcgcgcccttcttcagaatgttgaggtcaggcagatgatacggtccctcgggaatgtcatccgccgcttccccgtcaacggcagcagccggcatatcgtcaaggacctcgccggtcgcggcatccaccatgacttccttgccgttggaggtgccgtcctcgtcgatgacggcccatgggtcgtttggagcgacgccaaccggcttgatttcgctggacggcaccggctcggcgacgctgggcatggtgccgctcgcggtgccgatcggcgcggacgagaaggagcgtccgcgaccgttctgtggcatggccgtggtgccggacggcgcagcggcggaataatcatctgaatcataatcatcggcacgataatcgtccgaagaaatgctgcgtggcgaatcgacctgttggtacggctcgtcgacgatggtttccgcggtctgtccgtgccgttcggcggcattaagaaacgcttcgtcgccggcgtaatggtcaaggtcgccatcatcgacgttcttgctcttatgggatgcgaagcgttgcttcatacgcgtaaggaagcccggactatcgtcgttttctccatccgcatcggtgccgtcgtgggcgggaacgccttcggcgaaggcgagtgtcgtgcccccaacgcggacttcgttcggaaactgttcggcctcatcgtcaatgtcatcacggtttttaggcgttccaacaaacttggccgccagagccttcgccttgtccggtatctgcgtgacccgggtatgggtaatcaacagcaacgaaaacaggatgacgactacgaaaatcgcaatggaaaagcctttggaaagcccccacgccaacggacagccaagcacatagccaagcaggccgcctgcccgctgcagcaaagacatatcgaacttctgggagtcggaggcaatcgccgcgtcaagaatagagcagacggaccagaggatcatgaaccatccgagggccatatggaggttctcatccttgttttgcgtcttgcgcatcagactgaacaccacaagcgccaggaataccggcagaatcacgctggtcaatccgaacagtccggaggccatggcatgtaggacctgtccgaaagcgccctggacacggaaccattcggatgcgcagaacagcaccgcgagaatggccatgatgaaacatgcgatgtcgcggcgatatttacgcagtatgccggcgatcggcgaggaatcgacctcgtccatgactttggtatcgccggaacgcgatttgcctgcggaacccttgccgcctgatttcgggttggaagatgctgttcgtgccataacaggactcgattttacccatgggcaccgccatggcacgacgacatccgatacttatcgaaagtttttgccgttcacgccgtcaggcgcttcggctagacgatatcgccaagatgatgctgcgtgtacgcatccgcctgcgcgtcgatcgcgtcgtaatcgccggcgtcggcatgctcgatgatggccatggcattgcccagcagcgcggggttgagagcctgcagccagtggatacgcggatcgcggccaaaccatcccatctgtttgcgtgccagacgcttcgtcttctgcgcgatgctcatgaacgtgtcatttaaatcgcacaggccatccaaatagtcgacaacctgctggtatccaagagccttgcctgcggtgatgccaagccggggacggatacgctccacttcctcgacgaaaccgttctccagcatctgcttggtacggatgtcgatgcggcggtcaagttcctcacgcggcaaatcaaggccgatctgcacggtgggaatcacataccggtaatgcggcaggctcgccgaatacggccggcccgtcacttcgatgacctcaagcgcgcggatggtgcgtcgaggattgtgcggatccatgcgggccgcggcttcaggatcctttgtcttgagctcgtcgaacagcgcaccggcgccttcgaccttttcacgttcctcgaggcgtttgcgcacctctgggtcagtgccaggaaaggaaatgtcgtcgatggcggcacgggcgtacagaccggaaccgcccacgaggatagggcgcactcccctggcctgcagttcggcgattttggcgcgggcgatctcctggaaacgtgccacggacatggcgtcgtccggttcgatgatgtcaatcaggtggtgcctgacctcggcctgttcctcaggactcgccttggcggtgccgatatccatgcccttgtacatctggtaggcatcggcgttgacgatttccgcctgctcgcccttggcctccaacgccttggcaatggcgatgccaagtcccgtcttgccggacgcagtgggaccgacgatggacacgaccttacgggtttcgggcttgctttcagtggcggacggcataggtttgccccgcttccggattcggatcggcgatgagattgtggcgtcccgcatgggtgacggtggcggtcacgaaatcacccacctgcggcatcgactcgccttccggcacgccgacatgcaccagcacgcccgtcttctcacgtccagtaacacgatgggtggcggcatccttcttgccggatgcgccggtgaccatcacctcgacgtcacggccttcgaaagtcttgagattctcttcggtgatacgttcctgcagcgccacaagacgttcgaacctgtcctgcaccacgtcatgcggaacctgctccatctcagccgccggcgtgccgggacgcggcgagtagatgaacgtgaacgcggaagcgaatcgcgcctcctccaccacgcgcagggtttcctggaagtcctcctccgtttcgccggggaagccgacgatgatgtcggtggagatctgcgcgtccggcatggcctcgcgaatcttgcgcagaatgtcgaggaacttggcggaacggtaggagcggcgcatcgcacgaagaatcctgtcggaacccgactgcaacgggaaatgcagctggtgcatgacgttcggtgtctcggccattgctgcgatcacgtcgtcggtgaaggccgcgggatgcggcgaggtgaatcgtacgcgttccaaaccgtcaatctcgccgcacgcgcgcagcagcttggagaaggcaaaccggtcgccgatgccgtagccgaaggagttcacattctggcccagcaacgtgacttccttggcgccttcgtccacacattggcggatttcggcgaggatgtctccgggacgacggtcatgttccttgccgcgcgtggtcggcacgatgcagaaggtgcaggtgttgttgcagcctacggagatggccacccagctcgacaccttcgacgcacggtcggtaggcagttggcttgggaagtagttgagttcctcctgcaccttcacctgcgcgtggccttcgatgcgggcctggtcgagcagctgaggcagggatccgatgttcttggtaccgaacacggcgtcgacccacggggcttttttcgcgatcttctcacggtcgagctgcgccatgcagccgccgaccgcaatctgcaagttcgggcgttccctcttcaattcggcccacagtccgatggtgccgtacatgcgttcggcggcgttttcgcgcaccgcgcaggtgttcatgacgatcaggtcgatgtcatggttgagatactgttcctcggtggcgggcacgtagccgtcggcctcaagcacgccggcgatgcgttcggaatcatgcacattcatctggcatccgagcgtatgcacgtagaacacgcccttgccgcgcgtgggggtatcgttcgccgccggttcggccagtttcgaggcacgctccgcctcggtcatcatgtcttcgttcataacgcaccatgctaacggcagggcggcacaggcgtttcggaacgcgggaacgccccgttctcggcgcaatcgcagggcattgaccctcttcgatacacagcatacgttcagttttgcggaaagcgaggcggtacactgttcttccgtgatacttgacaggcaaaatcgaattaacaccaccgaattgcagatgcgtctgaagaacgtcgacgtcggcgagggatccctttcccccgaacagatcaccgagttcatcgaccagatgcaggtgtatgagggtgcgatgtacgagatcagcaccaaattggagattcttgactcggaattccaggtgcgcttctcccataatccaattcaccatatggaacgccgtctcaaatcgcttaactcgatcctcggcaagctgcagcgccgcaacctgccgttgaccgtcgacgccatcaaggacaacctgttcgacgtggcgggcgtacgcgtgatctgcaactaccgcgacgacgtgtattccgtggcgaattatctgtccgcgcaaagcgacatccaagtgctgcgtgtcaaggattacatcaagaacccgaagcagaacggttaccgttcgctgcatgtcatctacgcggtgccggtgttcctgtcatccggaccgcactacacgccggtagaggttcagctacgcaccatcgccatggattattgggcaagcctggagcatgcgctgcggtataagacggatctgccggacgcgaagcttgccgagcattcgcagacgctgttggattgcgcgcgcagcctgcagaacatcgagacgcagatgcagaacatccatcgcgacatcaacagcgccccgcgtgtgggtgaggcgccgcaggcggactgatgttttcggaaaatggcgattgacggacaaatcattgcctgtcaatcgccatttttcgacgatatcgaacgttattcgcgcttacgcagcaatcgtggtattttcaccggaacctgtgcgagcacggtgccgatgaaaatcagcgcgcagccgatgtaggctcgtgtggtcatgacttcgccgagcagcaacgcgccgcccaccgcggagaagaacgattcgagcgacatgatcacggccgcgcgcgacggcggcaccagctgctgtccgaccacctgcaacgtgtatgccacgccggccgagccgatgccggcgtacacgatgggaaaccagctttgcatggcgccggcccagtcgatggagccttcgcatagggagccgatccagctcagcagcgcggtggtggaaatttgtccgaaggacagcagaatcggatccatcttctgtccgaacgtgtcgatgacgagaatatggcctgcgaatagaaccgcagtggacaacagcaccacgtcggcaagggtgatcgagccgaatccgtcggtgatgcacagcagatagaagccgaccacggcgatggcaacgctgacgatgacgttcatggtcacgcggcggcgcagaataaggaaggcgagcagcggcgtcatgacgatgtagagcgccgtgatgaagccggaacggcctgcggaaccggaatagaggatgccgtattgttggacggtgctggcggtgaacaatacgatgccgcagatgacgctgacgaccacgggattgcccaggcatttcggcatggccacggttataccgttgccaagcgtgacggttggacactcattcgattcacggcgtcggcgttcctgttcggcgatgcctcgacggcggaaccacagcaacggtattaatgacagcgcgcccaatgtgaatcgcgtggccccgaagaacagggggctcatggaggccatgccctgcacttgggatacgaatgcgaagccccagatcatggccgtcagaacaaggcaggccatgccgccaatctctttcctctgcatgagccactaccctatggcacgtttttcgccgacagaaaagcctgaccatattctggtcaggcttttgtttgagggttcagcgcagaggacgtcgcgggatttttcagtcgcgatcgccgaagagctggagaatatacaggaacatgttgatgaagtccagatacaggttcagcgcgcagatgatggagaccttcttgaccatgtcctcaccctggcctgcgtactgggcgaacagcgcgcgagtagcttgggcgtcgtagacggtcatgccggcgaacagcacgaggccgatggcggagataaccatcagcatggtctgtccgggagcgaagatcataagcagcacttcggcgacgatcagcacgatgaggccgaccagcagaatcggaccggctttgagcatgttgaccttggtggtcatgcccagcatggtgagcgcgaagaagaagccggcgcacaacgccagggagatgccgatggtgccaagatcatacgccatgaaaatggtgcttagcgagaagcccatgatcgcggcatacacgtagaacatgacgcgtgcggtgctcggcttgatcttttcaatgcgggcgccaagatagatggcgatcacgatttcgacgacgaacggcgcccaagcgccaatgacgccaagcgactggatgagcgcgatgtaggcaccggtggcttgggtgaggatggccacagccgcggtgacgagcaggccgatggtcatctcaccgtaggcacgggtgacggaagcatgttcggcacgctcataggagtatgtcgcctgagccggaatggtggccgccggagcgccctgcgcatacatgttctgcggcgcgtactggtattggttctgaccgtacggattctggctgtactgcccgtacgaattctggttcggattgtattggttctgcccatacggctggccgttgaatccattggcgttgttgccttggggctgctgaccgaatgtcataatcgctccttaactcgattacgcatcacagtacggtacttttctgactatttcatgagagcccacgtcttacggtgccgagctgaaactaccggcaccgtatatccaatgcgcaatcagaccgtgaacttgtgcaccactttcgcgctatcgttcaggtcgaacaaatcagtgacgtcgaccgtcacttcggaatcgtctttcaaggtatatccaatcgtcacggttccggtggctccgggctggacttcggcgaaatcagaattggaatcgtatccggcagggttctcgctgtaaatggcggtgtcgagagcttgcccattttggaacacttgcgggctggcgaggattgcaaacgaattgtttttatccgtgttgttggtccattcgaatgtgaccaacaccgtgggctgattgttatagtcgttgttgctacgtaccgcggagacgattttcacatgcatggtcttcaaatcgccttccatatcctgatcgcccttcggctgattttttgcggagccttttgcggatgattgtgagcttgacacgccggtggcctcgtctatggccttgcttgctgcggactgcatggccagagtaatgacgatggccaacaccgacagcaccgcagcgacaatcgccaatgccttgccgcgttttttaccgcggaacgtgccgaccaatgccacaatcgcaagaatcacgccaatgaaaccgaaaatcgcagcaatgttgttgataatcggaatgaagctcagcacgaagccaagcgcgccgaacaccacgccgacaatgccgcacacagtcagtcccttctcttcctgatagaccggctgcagcgggggttggggttggatgggctgcagcggggcgatgtaaccactcatgatcgttccttcttctcgaatcggttgagacactttcgagggtacggaattccgcgctggaccggtattggacgaaaggtcattcccgtctgcactttggggcgtgcgaaacgcacggaagaacaatggcgtctttcggggacgggcccaataatggtaggtatgagcgagacgacgaattccccgacccccatcgaagtgccggtacgtaccagaggctggcaaagcatggtgatggtggtctgcgcgggcttcatgtgcttggcgcagaccgcgttcgccgcgcaacggttcggccaggattccgccgtatacgtatggatggtgttctgcatgctggtggcgttcgccatcgggtttctgctgctcgcccgttcccgttatccgcgtgccacattcgtcgccgcgtgtgtggtcgtgctggttttcccatacgatcccattctcgctttgatggcgttgaccgcgctattggcccgccgtaatgacatgaagaccacggttcgcgcgatcgtggcgggcggtttcgtcacgcttgccgcgcaggtacgcgacgcgttgcggccgccggaggcatccatctggcatatggtgttcgccaaaccggataccggcagccaatatggcaccgacctaatcatgcttgccgatgaccgcaccatcgtcatcaccgcgatagtggctgcattgttggagctggccatcgcgactttggcggggttgcatatccgttctcgcgccttggcatcgctggccacggccaaggcggacgcggcggacgcgcaggtggcgcagctcaagaccacgatcgacagtcagcagctggccgacgcgatcgctgccgaagcgcatgacacgcttgcccattcgctttccctgctggcgttgaatgcgagcgcgctgcaagccgagtcgaagaagctcgcggccgaagcgggaagtctggacgccggccaactggccgggcaggccagccgaatcgcggacaaaaccgaggagattcgcaaacaggcggcaggagcgttggacgaggcgcacagtgtcatcgacatgctgcgtcatccggagcaggcgaaggcgcaactggcgccgtccgatgagacgtcgttgacccgtgaatcgttggatgcgcttctcggagacgcacgtgccgccggcatgcggctcaacacatggattgacatccaacaattgggccagctcaacagggaaaccggcaaaatcgcctatcgagtccttcaggagggactgaccaacgcgagccgccatgcgccgggatccccggtatcgttggaactcaccgccaatcccaccgcaggcgtgcacgcgcatgtgtccaatccaactaatccgtccgttccggcagcatcggcggatgccacgcgtcccgccatggattccaaaaacgctttccgtaccggtgccggattgccgggattggccgagcgcgtccggcaggccggaggaacatgtcgattcggttttgacgcacgacacgcgttccatgttgatgtgcagctaccatgggttgagtgagcagcgaagagaacagcgatgacaggccgataacggttggcgtgattgatgacgatccgatgatttgccaggccatgcggctgattctcgaagattattccaccggcaggctcaatgtcgttttcacctgcaccgatggcggtcaagcggtcgacgaggccggcaggcatcatccggatgtggtgttgatggatatagccatgcccagcatggacggcatcgaggcgacacgaagactgcgcgcacttccgcagccgccgcatgtgctgatactgacgtccttgagtccgagcgggaccgtggagcgggccgtcgaggcaggcgccgagggttttgtctccaaaaccgatgcaccggaggacatcatccgccgcatcaccgatgtgtgcgacggtctgccgcaattcaatccatccagccaacggcagctcatcaacgatctgaacatgcagcaaccgcaatcgcgccgggacgaggctcgcgccatgctcgacgctctgcctgagcgggaacgcgaggcggtggttcttgcagccgacgggtacaccaataccgaaatcgcggaacgaatgttcatttcggaacgcaccgtcaaggcgcacatctcatccgcgggagacagattatgcatgggccgggtacagatggcgcgtttggttgaacgtgcggatctgccggaccaattatgaggcgaaggattctacggcagtggagactccgttacgtccatgaaacgccggtgcaccccctcccataaactagaaaacagtatgccgcacctgcggtgcaaacgttatcaatgagggatggcggtcgatatggcgatcagcgcgacggaaaaacccctgggcaaagtgttcacttccgattaccaactcaccatcccttcgttccaacgcgcgtacacgtggcaggcggagaacatcgaacagctcgtcaacgaccttcaggacgcctgcgccgacccggacacgccttacttcctcggctcgctcatcctcgtcaaggacggccccacccaataccaggtcatcgacggccaacagcgcctcatctccctgtcaatcatcgtctccgtgctgcgcgaactggaagacgaccccgacctcatcgacagcctcaacgacctcattttggaaccaggcgacaaactccgcggcatcaaagccgagccacgactcaccctgcgagaacgcgacaccgacttcttccgcatgtacgtgcaggaaggcgatttggaaggcctgttcgatctgagggacaacgacatcgcctcgcacgcgcaacgcaacatcgccgtcaacacccgccgcacattcgacctgctcgccgccatggacgccaaagaccgccgccgattcgcctcatacctggtcaacggcgtcaccctcgtcatcgtcaccaccgacgacctcgccggcgcgcaccgcatcttcgacgtgatgaacatgcgcggcgtgccactgaccgcatccgacgtgttcaaagcgaaaaccatcgcggaaatatcccccgccgcgcgtaacgcctacgccacacgatgggacgacatcatggacccgctcggcgatgactcgcacacgctcgaagagttcttctccgacctgcacctgatcgtctcgcacaaggccgtctgcacacagctgcttgaggaattccgcaaagacgtgctcaaaccatacgtgaagaaacagaacgtcatctccttcatcgacgatctgctcgccccttatgccaacgcgtggctcatcctcaaccgtccgaccgacgccaacctgccagacgacatcgtggccatgctcgtctcactcgccgactaccagaccaccgactggaaacccgtggccatgtgggcgctcgtcaactccatccgcaacctcggcagcgccaacgcacaagtgttctccacacccggaaatatcgggaacgaaaccacgaacgcgcacgacgaacgcctccaattacacgacatcgacagactccacgacgttctcgccgcactcgaacgcgtcaccggcgtcgacagcctcaaccggcaaagcccactcgcccgacgcacacgcgccgcaagcgccatccgagacctcaacaaaggccataccctccaacagatccgtggattcctcatcaccgacgaggaccgacgttccgcactcgcgcatctacgtggcgagttgcagaccagtcccgccatgaagaaacttctgctcatccgcgccaacgagcagaaggccggctaccgcatcacccgaccgcgcagtctcaaagcgttgccgatcatgcccgaacaggtcagcgcgaaatccgatttcgccgcttggccggagtcggtgcgtgaccattgggcaaaccgcatcggcaatttggtgcttagtcaggccaacgaaacccaagtcgcgccactcgccacgtatgcgcagcggcgcgaccgcatgctgttgtcggcaagctccagacgttttccactgacagccgaactcgccaatatcgccgaatgcacaccacagacgctgcaataccggcaggatgagatggttcggctcatcgccgaccattggaatattcgttacgatgccgacgatacggatttgtcgacgttgaacgaggagacgctcaatgtgaaagctacggcctcctctcccacgtccaaacgcgtcagcattgcccaagtgctggaagccgggctgcttatcgccggagagaccttggtatgggagcgtccccgcaagggcgaacgttgggtagcgaccgtcacttccgaagacaagctgcgcatggatgacggcagggagtatgccacgcctactgccgcggcgcgtgccgttggcggctcatcagcgggtcttaccgtgtggaaacgcacgtcgaatggccagaaactgagtgacgtttggaaggcgtatcgtctgcgcaagcactgaggacgccgaacgaccagatggtcagtctcaaccagccggattcaatcaaccggattcagccggtcaatgccaggccagccattcgacggcgagtttggtgcgattggagatgttggttttggcaagtatgtcgctgatgcggttgcggaccgtgccttcgctgagaaacagccgtgacgcgatctcacgattgtccaatccctcggccacaagttccagcacgtccaattcgcgttcggtaaggccggcgaaacgttcggatggtccgctggaatcggggttccgagatccttgaactgcctgcgcatcatcatgcgacacaacgcgatcgactgatgaggattcgtctgatgtcgtggattgcggactgacccgcagcttgctcaacacttcggcgcccatgaccacttgtccggccatgacggcttgcaccgcgggtatgacggacgaaacgtcctgtttgatcaagtagcctttcgtgcctatttccaacgctttggcgatgtatgactcgtcggcgaatgtggtgaggataaggattcgcgcgttcggatgcgcgtcaagaatcgcctccgacgcttgcaatccatccattcccggcatctgcacgtcgaccagcaacacatcgggggcatccatctcatattgggtcaccgcatccgtgccggtgttggcggtccatgccacatcggcggtgccggtggcttcgagaatcgtggataatgacgagcagacgattggatcatcgtctgcgatcgcgacatgcattaatgcgctcctttctccggttgcgtcatttccgagccactcgccggcttggggatggatacgaacacgcgccaaccctcgtgatacggcccgcaaatcgcggagcctcccaacgcacgagcccgttcctcaatgtccgaaatgccgatgcctgtggaatcgtccggtcgaatgaactgcatggcgacggcttcagcagacgatcttctcacggttccatcatcctgcacgcacagctgccacaatgcggggaaatcgcgcagggtgattgaaacgttccttgcctgactgtgtttgaccgtattgttcaacgcctcgcgaatcgcagtggcgaagcagcgggacacggccgccggcgctgaatcgatgccgttgaccagcctcacccgcaaggggccggcgccgtccatgctgtgcgcggccgtctcaatctgcgaagcgaaatccgtaccttcgtctttcaaatcatgcacggctttgcgcaccaaagtcatagcctcgctcaccgtgtcatgaatttcacagaaacgttgggccgattgttcctgtccggcaacctgggccaccacgtgcgccgcctcggtctgcatgatggctcgggtcagcatgtggccgacattgtcatggatctcacgtgcgatgcgcgtgcgttcggcaagcgtcgccgtgcgtacggccaacgcacgatcctcgtcgttttcggcgatctgcgagcgcaggcggcgaatctggtcgcggcgggaatcctgcaatcgccgcacttcgcgggcgaggttcgcgcagcgcgtgcaaagcagaccggcagcgaatcccagaaccgtttggagcaccatcaatatgatgatggacaagtcggatggaacgtgcgagccaatcgaacggaaaatcactatcgtcatgggaagaagccacagccatcgcggcaccaacgcttgcaagaagcggctgccatcgacaccagcggacgatgatgccgcgttgaatgctgcgatgggaagcatcagataccacgccggcaccaggcatgcgccgcagtcaagcatgacaatcaacgccatcgcaagccacgaacccgacgcgtattcccccaccgcggcacaacacaccgccacaagcgcgccgcacatcaggtcgaggccgacgtctccggatgcgtatacgcccatgatcatgcccgtggccaggaacacggcttggaacagcaaccgtttcatgccgcctcccgtccgccgattcgtgtctgattggttcgcttgcttccagagtaatgcacatggcgcatggcacagccggcggcatcaacgaaggtgacatttgtcatgttcgaaagtgacatcattccggcaattgtgactacgcgcaccatgtcgggggcatccggcggcacgacaatggaatcagaggcatggagcacgagaaaggagctcgtcatgggtggacgcatgaatgacgctgccgatgcggtcagcgcggtcaaggtctcgaaactggtgaaacgttacggagacatgctggcgctcgactatttcgatctcgacgtgcatcagggggaaatcttcggcctgctggggcctaacggctcaggcaagaccacggcgatcaactgcatacttgcgttgctcacgttcgatgagggcactgtgcgcgtgttcggcgagccgatcagccctaccagctatgcgttgaagcggcgtatcggcattgtgccgcagaacgtggccgtgttcaacgaattgaccgttgaggagaacatcgattatttctgctcgctgtatgtttccgacaaggcaaaacgtcgcatgctcgtggacgaggcgttggatttcgtaggattgcgcgattaccgtacctatcgtccggcgaaactgtccggcggtctgctgcgtcgtcttaatatcgcctgcggcatcgcccacaagccggatctgatctttttcgacgagccgaccgtggccgtcgatccacaaagccgcaatgcgattctcgaaggtatccaacgacttaaccgcgaaggcgcgacggtgatctacaccagccattacatggaggaggtcgagcagatctgcgaccgcatcctcatcatggatcatggccggcatctggctcttggcaccgcggaggaacttaaggcgatgatcagcaccggcgaacgcatcagcatcgaaaccgatgatctgggagggcgctcagattcggccgatacgacgcttgcgcgattgcgcgcattgccgttcgtgaccaacgccgactatgacggccatgagctgacggtgaactgccgccagggcgatcacaatctcatcgacgtactgcagctgttggagcacgagggcacgaatatcgggcatctctccagtcgccagccgacgctcaatgatgtgttcctggaactgaccggcaccgcgttacgcgactgacttggcttgcaaggcttgtggcaaatcgaaaggcatgtgacatcatgtggcagacgttactgatcaatctcaaactgcatttgcgggagaaaacgcaactgttctggctgttcgccttccccatcatcctggccaccatgttcaacggcatgttcggcaacatcgcggaaagtttcgaattgcacacacttgacgtggccgtggtcgaggacaacgcgtggaagacgtcctatggggcgcagacgctgatcgaaggcatttcatccgaatcgtctgcattatcggacaatcacgtgaaagtgagtgccgatggcaagaatggaacgggactcatcaacacgaccaaggtggaatcgattgcgcaggcggaacagctgctggccgacggcaccgcgcaaggcatgctgcgaatcgatgacggcagattgcgattctccgtctcacagtcgacgcaatcgtccgcgtccgatgtgatggcgtcgagcagcggcttggatatttcgctgacggtgctgggcaacatcgtggacctgtacaaccgcaacaccgatgtggtggtggacattgcgaagcacaaccccgaagctctgatgaatggcaaggtgaccggcagcatcggttcggcgaatggctatacaaaggaaatccagctgacgaattttaaaccgagcggtacggcacgatattactatgcactgctgggattggccgcgttgatggccatgagcttcgccatcaacgtagtgacgatgacgcaggcgaatctttcggctttgggtgtccgccgttccgtttcgccgcttccgaaatcgcagcaactgctggctggattcctgtccagttggctgtgttcgttcctgagtctgaccgtggccatgctgtatatccggttcgtctgtcatatttcgttgggcggacgtgaatgggctggtgtgggagcatgtctcatggcttcgttcgcggcgagcgcattcggcacgttgcttggcgcgctgccgaagattccaaccggcgccaagcaggggctgtgcacggcgatcgcctgcacgttgtcattgttctccggactgtacggttcgttcgccatgcagttgagcgacttgatcgcccagcgcacaccggtgctgagtctgctcaatccggcgcagcagatcacgaacctgttctacgacatcctctattacgacaatttcaaaccattcttcaccaccgccggcatccttgccgcgatgagcctggtctgccttgctgcggcgaccgttctgttgaggaggcaacgctatgaatacctgtaagacggcgctgagaattctcaaatcgcgcaagatgtacctggtcatctatttggggttcatcggcatcatgatgttcgccatcagctggcagatcatgcgtggctcgatgacgggtggcgatgaggtgttccatcccgatacggcacgtgtggcggtgatcgaccgtgatggcgatgccgatggtatttcatccgcgctgcgttcctatcttgcgttggatggcgagatggtggaccttgccgacgattccgaggcgttgcagcaggccgtcgcttcgaactatgttgatttgatcgcaattgtgccgcacggcttcgcttcggattatcagaaatatctggatggttcgtcaaatgaccaaccgactgtcgaaaccgttgtcagctacacttccggagcaggctccctttcgcagctggaagtcaacgaattcctgtcattgacacgcaccgcgtacttgggtcaagccgggaagcaacagtcgatggaaacggccatgcggacggcgttggataccgcgaaagcagatgccaagacgtcgaaaatagcggtggtgcaatcgccatccgcagatactgataataccaagccggcggcatccgcattcgccggcaccatcaaaacgggactctatccgttgctgctggtcatgccgatctgcacgttcctggtgattggcaccttcaatgacagtgagattcgtcgccgcctgtattcgtcgccgacgcgtctggtgtcgttgcagatgcaggagatgctcacctgcgccaccttcggcttggtggtgtgcgtgggttacacggcggcgacattggtcttgatggtggccgcaggagtgccgttcgacgggattacatccacgaatgtggctttgacgttcgtgtcgctgctggcgtacacgttgatggcaatcgcctgcggtttccttctggggtcggttggtttctcggaaatggcggtcaatgcgttcgccaacgtattcggtctgctgtgcatgttcacgtcgggtatggcattccccatcgatatgatgcccgaaccgatgatcatgatcggcaagctgctgccgggatggtggctgtgcgtgtccatcgacaacgtgttcgggcttggcacggcggccgcaaccggtgtggattatggttcttgggcatcgtcggtcggcttggtggcattgtttgcagtggcgttcatctgccttggtctggcattggggcgtatccgtcgcacacgcccgtccttggcctcccccaccaccacgcagttggccaagtaaatcaccaagtgttccgttccatcggccgagtcccgatggaacggaacatccgcctttgccgtaggctctcaatcaaatcggatggaaccggacgaaatcggactaggctgaaagcatgatcgaccacattacacttcatgtttcgaacgcggaacgcagcatcgcattctatacgaaagctctgtctccgctcggatacattccaaaagcccatcacgaaccgaccatcggtttcggcgtggatgacggcacgccccgttcggatttctacatctccccgatggacgatccgacgcaacagccgattcccacgcatatcgccttccgtgcaacgaacgaacaagcggtacgcgacttttatgaagccgcgatcacggcaggcggaatggataacggcagacccggaccacgtgcctaccattccgggtattacgcggccttcgtgctcgaccccgacggcaataacatcgaagctgtcacagactggtcgcacacaagccaatcatgaaatcggccgccgaatcgcaaaaagtcatcgggtgacattgcgcagccaacggtacttgcggtagtgcaacaacgcgggaaccattttgatgcattcgtcggtgttgagcagcgcatacaccaccaacacgggcagtttgaacacgaacgcggccaacagcccgaccggcaccacaatcagccacatgacgatggcatcgcacatgagaccgaacttcgcatcgccgccggctggaaaaataccggcgatcgtcagattcgtcatgcatccgcatgccgcgtaatatgcgcagacgaacagcatgaccgacaggtaccgtgtggcttcgggcgtaaggttcgcccattgcaaagccagcggacgcgccgcgacaatcaacagtcccgtcgcggtaccgaccacggccaccagcacgcacatcctgtcgcccatcgccttcgcctgtcggaaatctccacgtcccagcagattgccgaccaaaatgccgccggcattgcccagaccaagggacaggcacaccagcagatccttgacgatattggcgatggaattggcggcgactgcgtccgcacccaaatgtcccatgatcacggtgtacatggtgaaaccacatccccacaccaattcattgccaagcaccggcaggctgtatttccagaaatccttctgcaacggcccatcgggatgcagcacatggccaagtcgcaggtgggggccacgacgggtcgccacgaccgaccatgccagctcaatcgcacgcgaaatcaccgtggatatagccgcgccgaaaatgccaagcgcgggaatgccgagactgccgataccgtaaatcagcgccgcgttcaacacgacgtgcacgatcacgccaaccgtgctgaccgtcatgcccatcaccgcggagccggtgttcttcatcagacacaggtacatctgggacaggccgatgaacaagtacgacaatgacgaaatccgcagatatcgcgcgccaagcatgatcagcgtgccgtcattggtcatgatggacatcaactgttccggcacgagcagtgccgccaggaagaacgccgtcgacagcattccggcatacagcatgacgaatcccagcacgcgttccaccgcgtcacggttgccggcaccccaatactgcgccacgagaatgctcatgcccagggtcagggccgcagtgaacaggctgaacaggaactggaactgcgtggcgagcgagacggcggccaactcgttttgccctacccccgacaacatcagcgtgtcggcgcaggacgacaacgacagcatgagctgttggaaagcgataggcaaagccaatttgaatacatggccgaggaattcccggtccggcatgatggtgcgcacgatagtctccattggaatacaagcccgtttcagacgacgggcaaacgaaaacgccgggatatgtaggccgaccagccttatcccgacgttgggccgaatattgggcgaggttttacagcgaatccttccatgcgcggtattcggcggccttgccctcccagtattcacggtccgcatcagtgatcttgcgaatcacatggcacgggttgcccacggccaccgaatgggatgggatatccttggtcaccacggagcctgcaccgatcaccacatcatcgccgatggtaacgcccggacagaccaccacgctgccgccgaaccacacgtcattgccgatggtgatcggacgggcgccttccggaccggaagcgcgtacggccgcatcgattggatggtatggcgtgtacaggccgacgcgcgggccgaagaagacacggtcgccgatggtgattctcgccacgtcgaggaagatgcagtccatattggcatagaagttgtcgccgatatacgtgttgcagccgtaatcgcagttgaatggcggttcaaggaacgcgcctttgccgagtgaaccgaacagttcgcggaacagcctgtcacgttcctcgaacgcgtcgtatgcggacgtgttgatggcgtgcaccaagcggcgtttacgcatgttcgcttcacgctgcatatcaccgcaaatatacaattcgccggaaagcatgcgttcccactcgttcgtaggcaccgccacattatccacggcaacggccgcaccttcattctccgccattgaaagctccttgtgaatctgtttgtcaatcgtttgacgtcctttgacaccattcaacaccaccaacatcgacggcagcactcgcaatgttgtagaatcatccttgttctttgcattatctaccgtttattagagtagtcatgaacactgccgatgaagacgcacagatggaacgggacgaatgggcctcccgtgaggtgatgcccatcaccaattggggtcgccgacccgatggttcggagatagtgcagtatgacgcgccgatgttcttctccttcaccgagcattcgctgctccaccagtacccccatatgcgtgcggaatgccattggcatgtcgaccttgaactcacctacatcatccatgggcatatgtggtatttcgtcaacggagaaacagtccggctcgatgaggggcaggcgattttcgtcaactcacgtcagctgcattacggtttcaccaaggacggttccgattgcgaattctcctgcacgttgctcaatccggctaaaatgtgcgcctcattcgaagtgtacgaccgcttcatcgcgccgttgatggcggagaacacgatgccatatgccgtcatcaccgacgacacggcccccggtcggcggctgctcgccaccatccgacagcttcatgcggcgaaattcggtccgctggagcggtcagagcggtcagccgaaccgttgcccgccgacgatatgacgctaaccgacgataccgaggcgttgacggtgctcagctgtttctatgcggtcgtccgcgacatactggcgatcgccggcagtcattgcgcgacttccacagcgccgcacccccgcatcgtgacgctacgcaagatgatcgattacgtgcagagatattacgtgcgtccgatcaccttgaagcaaatcgcatcggccggatcggtgggacgcaccacttgcgcatcgatattccgcgaatcgctcaaccagtcgccgatcgaattcgtcaacgacgtgcgcgtgcgcgccgcagccaacctgctggtaacgagctcgctgcctatcgccacggtcgccaaacagaccggtttctcatccgccagtttcttctcccgcaccttccaccggttcatgggcgtcacccccatcacgtaccgaaccacgcataccaagcggaaatccgaggaataaaaacaatcggctgcatgccccacgccgtcacgcataaggacacgcagccgattgcgtcacatcaagccggaaaggacacgttcacttcctcttcagtccgcgggcgatggaggcgttgcgcacctcgaccgtgccgtcggtggcgaagacgcccaacgactcgcccggacgctcgtacatgcgcacgttcaacgccaccccatccacgtacaacgtgccgatggtgtcgtcgacgacgagacggatgtggtacgtatgccccgcctcgaggccgatgttcatgacgtggattggcaacggtgtgttggacggtttcttagaggacgagtccctgttcggtgaattccttcggactccggtatccaagggtggagtggagccgctggttgtcggaccaccacacgtagtcgtcggggtcatgcctcagctgctcgatcgtggtgtagtggttccggtacacgagctccttcttcagcagcctgttcgtcgattcgaccacggcgttgtcgtaggggttgcccttgcgcgacagcgatcttttgatgtcgaacacgtcgagcagctcgtcgatcctcgtgttgtcgaactcgccgccccggtcggtgtggaacacctggacgtccgtcagcgggaagtcgagggtggcgaacgcgcccaataccaggctcgcgtcccgggtccgcccggcggaatggccgacgatgcccctgttcgccaggtcgaccagcagacacacgtacgcccagtctccgccgacgcggacataggtaagatcgctcgccggatgcgtgtgcggggcgtagccgtcgaacccgcggtccagcaggttcgcgagcctggcctcgtcggcccgcgtcctgtgcggttcggaccgtccgcgcgcgtacgcgctcgtcatgccctgttcgcgcatgatgttgccgatgcgtctcctggacgcggtgacgcccttcctttccagggcggccttgatcttcctggcgccgtagcgttcgcggccgtcgcgccagaccgcgcgcacgtcgccggcgatcggatccgcacgctccgtcccgggatgcccggtcatccagtagtaggtggggcggggaacgtccggtatcctgcattgcgccgatatcgggtagcgggcggcgttggcccgtatcacgcctgccttcgtgcgaataccggcgccgcttgttctgaaacgtccgcctccatctccaactgcctgttgcgcctccccggctcgatcagctcgttccgcccgggcgtgcggttgtccgcggcccgggcggagccgctgtcgcggatgccttggacccggcgccgcggggtcgatcgcgcgatgtcgtactcggccctgatctcccgggatggcttgccgctctcgcacgactgcacgatctgccgtttgaacgcctcgtcgtagtggcggggatgtttcgggtcggccatcgtcggcctccaatcccacgtcattcgtccctcatcggagggtctaatacattgtagccaatccaatgatgccctcgacctggtgttcgaacatgaacgagaaggttctgcgttccacgtcttttctgccgtcggtatccaccaccagcagaattttcccattgcgccaggcttcgtcctgcgcgccttggatcacctggccggcgaagggcgatgtggccactccgtcgctgatgaagccgatgatgtcggagcagcctcgggccaatccgcgggcgagcgcgttgtgatggtggccgagttcgtcagcagccctgcgtaccttgcggtgtgtggattccgtgatccgcacgtcccggttgtcgttcaccgcccatgaggcggttgcgatggagacaccagccgcttcggccacgtcccgcaatgtcactttctccatgcccgcgtatcagccccgtccgacgcctagcgcatcaggttgcgcaggacgtactggagaatacctccgttgcggtagtagtccgcttcgcctggcgtatcgatgcgaacgacggcatcgaattcggtcgtggaaccgtccgcgtgggtggcggtgacgtggaccgtcttcggggtgacgcccttgttgagttcctcgacaccggagatgtcgtaggtttcggtgccgttcaggccgaggctctcatacgattcgccttcggggaactgcaatggcagcacgcccatgccgatgaggttggaacggtggatgcgttcgaagctttcggtgatgacggctttgacacccaacatgacggtgcccttggcggcccagtcacgggaggagccggtaccgtattccttgcctgcgagcacgacgagcggcacatcatggtcgatatagtcgcgagacgcttcgaagatcgtggtcggcttcttgtcgaggaagtcgtaggtgtagccaccaggggtgatttcctcgccgacggaggcgagcaactggttgcgcaggcggatgttgccaaacgtgccgcggaccatgacctcatggttgcctcgacgggaaccgtaggagttgaagttcttcggttcgacgccacggtcggtcaggtatttgcctgccgggctggaggccttgaacgcgcctgccggggagatgtggtcggtggtcacggagtcgccgagcagtgcgagcacgcgggcgccgtggatgtccttgaccggatccggggtggccttcatgccgtcgaagaaggtctgcttgcgcacgtaggtggagttctcatcccatgcgaacagttcgccttccggcacgtcaaggcccttccaacggcggtcgccttcgaacacggaggcgtaatccttgaggaacatctcgcggctgacggtgccatccaccactgcggcgacttcctcattggtaggccagatgtccttcaggtacacgtcgttgccgtcctggtccttgccgagcggctgggtttcgaaatcgaaatccatagtgccggcgagcgcgtaggcgatgacaagcggcggggacgcgaggtagttcatcttgacgtccgggctgatgcggccttcgaagttacggttgccggacagcacggaggtgacggtcaaatcgttggcgttgatggcctcggagatttccggcagcagcgggccggagttgccgatgcaggtggcgcagccgaagccgaccagctggtagccgagcgcgtcgagatcatcctgcaggccggcggccttcagatagtcggcgacgacctgggagcccggggcgagagacgtcttgacccacggcttgggcttcagtcccttggcatgcgcgttgcgggcgatcaggccggcggcgatcatgacggacgggttggaggtgttggtgcacgacgtgatggacgcgatcgccacgtcgccgttcttgatatcgaagtcgccacggaagtcagtggataccgcgatcggatcctgcacggtcttgtcggtttcgtacgccggcagcgtggcttcgaacttctctttcgattcggacagcctgatgcggtcctgcggacgcttcggtcccgcgatggaaggcacgacggtgccaaggtcgagttccaggtattcggagtactgcggttctacgtagtccggatcggtggcgtcgccccagagcttgttggctttcgcgtaggcttcgacgagagcgatctgttcttcggaacgaccggtcagacgcagatagtcgagggtgacgttgtcgatcgggaagatgccgcaggtggagccgaattccggtcccatgttgccgatggtggcgcggttggccagcggcacggaagcgatgccttcgccgtagaattccacgaatttgccgaccacaccgtgctggcggagcatgtcggtgatggtgaggaccacgtcggtggcggtgacgccttccggaatggaaccggtgagcttgaagccgacgacgcgcggcacgagcatggagatcggctggccgagcatggcggcttcggcttcgatgccgccgacgccccagccgagcacgcccagaccgttgacggtggtggtgtgcgaatcggtgcccacgcaggagtcgaggtaggcgaggtcgcgaccgcgctcccccgccttggtcatgacgactttggcgaggtattcgatattgacctggtggatgatgccggttcccggcggcaccacgcggaagttgcggaaggcctgctgtccccagcgcaggaactggtagcgttcgccgttgcgctggtattcgatgtccatgttctgttcgaccgcgtcggccacgccgtacttgtcgatctgcacggaatggtcgatgaccatgtcggactggacctgcgggttgatgacctccggatctccgccaagctccttgacggcgtcacgcatggtggcgaggtcgacgatgcacggcacgccggtgaagtcctgcatgaccacgcgggacggggtgaactggatctcgtggctcggctgtgcggccggatcccaatccaacagggccttgacatgatcatccgtgatgttggcgccatcgatgttgcgcaccaggttctcaacgagaaccttcaacgaatacgggagatgatcgatgcccggcaaatccgcgatgcggtaaaagtcgtaatccttgccgcccaccttcagggtgtcgagctggtcgtcgcgcacagacatgctacctccgagcttttgtggctggttgaaactgctttccagcagccgattatccgttgccaacgatacagccacgttacttcagcactggcgtgtcttcttgaaacgtgagaaaatggcgaccattttcggcacgcaccacaggcacagcacgaaaacgatggcggacaccacaagcgcgacgcccgtcgccgcgagcatttcgccggacggtatcacgagcgcgaagaaacgcgcgacgggcggaatgaacatgccggccacgcccgccacggcgaacgccaataccagaccgcctctccacgagttgagcggccgggccacgcgcgccagtacgaagatgcccatcatcagcaggataatcgcgttgacgccacgaagcatgcccagctgcgcggcggaatgctgtgcgtcccagcccatgaacttcggcaacagccacgaatcggcgagaatcgacagagccgtggcgatgcctcccggcaatgcgaagtgcaccacgcgcctgaggaagcccggaatgtagcggcgcgtgttcggcgcaagcgcgaggatgaacgccggcatgccgatggtgagtgcgccgatgtaggtgatatggcggggcaggtatgggaatgggatctgcgtcagcaccacgccgagcgagatcagcgcggaatatacggttttgacgaggaacaggctggccacgcgttccatgttggccatgacctggcgtccacgtgccaccacatcgggcagatgcgagaatttcgaatcgacgagcaccacttgtgcgacggctttggtggcgggtgccgcgttgcccatcgcgatgcccaggtcggcctccttgatggcgagcgcgtcgttcacgccgtcgccggtcatcgccacgacatgatcgcctaggtgcagcgcctggacgatcgccttcttctggtcgggcaggacacggccgagcacgtccacgttctccagtactttcgccagttccgtgatgtcggtgggcagttcgcgcgcgtccatgaagcgtggctccgcgtctccggtgagccgtacttttcttgcgatcgcaccgacggtgacgggattgtcgccggagatgatgcggcagcgcacgccctgctcgcggaaccaggcgagtgtggcttcggcgtcgtcgcgaatgtgctcggagcataataccagcgcgacgggccgcgatgcggggtcgatggcgggatcgctttcgtaatcggcgggcgccttgccgtcatgccgtgcgatcagcagcacgcggtttccgtcgtgtgcggaatcgttgaccagtcgaagaacgtcggcgtaatcgccatccaagtgggacagcacgacttccggcgcgcccatcgtccatgccgcgccgtcatcggcaatcgagctccatttgcgtgccgacgagaacggaacgcgcgccgcgacgggaccggcggagaatccctgcttgcccagtccgttgagaatcgccaatccggtgccgttcggctgtccttcgttcgacaggtcgtacaacgcctgtttcacggcatgttcgtcaacggtattggctccgatgccatccagcatgcgtatttcgttgagcatgatgccgccgtcggtgacggtgccggttttgtcgaggttcaggcagtccacgcgtgcgagggtctccacggattcgagctcctgcacgagcgtgttcttgcgtgccaaacggatggcggcgagcgcgaagttgagcgaggtgagcagtacgaggccttcggggatcatgccgaccacgccagccacggcggacaccacggcggaacgccattggccggtggagacggctacatcccaaccgccgaccgcgtgcacctgcgaccagatgagcagcacgcacagcggtacgacgaggaaggtcatgaatttgaggatggtgttgatgcccttgttgaggtcggacacggtctttttgtagaccttcgcctgcgcggtcaaggtggcggcatagctgtgcgcgccgaccgcgttgaccttgaccaaggccatgccggagaccgcggtggatccggaatagatgtcgtcgccttcgttcttgcgcacggtgcgcgattcgccagtgagcatggattcgtcgagttccagaccccaggtgcgcacgatctgcgcgtcggcgggaacctgttcgccggagcggatccacatgaggtcgccgagcacgatttcgttgtgcggcacttcgacgtccttgccgtcgcgtcgtacgagatagtcggaggctacgaggatggaaagcttgtcgagcgttcgtttggctttcagttcggtgatgatgccgatgccggtgttgatgaggatgacgaggccgaacacggcgtctctccatgatcccgtgaccaataccatgaccatggcggcgaagatgatgccgttgaacagggtgaacacgttggctcgcacgatgtcggcgaacgaacgtgacgtggacgatttgacggcgttgacctgcccgctttccgtaagggcggcgacttccgctgcggtgagccccttttcactggtttcaggcatggtttgactttcgctcatgctgccagcataccgcttggcgatgcgcgcccgcaggcttttcccgtaaagctccggcaaaattcagggttttctcagggtgcgttcagcgccacgcatccgaaccgattcgaactcacccgaatgcgtggagcggttcactgtttgccgccgtggctgatggtggtgacgaggattgctctgtcgtgcgggtcgttgttggctatgccggctaccgcgtcggcgagcggcgtcgcatccgtcatgcggtcgttgattgtgagcgtcgccgcgaacagcgtgctgtcggtcggcgtggcgatcgggttgagcagtgccactggaatgcccgcctgtcttgcggttgtcagcgtgtcgtaccagccgtcatggttcacgccggacacgtcgattcccgaaatgacgatgatgctgaccatgcgttgcgccatatcctcgaccgcttgccgggcggtgtcctgcatgtcgaccgtgccggcgaccggcagatacaccggcctgagcccgcccgcctccatggcatccaacgccaggcgatcggtctgttcgtcttgggagccgatcatggccacgtcgagactgttgcggtccttcatgctgtgggcgaccgcatcgcctgcggactgcgtatctcccaccgcggcattgttcggcgtgcagccggccagcatggagataccgaagacggctgcaaggagaccggctgcggcacgccgcgcgaaaccggtcatcgtgtggctttcctgaatagcgccaccgtttcgacatggtgggtggtcggatagatgtcgaatgcgcgaatatcagcaagatcgtatccgagcgaggccaatgtggcggtgtcgcgtgccagcgatgccgggtcacaggcgatgtatacgacgcttcgcgcgccggattcggcgatctgcctgcataccttcgcacgtgcgccggcacgcggcggatcaagcaccacgatatcgggtttggccaaatcgttgcgtacgttggcaagcgtcttggccacatcgcccacacgggcgtcgacattgcccaaatggatggccctcagattgcgctgcgcgtgtttgacagcggtcttgccaccttccacgctcagcatgcgcgtgcggccagcgcttaacgtggccaacggcagcgtgaacaggccggaaccggaatacaaatcccacaggcatgcggaagcggcgccgtcaagctcgccatgcaccaaggacatcacatggccggtcaacgcgatcggcgcgtgacggtgcatctgccagaatccgccggcgtccacaccgtattcgaattcacgtccgcacaccgtcaccttttcggtaagctcgcgattgcccgccgtcacttcgccatcgacgagcacggcgtagttgtcggcgatttcggcattgccgcgaggctcgggaacagacagacgaatctgcgatccgggagtgaatcccccatcccacacgtgttccttctcggccacgttaagcaacgcgcgactggccaacggcatggtgtcgatcggcacacgcacgtgggtgccgcgtctgcgcatggacggtcggccgttatcgtccgcgatcatctcgatgcgggtacgccagtgcagcccctgctccgcctcatcctcgggcatgcgctcgatcggcacgtcaacgtcgacatggccgagacgtctcatctgttcggcgatggacatggatttccatttaagctgtccgggcagtgagacgtgcaccaaatcggcaccgccgacgccgccgcccatggcgagcggacccgccaacggccatacgggttcgacgcggtcctcgctggcttccagcacttccgtcacttcgccagtccaaaaacggtcctcgcgatcatgtggctcgtccaacacgacgcgtaccagctcgcccggcaacgcgaatcgcacgaacacgacgcgtccgtcgatgtggccgacgcaacggccttggtcggcgtatcgttcgatgcggatggtcgattccatcagtgctgttcctccgtttcgttgttgtcgtccatcgcgtcggcgtttggttcggccaacgtcttatgccgatgcatgggggtggccacgatgaggtacgacacccagatggccaacgcccagaacggaatgcccatgagcagacgtgcagtgccgagccagccgacctggttggacaggtacaacggcacctgcaccaccagtcgtagggagaacacgccgatccacaacgcggtgatgatggtgtacgcgcggttcaatgccttgtcgccacgccaatcggcaagccatgcgcgcagatgctcggttggcagtgtccggatgaattcgatcaccaagccaagtcccggtacacgtaccatcaacgaaatggcgagcagcacgatgtagaaggcgttggtcaggaatccgaacatgtagtagttgcgcgcctcgtggctgttccatgcccagatcaggcagatgccgactgccagaaggccggagacggcgcccatgacggattggcgttggcataggcggacgatcacctgcagtacggcgagggatgcggatacgccgatggtcagatgcaggtcggaggtgatgacgaacatcaccacgaacaccacgcccggcagcatcgattcgacgacgccgcgcggaccgccgatcgcgtcgatgacggagaaatcgtcggcatcgccggcgtcggcgagcgcgccgaggccggttcttttcttggtttcggtttcagccatgcgtttgtgttttcgtggtcgtcgttcgctcagcgcacttcggagaacatcggtccacgcgacaacgtggtcttgacctcgacctgctggtcggagtcaaacggtcccttcggctggcctggaatgtccatcgtcctgcctgcctgttcggcttcggcggcttccttggcggccttgcgttcggccggggcgaccggcggatgcatcgggatgaggtcacgcggggccagcgggtcctcgccgcgttccacgacgatgttggagaaaagctggttcagcgccttggtttcggcgtggtccggatcggtggcggctttgccggagaagatgccgcgcagcatccaccgcggtccgtccacaccgacgatgcgggtgacgaccttgcgtccgcccttgaccacgaccggcagtgtcagttcggtgccgaacacgccgtcggtctccttggcgtctttgttggcctcaaccaggtcggcgcgcacgtcatcccacagtcccatggtcttcggcgcggcgaaggcttcgatctccacgctggaggatccgtaggtgatggtggtgccgagcacctgctgggtggcgcggttggccttcacgcgcagttcgatgccttggaggaacggcagatagtaggcgcccatgtcgaggtattcgtcatagtcgggcacgttctcgtcgtcgacgtcccacggaccgtgctcatcgccacggccgtcgtactcatcggatggttccggaaggatggtttcctgaattccaccggcgggcgcctcagcggtttcggagatggcctcatcggccttgtcgttctcttcggcggcggcttcagcggcttcctcgctctgacgcttcttcttgccgaatccaaacagtcccatgatgttcctcatttcattacggttgcaaccgtgactagcctagcacccatgcttaatacgggctgggaatcggagtgtgtctcccgttgcccggcattggccggatgacggccgcaaaaactcacacgtcgtaggtgatgctcagcggcgcatgatccgaccatcgcaggtcgtaggtcggagctttgtcgatgacgaatccgcgggccgtttcggcgagttcgggtgtggcgaactggtagtcgatcctccagccgacgttgttgtcgaaggcgcggccccgctggctccaccaggtgtacggtccttggatgtctccgcacagggaacgcatcacatccacgaattccaactcccccagccatttgtccacgtaggcgcgttcctcgggcaggaagccggcgtgcttctcgttggctttcgcgttcttgatgtcgagcggcgtgtgcgcgatgttgaaatcgccgcacaataccgcctgcttgccgccgtgcgccgcttcatcgcgcagttgccccatacgtaccagcatggtgtcgaggaaacggtatttctgcttcattttctccggatcgtcggtgttgccggcgtgcacgtacacgcatacgacagtgacggtgtacccttgcggggtcttcacatccgcttcgatccaacggccggaatcgacgtcctcggcaagtcccggcagtccgtagcgtttgtcgatgacgggcagcgcggagagcagaccgacgccggcgcgtcccttgatacggcagatctcgttcatgcgatcaagcccgctttggtcggcgatgcgtccggcggtcgcgtattcgaagccgaattcgtcgaagatggggtcgatttcgttttgcggggcgcgtacttcctgcatgcaccacacgtccggcgtgttcttcgcggcccattgctcgatgcctttgcgtttcgccgcgcggattccattcacattcgatgtcgtgattgtgatcgtcatagcgccttagcctagccggaatacaagaaaacctcccttgtgggaagggaggttttccagatggctgacgcgatcagtcgagtccgagctgcagcttgccgcctgggatggcgtccagcaggtcgcgggtgtactgcttcttcggatggtcgaagacctcgtcggtggtggcatgctccaccagcttgccgtgctgcatcaccacgacctcatcggcgatctgacgcaccaccgccagatcatgggtgatgaacaggtagctcagtcccttttccgcctgcaggtcgttgagcaggcgaagcacctggtcctgcaccagcacgtccaatgcggagacggcctcgtcgcagacgatcatatccggatcgagggccatggcgcgcgcgatggcgatgcgctgcctttggccgccggaaagctcgttcggataacggctcatcaccgattccggcagttccaccatgtcgatgagctcgcgcacacgcttggcacggctcttcttgtctccgatgccgtggatgcgcagcggctcctcgatggaccggtagatggagtacatggggtcgagcgatccgtacgggttctggaacaccggctgcacatgacgtcggaagtcaagcagctccttgcccttgaatccggagatgtctttgccgtcgtaggtgacggtgccggcggtcggctcaagcagtttcagcaccatgttggccacggtggatttgccggaaccggattcgccgacgatggccaatgtggtgcccttcttgatggagaagctcacatcgtcgaccgccttgaacatctccttcttgcgcggcagcttgaattccttggtcaggtgatccaccgtgatgatggcttcgcccttcttcagggaatcctcgttcaccgcgtgctccatgaccgcggtggcgtcgccgccatgttccttgacggagatgatgcgctgcgatgccaaggacggcgcagcggcgaccaaacgcttggtgtacggatgctgcggatgctgcagcacttccagtgaaggaccggattccacgacctggcccttgtacatgaccacgatatgctgggcgcgttccgcggccagaccgagatcgtgggtgatgaacagcaccgcggttcccagggaatcggtcagcatgtgcagatggtcgaggatcttcttctgcacggtcacgtcgagcgcggaggtcggctcgtcggcgatgagcagttccggacggcaggccagaccgatggcgatcagcgcacgctgacgcatgccgccggagaattcgtgcgggaactggcgggcacgggtggcggcgtcaggcagaccggcctcggacagcagaccggcgatgcggtcgcccatggtggagccgaccacatacttcttggcgatgtaccatgcgtcatcgtccttcaccccggctttgatcaggccatcggccacacgccagcgggtttcggatcccggaacccattcctcggcgaaccgggccatgatcttgtcaagctcgtcaccgctcttgccgatcttgacaagagcctccttggccgcggcgatcagatcaggcagttccttggaaccaaggaaggtctcatcgtcattgcccttgagctccacttcgtcaccggccagggccttggcgaatttggaacgcttttcgtggtcgatgtccatgttgttggccaccaacgcttccttgacctgggtgccgatgcgccacaccgggttcaggttgctcatcggatcctgcgggacaagacccatcttgctaccacggagcttgtcgaaatccttctgcttgaagccggagatctcctggccatcaagcttgatggagccgccgaccacatggccggttcccggaagcaggccaagcacggccatggcggaagtggatttgccggaaccggattcgccgacgatggccacccactggccgggatacacgctgaaggacgagttgcgcacggcatgcacggccttgccttcatcggtggtgaagtcgacctggaggttcttgacctccaacagcggcccgtgggcgcgctgcatggcctcgaggttgttctcggtattcatttcagtcatcgaatatcccttcacttacactcaggccgtacggctcttcggatcgagcgcgtccttgacggcgtcgcccatcatgatgaatgccagcacggtgatggccagcgcggcggacgggtagaacagcaccatcgggtcagtacgcaggatggactgcgcgttggagatgtctccgccccagctgaccgtggtggtgggcaggccgacgcccaggaagctcagcgtggcctcgagcacgatgtaggtggccagcgaggtggtgccgaccacgatgatcggagccagcgaattcggcaggatgtggcggaacaggttgcggatcggggtggatcccagagcggtggacgccgtgttgaattcaaggttcttggcttccatcacagcacctcgcgcgattcgtgacacggaggtccagccgaacagcgtcatcaccagaatgatcttccagatggagctgctcgttttgaacatctggagcaccacgatggcgccaagcagaatcggcagcgcgaggaagatatcggtcagtcggctcagcacggcgtcgacccatcctccgaagaagccggcgattgcgccgatcagcgttccgagcagcaccaccagcagtgtggcgaacacgccgacgctcagcgaggtgcgggtgccgtagaccacacgggagtatacgtcgcaaccttgcaggtcgaagccgaacggatggcctgaggaagccggctcaagggaattgtcgagcgtgcagtagttcgggttctgcttggtcaacacgctcgggaacagcgccacgaacacgatgaagatgatcagcagtccggagatgatgaacagcgggttcttacgcagggttcgccatgcgtcggcccacatgttcgaagccggtgcggattcgtccatcgagtcgacggccttcaggggcgtctcatcgagcggtgccacatagcgttcctgtcccggaagcacggtggaaggattggtctcattcatttcggtcatttcttgttccctccctcgactcacgcgtaacggattcgcggatcaagcgcggcgtacagcatgtcgaccagcagattgcaaaccacgaagatcagcatgagcagcgtcacgatggacaccaccaggttgccttctcccttgaggatgctctgataggtcaggtagccgatgccatgcacgttgaagatggtttcggagatcatcgcgccgcccatcagtgcgccaagatcctggcccagataggtgacgacggggatcatggagttgcgcagcacgtggcgcagcatgacggatttgttgtccatgcccttggcgcgcgcggtgcgcacatagtcgagggcgatgttggacgaaatctccgtacggctcagacggatgatgtacgccatcgatacagagccaagcaccatggccggcatcagcagatcaaggaatcctggattcgctccggcggtgaccggcagcagatgccacttcacaccgaggaagtactggcagaggaagccggtgacgaaggtcggcacggagatgagcagcagggagaagatcaggatgacggtatcgcaccacttgcccttcttcaggccggagatcacaccgaagatcacgccgaaaaccgcttcgaacacgaaggccatcagggcgagcttgatggtcacggggaaggcgcggccgatcacgtcgatgacaagctgtccggagaaggtcttgccgaagtcgagggtcagcgcgttcttcaggaacagcagatactggacgatgaacggcttgtccagattgtattcggcacggatctgggccgcgaccgcttcgttgaccggcttgtcgccgaacatcgccttgaccggttcgcccggcaacgcgaacaccagggcatacaccagaagcgtcgtgccgagaaccacaggaatcatctgcagaatgcgtcgcagaagatacttgcccattggtttctccttttgattactcactcgttcgccagccgtttgcggcttcgtcccctacgctcacgcgtataggacatgaggcccggggcggctggcgcttgccccgttacgtatcagtgatactgcaccacaatgctttatattgcagtttcatgaaagacagctgaaaatataccccacgcgcggacatcttctgttgatgtcgcatgtccagccgtcatggacctccgatggaagccccgtttattacgcggaaaggaaggaacggatattcgaatccgttccttccttcatgtcgatcctacgaaatcaaaatcagagaacggctcacttgccggacttggtcatgttctcgtagaccggcaggttctgccagttcatctcgaagccggagacacctgtcgaggccacaccataggcattggcgtagtacagcggaacggccggcaggtcgttgagcagcacttcctgtgcctgctggtacagcttgttggcgtctgcgacggacttggaggcagcggccttgtcgcacagcgcatcgaactccgggttcttgtagtcgccatcgttggagccgttgccatcggcagcggcggaggcgaagttctgcaccaggtagttttcggcggacgggtaatccggctgccagccgctacggaacgcgccgttcaccttgcggtcggacacggcggtgcggaaatcgttgaaggtcgggtacgggttggtggcggccacgccggcgcccagcacgttgttgatggagttgaccacggcggtgtagatgacttcgtggccaccatcggcgttgtaggcgaaggtgaacttgtcatcggaggtccacgggctgatggcgttggccttcgcccacagttccttggccttcttctcgttgtacttcaggttgccggagcccttgagggaatcggagtagcccggggtcagcggggaggtgaagtcggcggccggggtgccggtgccgttgagcaccttcttgcagatgttctcgcggttgatggccatggagacggcctggcgacgcagggtgccttcctcggtgtcggcctcgaagtgcttcagcttggccgggatggtgaactgctggatgacggagccggccttgttgtaggcctgtacggtggagtccttctggaaggtcttggtggcggaggccgggacggactccatcacgtcgagggaaccggactggatgtcggcgtaggcggcctcatccttggtgtagaccttgaaggtcacgccgtcgttcttggcgacgcggttgcccttgtagtcggggttcttcaccagcacgatctggttgtcgtggtcccaggactggaacttgtacgggccgttgccgaccggcttctcgccgaaggccttcggatccttgaagaaggattccggcagcggagcgaatgcggtgtagccgaccttgacggcgaacacggagtcggaacggttcaggtcgacggtgaactcatggtcgttgacgaccttcaggccctcgagctgttcgtcgcccttgagcttgtctccatcctggagcttgtcgtagcccttgatggtggagaagaaggaggagccgagctgtgcgttcttggcgttggccgtgtagctccatgccttggtgaaggattcggcggtcaccggggtgccgtcggtgaacttccaaccatccttgagcttgatggtgtactgggtggcgtcatcgttggacttgatggactccgccacttcgttggaggcgttgcccttggcgtcgaaggaaatcagacgtgcgaacagcaggtcgagcggcttgccgccgccggtctcgttgcagtcgcccgggatgagcgggttctgcggttcggaattgtatgcggtgatgacgttggaacccttgtcagcggtggagtcaccgttggaagagccgcaaccgctgagcagcatgccgaatgcgcatgcggccgcagcgaaagccagagctttcttcttcatggaattcatattctccttatccattatttccagagccgtaagaccctgctcaaaaagaaggcgggcgtcaataccgtggcatcaacgtccgtcttcgttctgatggtaggttcattatcactcgattgagggacaaccgctccatatccgagggaggcccatgcaaaatagccaaatcaaaactcatcatctgataaaacaatccgtttttccctcttatcgccggaacaacttatccgcatcgtgcgtatggacggacgcggacatatccgttcgccgtcagcgtactttgccaatccgcgtcacgcccgtggaaacgcctgcccgtatcgtgccttcaactgttcgatggacacgtgtgtgtaacgctgtgtggtcttcagcgaggaatgccccagcatctcctgcacctcacgcaggtccgctcccccgtcgagcatatgggtcgccgcactgtggcgcaacgcatgcggactgatgtctggcacgccggcctcccgtgcccggtcgtgcaccaccttgcgcaccatacgttgaccgatccgcccgccctgcgatcccaaaaagaacgcgtcgtccgacatgtcaccgcatagtacgggacggccatgttccagccaatcgcgcaaggccttgtcggctggtgcgccgaatggcatgacacgctgcttgtcgcctttgccggtcactttcaccgtgcggttgccgaatgtcacgtcggccacgtcgagtccgaccagttccgccacacgcatgccggtggcatagagcagttccagcatggccgcgtcacgcagcgcgatcgcctgttttttcatattcggttcctgcgatcgcgcctccatgccgtcctcatcaacgcggtccatcagctgctgcgcctgcgtttcgttcaataccgccggcagcgtatcggggattttcggcgtctgcaacgaagccgccgggttggcggacgccatgtcatggtcgtacgcccatgcgaagaatccacgcacggcgacggttttgcgcgccatgctgctgcgtgcgtgatttttggacgatttggccatccacaggcgcaaatcctcgatggtcacctcattcagatccacgcaaccctgtttccgcaacgccaccaagcattcctcgacatcgctgcggtacgccctgcgggtgtttgcgctcaaccctcggttggctttcagataggcgtcgaatccgtccaacgcatcatcgaaacacatgcaaaccaccttccgcttcgtctgaaatgaacagacaccacgcagacaccgtataaatgccattccgcagcgcgatcgaatgtcatctcacgcgatggcacgattccattatgtccccataccgatagactgatgacgattaggcatcttacgaacaggcggtattatgactcgtcattccattcatgacgtacagcatccgacagccgaaaaccccgatgatgggattgtggcccgcgccatcgacctgaccaaggtctacggctcaaaagacaacgaagtgatggcgttggatcatgtgaatgtggaattcaagcgcggtgaaatgaccgccatcatgggcccttccggttccggcaagtccacgctcatgcattgcatggccgggctcgacaccccttcgtccggcaaggtgatcgtggagggactcgaggtctcctccatgaaccagaagcagttgacggacctgcgccgcgagcagattggcttcatcttccaatcgttcaatctggtgccgacgctgtccgccgaagaaaacatcctgctgccgttgcagatcgcgaaacgtccgatcgaccgcgaatggttcaaccaggtggtcaaggtggtcggtctcgaaaagcgtcttacccaccgtccaagccagctgtccggcggccagcagcagcgtgtggcctgcgcccgcgccatcatggcacgtccgtccgtgatcttcgccgacgagccgaccggcaacctcgactcgcgctccagccgtgaggtgcttggcttcctgcgtgattcggtacgcgactacggccagtcgatcgtcatggtcacccacgatccgcgtgcggcctccttcgcggaccgtgtgctggtgctcgccgacggcaacatcacccgcgacatgcagcatccgacgtacaacgagattcttgaggtgttcgccggcgacgacgatatcgacgacgttcctgcagccgacatggtcgcgccgtccaccgcaacggagggcgcacaggcatgattcgcataggattgcgcgacgcgcgcagccatttcggccgtttcatcatgtcgatcgtggccatcgcgctcggcgtgagtttcgtggtcggctcgttctgtttccgcgaaatgctcaacaaccaggtttcacagatgatgtccaccaatgcggaccatgacgtgtacgtgcgcggttcgcaggagaagaaaaaagattcgtcggcgatgtcgatgggatcgacgaaaagctacaacgatgtcgacgtcgatctggcgggcacgatagccaaggtcgacggtgtttcctcggcacgcgtcgtgcacatgctgttcggcgtggtgctgctcgacaagcatggcgatgcggtgaccaccatggggtctccgacgctcgccataggcatgggcaagccgtcgccgtggcggtccgccaagttcacgaccggcacgtggccgaagaacggcgatgagatcgcccttcattccttcgccgccgaacagtcgggtctgaaggtcggcgataagacgaaaatcgtctatccggacggcgctcataaggtgaccgtcagcggcatcttcaccaccgatgccagccaggcaggcgccatcatcatcgccatcgatcccgtaacggccaaggaaaaagccagcaagcagtcggacgatcccgacaagacgtcgctgatcagcgtttacggcaataagaccatgccgcttgacgacaacgcgcagcagcagctggcggaccgtatcaacaaggcgctgccgagatcggcgaaggcgcatgccatcaccggtgacgaataccgtgacgaatcaaccaaatccacgcaggacgcgctcggcttcatccaaccgcttattctgattttcgcggtgatcgcattgtttgtcggctcgttcatcatcgccaacacgttctccatgatcgtgcgcgagtcgatgcgcggctatgcgctgctgcgttccatcggcgcttctcccctgcaagtgttctccacggtgatcgtgcaagctctgttgctgggcctggtaggttcgctcgcaggcatcgggctcggctggggcatggtcaaactcatcgcatccggtttggcgaatatgggtatgccattgaccggcgccaccaatccgaccgtttccgacatgctcgtcggccttgtggtcggcattgtggtgacgttgatcggtgcggccctgccggcgcgaaatgcggcgcttgccccgccgattcaggcgatgaacgaaaccgtcaatccggaaaagtctgtcctcgcacgtggcatcctcggcaccgtcatggtgctgttgggcttcctgagctggggtttcacctacgctttggccgccgcggatggtgacggcggtccgacgccgtggaaggcgctcaacagtatcgctgtcggctggccgctcggtattggcgcggcgctggccgtgatcggcgtgattgtggctggaccggcatacgtgtccaccgcgggcgcggtgctcggctggctgccatcgaaggtcttcaccgtgaccgggcgtctcgcgcaacgtaacatttctcgttcgaaacgtcgcacgtccaacaccgcagccgccctgttcgtgggagtggcgattgtcagctgtctgggcgtggtggccacgtcggcgaaggcttcggtcaattcgctggtggataccgggctcaaagccgatttcgccgtatcttcggcttcggccgggcagattcccgaccaggccatcaaagacatcaaaaaggtcgatggcgtgaatcatgtggtgtcgaaccgtgtggtgcttggtgtgaaatatgacggcaaagccatcaacgggttcacgttcgccacacagccggagctgttcaccaagatcttcgccgccgaaaccaccgaaggtgatgccgctgccgcgttgaaggatggcaagctgctcgtcggcaagaccattgccgacgatcgtggatggcatgtgggtcagaaggtcaaggccacggccgagaacatcgtggtagacaaggaggtcacagccaaggcgcaggccgattaccaggccaaggtgcaggcgcatgtgcaggaattgcagtcgcaggcccagcaattggccgcatccggcgacttggcaggagcgcaggccaaggcttcggaaatcgaacagtacacgaacgacgccaagaacgtcgatccgaaaacgctggtcaagacgaagaaggtcaccaccggaaagacgctgaccatcggcgcgatcgtgtcgaattccgtataccgcgatttcgcgatcgtcaacgacgatttggccgagcagatcggcaacaagcagaccatgttcgtcatgcaggcgttcgtcacggacaagcggggcgccgacacggcccaagtcaagaaggccctgaagaaaacaatcaagaaatactacacaatcgtcgtgttcgatcgtgacgagtacaagtccacgatgagttcgatgatcgatcagatgctcatggtcctgtacgcgttgctggcgttgtccatcatcatcgccattttcggcatcgtgaacacgctggcgttgagcgtgtcggaacgcaccaaggagattggtctgctccgtgccatcggcacgtcacgtggccaggtgcgtggcatgcttggcatcgaagcggcgatcatctccgtgttcggcacggtgttgggtttggtcgtcggcgtcgccgcgggagtggtgattcgtgcggtctacgcgtccgaaggtttggagacgctggcgattccgtggttgcagctgctcgtgttcctgctgctgtcgattgtggtcggtctggtgtccagcatctcccccgcctcccgcgcgttgaagcagccggtccttgacgccgtggcgagcgagtgagacagttggagcggaacatcgaaaggaggcagcaatgcctattcccaatgagattccagtaggagcgcgcatcgtggtgcgcaccttggaaggcgtcgatcctaccgatcatcgtatgaagttccgcgattacgtaggccacgtgcgttcgtgggacggtcagaaactggagatgacgcgcgatgcggcggcgaacggctcacgtcccgagcagcgtgtcacgattcccgccgacgaaatcgtgacgatcaagccggtgccggaacgttccatgactcggccacgtccgtagtcgcatacctccccctaccgcgcgcaaagacaagagcgccgcaatcgcactgattttctgcgattgcggcgcttttgcatagcgatggcgtcagtcgtcagaccacggaacgcgcctgcgcgatcgcggtacgctcgccgtcgaatcgcacgatatgctcgcctctgcgggcggattccagcagcgtgcgctgccaatcgttttcgggaatcgacagttcggccgtcgcgcaatgttcggcgtactccggctgcctgctggcggccttgtagtcgcggaacggttggccttgggtgaagaaacggtccatttgcttcacgtcgccttccgtggggcgcacgccggtatcggccatgtcgtgcagcacgttggccaccaacgtcaatcggttggccatgttgcgtagcagggtctccacgttggccgcgtcctcctccaccatggcacgtgtgcggttcggatcggtcagcgccacgcgcgtcatgtcacgccaggacccggctgcgagcgcggccgcgatgttgcggttcgggttggccaccagctcgttgatcatggcggtggcgatgacgtgaggcatatgtgagatgagcgcggcgcaacggtcatgggtggcgtcgtcaagtacgatgagccggttgccgcaacggttcacgatcatgtcggccacggcgcggaaccggcggtattcggtgtgttcgtcgacggtgatggcccagagcgcgtcgtcatagagtgtcgggtcggatgcctcccagccggacagttcgtttccggccatcgggtgtgctccgacgtagcagccgtcaagaccaatggctttgacttggtcgcggaccatgcctttgacgctgcccacgtcggtgagcgtggttgtttccgtgtcgatcaatggtttcaatgcgccgaggatttcgggcatggccttgagcgggttgcacagtacgagcacgttcggtttggtttcggcgagtgccgccaaggtgggtttgcagatgatgccgtcggcttcggcggtggcgtaggggcggtcgttgtggttccatgcggtcacttcgcagccggcgttgacgagtcggcgtgccagtgatcctccgatgaggccgagtcctacgattgcgatgcgtggcttcaccacatcagctcccttctgacggtttcgtcgttctgccaatcgtccggcaggtggctgtcgtcgagtcgtacgccgccttgcggcagcatccatgaggtgacgggcgggttggggcgttccctgcgagggtagacggcgagtgttttggcccagtcgccatgttctgcgatttccacaagcgcgtcgcggaaacgttcctcccaaggggcggcgtcgagggtgacgatgaagctgtatgtgccggtgcgtcctttgatgggccgtgagatgaagctggtcatgttcagtcccgcgtcacggaacacgtcgagcaggttggcgagcacgcctgggccggtgacgagcgggatgagcgtcaataccgattcgtattcgacgttagcttcggcgcgtggtttggcgagcagccgtgcgacttcggcgcgtggcgcgagcacgaggaagtcggtggcggctccttggtagtcctggatggcggtgccgatgcgggtgatgtcgtacagttcgccgcagatggcgggaccgaaggcgatttcacctgggataaggtcccggcaggccgccgcgttggatgtggccggctgtgtggagagccgatgttcggcgatgaatcgtttgcattgcgcgagaccgtgcggatgggctgtggcgatgcgcgcttcggctggatcggctccttgcgccacgtaggcgtcgaattcgacgttcacaccgacgcgtgcgaatccgacaaggtccttcgcgtcgatcagcgcgtcgaggttgggcaccacgtacccttcgacgttgttctcccaggccacgattccccagccgtcgccgtgctgtgcggcgtcgagaatctgcggcacatcgtccatgggcatcaggtcgaagccttgcggttcgagccgtgccaactcttgggcggcattgacggccgcctgatgggtgaaggtgccttgtggccccagatagaacagcttgcgtgcgctcattgccgcctgtgcctccttgttgcgggtcatcctaagcaccttagcgcattcgcgaggctgtggaggggtctagtccaccggttgggcggtgtcatggtccggttcagacgattcgttctggtcatattccgtggagtcatcctcagtgcgcggcggcatcgtgaaccagcttttgggcagcgccagcatgatcaatggaatcagcaccacgccgtatagccagaaatagccggcgttgttgctgaaatacggcaacgtcgccgtctcgccgaatccgacgggaatcatggcgtccccgcccggaccgtaaccggccatgacggtccagaccaccagtgatgaactgatcagatgcaatgcgaggcccgacacgccatcacgtgaacgcgccgaccatgtcgagatgatgaccagagcatatgcgatcacaagaccgtagggaatattcgccgacgcgcccatgcggtgcgccatcgtgccgatcacgccgacgacggcaccggcgagcaggtcaaccaaaaaccgcgcccataccggtagacgatgcgaccacggcagcagcctgcggtcgatgccgtcctgtgactgcgattgcggttccggctgtgtttcctgcgtgcgttgcgtcatgtcctccactatgccctacgttccttacaaaacagcaagaaaggcaagagatacgcggaaaaccgccgacatctcttgcctttcttaagcgtttagcgcactagcggaacacactaccgtgcccgcgaagcgccaaaacaacgcgaagaatcacttgttattctgagcgttgttctggcgacgctgcttggcgcgccacttgtaccaatcctcacggctcagaatgatcttgcgcacgcggatggactccggagtgacttccacgcactcgtcctcgttggcgaagtccagggactcttcgaggctcatcttgatcggcggggtcagggtttccagcacgtccgcggtggcggaacgcatgttggtcatgtgcttggccagcgtgatgttcacatccagctcgtccggcttgttgttgatgccgacgacctggccctcgtacaccggggactgcggctcgacgaagaagttgccacgtgcctgcagacgctgcatggcgtacggagtggcgacgccctgacggtcacagaccatggagccgttctggcgggtcacgatctggccggcccacggagcgtagccagcggagatggaggaggcgatgccggtgccgcgggtggcggacagcagcgcggtgcggaaaccgatcagaccacgggacggcacagtgaactgcagacggacccagccggtgccgtggttggtcatgttgtccatgcggcccttgcggtcggcgagcagctgggtgacggcgcccatgtactcttccggcacgtcgatggtggtgttttccatcggctcgttgaccacgccgtcgatggtcttggtgaccacctgcggacggccgacggtcagctcgaagccttcacggcgcatctgctcggcaagcacggccagtgcgagttcgccacggccctgcacttcccaagcgtccggacggtcggtcggcagcaccttgatggacacgttgccgatgagctcgcgatcgaggcggtccttgatcatgcgggcggtaagcttgtggtccttgccttcggtgccggcaagtggggaatcgttgatgccgaaggtcatggagatggccgggtcgtcaacgtggatgagcggcagcggacgcggatcgtccgggtcgacgatggtctcgccgatcatgatgtcgttcacgccggcgacggcgacgatgtcgccagggcctgcggattcgaccggggtgcgctccaggccctgcgtacgcagcagctcggacacgcggaagttctcgatggagccgtccacacgggacaggccgtaggtcttgcccttctcaagggtgccgttgtagatgcggaccagaccgagtcggccgaggaagtcggaggagtcgatgttggcgacgtgggcctgcagcggcgcgccttcctcgtattccggagccggaatgttcttgatgatggcctcgaacagcggctcgaggttgtcgttgtccggcaggccgccgttttccggctggttttcggaagcgtaaccggccttggcggcgcagtagatgaccggaaggtcgaagagggaatcctcatcgaggtcgatgccttcctcgatgacgtcctgggccaggccgagcagcaggtcggaggattcaccgacgacttcggagattcgggcgtccggacgatcggtcttgttcacgcacaggatgaccggaagcttggcttcgagggccttgcgcagcacgaaacgggtctgcggcagcgggccttcggaagcgtcgacgagcagcacgacgccatcgaccatggagatgccgcgctccacttcgccaccgaaatcggcgtggccaggagtgtcgatgatgttgagggtgatgccttccggatggccgtacttggcggccagcgggccggtgtactgcaccgcggtgttcttggcgaggatggtgatgcccttctcacgttccagatcgttggaatccatcacacggtccgggacttcctcacgctcgttgaacacgtgggactgggccagcatcgcgttgaccagggtggtcttaccgtgatcgacgtgtgccacaatcgctacatttcggatatcgccgcgaaccgccatcgaaacctctcttagtgttgctgttttcttacgtaaacgttcggtacgtacatgctatcggtacttaaaaatccgtacttacacacaaaccgagccaattctagcgaagcattacgacacatggaaaacggcggacctgtcagatcatgccgacaggcccgccgtcaatcgcgcgaagagacgcgcggaccttaatcctcaagctccttgccagtgcgttcaggcaggcacagggccgccacgcaggcgagaatgaacgccacggcgaaaacgatgaacgccacggccttgttgccaccggacaaggtcaggaaccatggcatcagcagcggcgcgatgatcgcggccacacgaccgcaagccgcggctgcaccggaggcggcgccgcgcagacgcgtcggatagatttccggagtcaccgcgtacaacacgccccaagcgccaaggttggacgcggacagcagcatgccgaagcccagcacagcggccacggaaccggcttgggagaaggcgaacgcggccacggcggacacggcgaggaacacgctcagggtcttcctgcggccccagatctccaccagccatgccgcgaggaagtagccgggcagctgtgcgatggcgatggcgagcgtgtagccgaacgacttggtcagcgagccgaactggtcggccagcagagacggcatccacgtgaacgcgccgtagtaggagaagttcacgaagaaccatgtggcccagatggctgcggtgcgcgcaagatacttcttgccgaacagctcgcgggttttgatcttcggcagcggctcgcccttcggggatgcgaccggttcgacgcctccggcctgttcgaagtagcgcacggcctgctcggcctcatcctcacgtcccttggattcgaggaatcgcacggactcagggatatgaatgcgcgtcacgatggcgtacagcagcggcaatgctccgatgagcagcgcccagcgccatccccaatcgccggtgttcggaatgacgaaatagccgatgcaggcggcgatgatccagccgattgcccagaaggattccagcagcaccgtcatacggccgcgttgtttggtcggagagaattccgagaccaatgtggaggcgaccggcagctcggcgcccaggccgaggccgatgaccagtcgagcgatcagcagagccgccagcgaccatgacaacgccataccgccattggccagaccgaaaatcaccagcgtcgcggagaagaccgtcttgcggccaacgcggtcggccacgaagccgccaagcgcggcgccgatcgccattccgacgaaaccgatggacagcacccagcttttctcggtcggcgtcagattgaaatgcggatcggccgcgatggcggccacgacgaacgacaccagaccaacgtccatcgcgtcgaacgcccatccaatacccgaagccaccaacagcttcctgtgcgccttgttgaacggcagtcggtcaagacgctcgttgcgagtcagcgagacctctcccccgacggtttgttgcgatgcggacatcaacacccctttatcattgttttcctattgtgtcgtgagctcgttcaagcccgacgatggcaggcaatcacgccgtcatcaatgcggataacgcgtcgtcatcctggaaagcaattcgagtgtcgtccgattcggatgccgttccggcttcggtccacaaatccgttcccggcttccggctgtaccggtagaccgccgccggcctgttacggccgatccgcagtttctcaccggtgtcttccaacagtccggaagcgagcattttacggcggaaattcgccaaatcgatacgctgtccggcaatcgcctcgtacacgtcatgcagttggctcaacgtgaatcgctcgcccaccaatcgggtggcgatgtcaggcgattcgattttgccgcgaagccggttcatggcgtattcgacgatggtgcgatggtcgaacgcaagttccggaagatggttgacggggaaccacttgacgttgtcccctccggcgaagtcgattcgtccatcggcctcgcccaccagggcccagtacacgatggacaccatcggcagaccgccatgcgaacgtgccggatcgccgaacgtgtaaagctgctcaagatatttcggatgcagcgacgtcgtcgattccagtgcggcatacgccgactgttccaatgaatggtcggccctcagaccgcctcccggcaacgcccattgccccaaaaaaggctgacggacgcgtttgaccagcggcatccacagggtggagcccatgccggacgaagcggcaccagcgcccacatctgactgcggaaccggtcccaaagccagaatcaccacggatacgccgacctgcggaggctgcttgcgccgttccgagacattgcccatgatcaattgatggcctcttccaatacttcgaattgcttacaggaaaggagtctaacacttatagtcaacatgactataagtgtgtcgagtcgctcataaacaccaagagcccccaacggggctcttgcaaagttcaggccacgatgtcgttggcgatcagctcgcgggccacttcacggtattccttcgccgtcttgtggttcggcgcgtagatggtgatcggcgcggccgccaccgtggaatccggcagcttgatggaacgcgaaatcacggaatggaacaccttgccttggaacgcctcgtagatacgctgcaacacctcctcgcaatgcagggtacgggtgtacatggtgaccagcacgccatacacttcaaggctcggattgatgcgcgactgcaccttctcgatggattgcatgagcagcgccacgccacgcagcgcgaagaattcggcagcgaccggaatgatcacaccgtcggccgcggtcaacgcgttcaccgtcagcaggcccaacgatggctggcagtcgatgatgatcacgtcgtactcgtccttgacctggcgcagcacaccggcaagcacctgctcacgtcccacttcggtgaccagttgcacttcggcggcggacagatcgatgttggccggcataatgtcgagattctcgaaatcggtgtggtgaatcacgctgtgcacgtccatgcgcggattgaacaacgccgtgtacacggtgtcctccaccgcgttggcgttgatgccgagacccaccgtggcggcgccttgcggatcgaagtcgacgatcagcacgcgcctgccgtattggcttagcgcgccgccgatattgatggaactggtggtcttgccgacgccacccttctggttgcacatggcgatgacccttgccggaccgtgcgtctgcagcggctccggtgcgggaaacgtctcataatcacgtccaagcaaatccgtaggcataccgtttaccttaccaacatcctcgtgtcaaaaattccactgtttccatgctagcccatcatcgccgtcagaaacggcagcaacacatgcatctcatgctatcttgcccttggatgcgaggtcagatatgtctcgatgaggttctccgggcttacatgcgtgtagatctgcgtggtggtgacgctcgcgtgacccagcagttcctgcacggtgcgcacgtcggccccaccttggatcagatgcgtggcgaaggaatggcgcaatgtgtgcggatgcaggggcttgtcgatatgcgcgcgttccccggccgcacggatgatctcccacaccgattgccttgacagtcgtttgccgcgcttgttgaggaacaacgcgcgtcgttcggtgggccctttcgccttcgactcgagctgcggccgtccgtttttgaggtatcttgcgatcgcctcacatgcgtaactgccgaccggcaccagacgttgtttggagcctttgcccatcaatctcgcaacgttcgattccaagtcgacatcgtcaagattcgcgccgcacgcttccgacacgcgggctccggtggcgtacatgaattccagcaacgccttgtcgcgcagcatcgcgggatcatcgggcatgtccgccatgccttcggattgaggccgattctgcgagacggggatcgcgtccagcaaactggccacctcgtccacagtgagcacgtcaggcagcgtcgtcgcgcctttgggagccttgacctgtgccgcaacgtcattggacaccacatgttcgttcagtgcgaagcgatggaatgcatggatgctggccagtcttcgtgccttgctgcgcgcggattctccggaatcgtcaagaaaggcgatgtatcgttccacgtcctgcgtggtcactgcattaaggtcttgaatgccttgcgtcgcaagccagccgttgtatttgcgcaggtccgagtcatatgcgcgcaccgtggctttcgcaagtcctcgttccacgtcgatgtacgcgaggaactgatcaatcaagcgttcgatatccgtcatcgtggtcctccgtttgcatcgtcatcatttgtcgtgtccgttccgtcacgctcccgtacggaacgcgctgcccgcatggaggattccaaggacgttcgttccaagtggaagccgtcattggatggaaatcaacattccggaaagtctattcaaagtatccggtatggggaacgcgatacgcaagaacccccgtccgtttgccggatcgggggttctgaagttcacaggtgaaccgtcggggaaactcaggcttccttcggagcgttcacgtcagccggaagagcggccttggcctgctcgacgatggccttgaaagcctccggatcggagacagccagctcggcgagagcgcgacgatccagctcgatgccggcaaggtgcaggccctggatgaagcggttgtaggtgatgccttcggcgcggacggcagcgttgatgcgctggatccacagcttgcggaagtcgcccttgcgagccttgcggtcgcggaagttgtaggtaaaggagtgcagcagctgctccttggccttacggtacaggcgggagcgctggccgcggtagccggaagccctctcgagaacgacgcgacgcttcttgtgggcgtttactgcgcgcttgacacgtgccatatttgattcctcagctttctattaagtctttgtttctaagctctcgctatgctcagcgaccgagcagcttcttcatgttcttgctctgggaagtggccagaacaccgtcggccttcagctcacggcgcttacgagcggacttgtgctcgaggttgtggcgcattgcggagccggcgtgcatcagcttgccggaaccggtcacgcggacgcgcttggaagcggcggaattagttttcatcttcggcattgctgccctccttgtttgttacttcgtttcggaagtcttcggtttgtcggatgccacggctgccttggctgcggctgcggccgctgcctgggcctcctgcttggccgccagacgggcggcctggcgggcctggcgctcggcacgggactgatcgccacgacgacgctgctcggactgggtatggaccttcttgcccttcggcgcgagcgtcatgatgatgttgcggccttcctgcttcggagcgaattcgacagtgccgtattcctccacttcgctggcgagacgctgcaacagctcgacgccgccgatcggtcgggactgttcacgaccgcgcagcataatggtgaccttgaccttgtctccgccgttcaggaagcgcaccacatggcccttcttgacctcgaagtcatggtcatcgatcttcagacggaagcgaatttccttgatttccgcggtgctctgattgcggcgggcctcacgagccttgatcttctcgttgtacttgtacttgccgtaatcgatgagcttggcgaccggaggcttcgcgttgggcgccacctcgacgagatcgaggttcgcttcctttgccaggttcaatgcgacggaagtcgcgatgactcccacctgctcgccgttcgggccgatcagacgcacctgggagacgcgaatctcgtcgttaatgcgtggttcgtcgctgatgatgactccaatcctcatattccatgcaacggaacatcctttgattggcagttttccaaagtctcgattgttcaaggcatgccaaaacgcatcacaacgcgccgtaaacccgtaagagcggcttacatatctcaccgagacgaccggtggaaggcatctgcctgaacccgaggccctgaaaggcttccaggtggggatatcccgctttcttgatttctcaagccttgtagataataccacaccccgggaccagcgcgtgtcgcaccggtcccggggtgttcgtcaccattcggacggcatccgccgtcaggcgatggcgatgacgtccggcttctcgccgtcgtgcacgaagtagacgtcgtaccacgtcaggaacgagtacacggtccagatcttgcggcgatcgtcggttttgccggcatagttgtcatcgatcatcttcagcagcgcgtcctggtcgaagaactggctgacgtaatcgcgttcgaacacggaacggacgtacttgtagaacttctcctcacgcagccacttcttgatcggcaccgggaagccaagcttctcacggtcgtaccattccttgggcagatgacgtcccgccgcctggcggaacgcgtatttcgtgttctcgtcggtgatgaggtacttggtcggcacctgctcggccacgcccatgagctccttgtcgagcagcggcacacgcaattccagcgaatgcgccatggtcatcttgtcggccttgagcagaatgtcacccggcatccactgatgcatgtcaaggtactgcttcttcttcagttcgctcagacccttgccttccacacgcgcatacgtcttgtcgacgatgctttgcacgctcggcgccttgcggtattcaggcttgagcagctgttcggactgcgattcctcaaacacacgtgcctgtccgatgaagctttcctcggccggcgcaagattggcgtacagatgccatgcgcctgggaaggtcttgcccttgcagaaccgggcgatcgccttgcgcgcgccggctggcagatgcgtgagccagcgagtcaccaccttgatgggcttgaatttggtgtgcacgccgtagtcgatgtatccggcgaacaactcgtcggcgccttcgccgctcagcaccaccttcacgtctttggcggccaatgcggacaggaagtacagcggcacgcagctcggattggagtccggctcgtcgagatgccattggatgcgcgggaacgcggcgaacgcctcctcgtcggtcaacgactcggcggtgttgttcagtttgagcagttccgccagttcgccggcctgctgcgattcgttgtacgtgcctttgccgaaaccgatcgaatacgtgtgctgcggacgcgccacggcggcgacgtagctggagtcgacaccgctcgacaggaaggagccgacctccacatcggcgatctggtgcgccttgacggaatcgcacaccgtctggtcgatcgagttcaccagctcgcccagcttctgcttgccttcgcggaaatcctcgtcgtaataccggtggatgtccatcttgccatcccggtacgtgaaatagtgcccttccggcagcttgtagacgcctttgaagaaggtctcaccgatcgccggatactggaaggtcatatacggcttcaacgcctcggcgttgagctccttgacgaaatcggggtggcgcaacaggctcttgatctccgacgcgtacatgaacgtgccgttcatcttcgcatagtagaagggcttgatgccgaaatggtcgcgcgcgccgaacagctcctgcttgttcttgtcccagatcacgaaagtgaacatgccacgtacgcgctgcagcaaatccacaccccactgctcatagccgtgcagcagcacctcggtgtcgcttttggtggtgaaggtgtgtccggccgcgatcaattcctcacgcagcgtctgatagttgtagatctcgccgttgaaggtgatgaccttcgaaccatcctcgttgtagatgggctgctggccgccgccgaggtcgatgatgctgagccttcgatggccgagcgccgcatgctcgtcgatgtaatggccttcgctgtccggcccgcgatgcgcgatcatgtcggtcatacgttggaggaccgggcatttcacgtcaatgggcatatcgttgacgaaaccagcaattccgcacattatctgcaatcccttcaaaacaaactcggtgtcagtgtaccagcatccgcatgtcgaaaaaccgccgccgcgcctccgaaccgattcatgcgtgacaatctccataggtttcagacattttaggtatgccgcatagccatgaaaatgacgattctttcctttcgtccgtcacggctacactaccgggtatggatttccacgatgcccgcacctgcgtgatcttcggcgcaggcgattattacgatgagacccctgcgattccggatgacgccttcgtcgtcgccgcggacggcggcctcgaccacgcccgtgccttcggcatcgacgccgatttcgtggtcggcgacttcgattcgattaccggcgaccgccccacgcaaaacgaccgcaccatcgcattgccttcggaaaaggacgatcccgacctgctgtcggctttgaagatcggctggctgcgcggcgcgcgcacgttccacatatacggcgcgctcggcggacgaatcgaccatacgatttccaatatccagcttatggcgctactggccgaccgtggcgcgaccggctacctgcacggcgacggatcgatcgtcaccgcgatctgcgacggcgcgctcgatttcccggcggatgacgccgttgcgggacgcatggtctccgtgttctcccacagcgatatctcgaccggcgtaagcgaaacgggattgaaatacgagctgcaccacgccgacatgagcagcacgcgcgtcaacggactgagcaacgagttccttgccggcaggccgtcccgcatcacggtggagcatggcacgctcatcgtcacgttccccatcgaggctcccctgccgcacgtggcgcgatggcatggcttctccggagatctcggtgcattggacacggacgtatcctccgcgctggtcgagccaagcggccgttgaacgcatgcgggacatgcatgtgagcgttcactgaaaatcgcactgcattttggaacacgcgcctcggaacgttgccctaagtacaggtgacgcactacagtggacggtgttggtaaacaatggcttcagtgtgcctggcacacgcgtggcctaccctaaagggagaattacatgacagttaagattggtattaacggctttggtcgtatcggtcgtctggctttccgccgtatcttcgagctgcaggctcgtggcggccaggccggtgacattgaggtcgctgcaatcaacgatctgaccaccccgtccatgctggcctacctgctgaagtacgacagcacccacggcaccttccgtcatgacgatggcaccccggtcgaggtcacctccaccgacgactccatcgtggtcgacggcaaggaatacaaggtctacgccgagaaggatgccaacaacatcccgtgggtcaagaacgacggcgttgagttcgtgctcgagtgcaccggcttctacacctccgctgagaagtcccaggcccacatcaacgctggcgccaagaaggtcctgatctccgctccggccaaggacgagaccaccccgaccatcgtgttcggcgtgaaccacgagaccctcaaggcttccgacgtgatcgtgtccgctggctcctgcaccaccaactccatggccgccatggtcaagctgctggacgagaactggggcatcaaggctggcttcatgaccaccatccacgcctacaccggcacccagatgatcctcgacggcccgcgcttcccgaaggctcgcaacaaccgcgccgccgccatcaacaccattcctcattccactggcgccgccaaggccatcggcaaggtcgttccgtccgtgaacggcaagctgcagggccacgcccagcgcatccaggttccggatggctccgtcaccgagctgaccaccgtcctgaacaaggaagtcaccgccgatgagatcaacgccgccttcaaggccgccttctccgacaccgacttctacggctacaacgaggatggcatcgtgtcctccgacatcatcggcgacacccacggtggcgtgttcgatccgacccagaccgatgtcaacaccgttgacggcctgaccatggctcgcaccgtctcctggtacgacaacgagtacggcttcacctgcaacatggtgcgtaccctgctgtacttcgccgagatctccgagtgaatcggcgcggagtaatccgcacggttcgtctctgaacctcagacaaaggggctttcgcttcggcggaagccccttttcgtatccgaaacgccgcaacggacacgtggaaggcttattatgggcggcatggcaaagaaaaagcatgagaagggcgccggttccacaccggccaccgtgcagttggaaaaagccggagttccgttcaaaacctacgaatacgcgcattcgaacgatcacatggatgacggttatggggttgaggccgccaccaagctcggtttcgacgagcatcaggtgttcaagacgctgatggcggacaccggctccgaacgcgtggtcggcgtggtgccggtcagcggacatatggatctgaaggcgctggccgcggcagtcggcgcgaagaaggcggcgatggccgatccgaaggtcgccatgcgcgaatccggctacgtggtcggcggcatctccccgcttggccagcgcacacaccacaagacggtgcttgacgaaagcgcgctgcaatacgacgaaatcctgctgtcgggcggcaaacgcggtttctcagtcggcgtcaatcccaacgatctgctcaaggtgctcgacgcggtagcggcgccgatcggcacttggtaaaaaacacgccgatacatcacaccaatacataagtgggtggtcggaacaacacgatgttccgaccacccacttgcgtaagcgaaaggttcgcgctatttgcgcagttccgcaggaagcacgaaatgcatgttctccttgatggtttcgatggtgctcacatcctggtagccaagttcttgcaacgctgcgaccacgccggaaaccagctcgtccggcacggaggcacccgaggaaatacccacggattcgacaccttcaaaccatgcggggtcaagttccgaagcatcatcaacacgatgggcgcgaccagcggcgccaacagccgtttttgaggcgtaccgcgcgttaagtccctcctgagcgacttccatcaaccgcacggaattcgaggaattcgcggagccgacaatcaccacgcaatcggcttgctcggcaacgagcttgaccgccgcctgacgattcgacgtggcatagcagatatcggagttcggcggcatttcaagccatgggaaacgagctttgagcgcggtgatcgtgccagcggtctcatcgacgctcaacgtggtctgcgtaagcagcaccagtttcgtgtcaggttggaaatccaacgagtcgacgtcggacgtatgctcgatcaaatgcacatgttccggcgattcctccaccacgccaacggcctcatcgtggcctttatgcccaatgtagatgatctcgtaaccttccttgacaaaacgcagcacctcgcgatgcactttgcttaccagcgggcaagtggcatcgaccacatgcatgccgcgcgccgcggcctcggctttgaccgccggagacacgccgtgggcggaaaatacgattgggatgccggcttcggcggcggcatcggggatctcagccaattcctgcacgaacaccgcgccctgcgcggccaaatcctcgacgacatgcttgttgtgcacgatctggcggcgcacatacaccggcggcaatccgtcggcacgtggcgtatcggcggatttgagaatcgtccgcaccgtcagaatcgccctatccacgccggcgcagaatccgcgcggatccgccagcacgatgcgtttgcccatgtcaagccgccttccaatcgtatccatccatcacaacagcaatcaccaatattaaggcacgggcgccgtcaatcgacatcggccgtcttcatccgcagaatttccacacgacaagcgcatccaccaccacatcgtgagcggtaacatagtagcggaaacacagtcgacaacactatggagtgatttatgacctgcaccaatctgccgccacgcaccggacagcaattttccatttcgcatggcgattaccatgccgtcgtcaccgagttgggcgcgacgctgcgcaaactgacctaccaaggcgaggacatcatcgtctcccccggtccggatgacatggtgacctgctgccacggccagctgctcatcccgttcccgaaccgcatcgagaatggcgaatacaccttcgaaggcaagacctacacgctgccgatcgacgagcatgagcgccacaacgccatccacggctacggcaagcgcgcgttctggaagcttgtctcccttaaagaggatgccgtgaccctcagctggcgcgcccccaacatggagggatatccgttcgacatcgtggtgaccgcgacgtacagcctcgccgacgatggcctgcatctgaacatcagcgcctacaacaacggcgatgcagacgcaccgtgggccttggccatccacccgtggctcgccaacggcttcaacggatacggcgatgagatcgacgcccacaacgccaagtgcagcctgaccatgccggggcgcacgcatgtcaccgtcaacgagaacctcattccgaccggcaccgagccggtggacggcaccaagtacgacctgcgtaaggacacgctgctcaccgagcagccgttcgacgacgcttggacggatctggagcatgccgaagacggcaccgtcaccgcggtgttcacccgtccggacggcaagaaggtgcgtgtgggcggcgacgagaccgtcacctcgttccaggtgtgcaccggcaccggtttcccggccatcaagcatccggccggcgtggcggtggaaccgcagacggcatacgcgaacgcgttcaacaccggcaaggacctcatcgtcatcaagccgggcgagacgtcaagcacggcgctgttcatcgggatgctcgactgatataatcaccatcggaataagtcccggccacacagcggacgccgaatttggcaaacgtctcgctcgtgtgcgataatcccgaaggcttattaatcgcaagtaaaggagtccaatcatgggcatgcgcggacgtaagcgcaaggatcgtcgtaagaaggccgccaatcacggcaagcgcccgaacgcctgatccctgccggcgcgaatagcgtcacagagcatggaaaaccccgcggaatcattacggttcgcggggttttcccatattcagacgctgatgcggcgggcgcgcctcgcgtcacatcagcgtggcacttggcgcatgaaacgccgcacgtccttccaattactcgtcacaacagtggtcaagtgtcgcctcaagcctgtcgatcaggctttgcggcgcgtgtttcggccgcaggtacgcgcgcatcgctgcgatcagcgcacgttcgcgttcatcgcaacaggtctccgggtcgaagcagtccccggaagccacgacatgcacgctggcatgcgtcacctgcgtcaccacaccgttcgtgttggtggtggtcgaagtaatggagatgtgccgttccattggttcgctcatggtcgatccttcccggcagtggcatagccacgttccttggcgtaattggcaagctcacgtttcagctgtgtgcgggcgcggttgagccggctcatcacggtgccgattttcacgccttgttcctcagctacctggctgtatgatttgccgtcgatcgcggcgtcgatgaaaacctgcctgcgttccggggaaagccggttcaaagcggccatgatctcctccggcgcgtaggcgtccaagtattcctgttcggcggatttgagttgttcggaggaatgctcggacgcggaatacaggtcccagtcgtcgtattcgccggtggaatcgttagcgcgttgcggccgtcgcttggctttggcgtactggttgaaataggcgttgcgttcgatggtggtcatccaagccgcgaaattcgttccttctttgaaggagtcgaacgccttgaatccacgttcgaaggtgtcctgcaccagatcctgcgcgtcgtcgggattgttggtcagtttcatcgcctgccggtacagcgagtccacaacgggcatggcaagcttctcaaaccgcgcgcgccggcccgccatggattccgtttcttgttcagtcacaccctcattgtaacttccccgacgtcacacgtcgtgcacatggttgccgctaaaatggctcttcggtatccgctcggcgtctcatacacagggagaacacgaaaacatggctttgactctggaatcggcggcccgactgctcgataggcacggactgctgcgcgaaatcatccgcggcgatgtctggacgcttgatccgcacgacatcaagggattcgacgagccgttctccgcaatcacctacgacacccgcaaggtggagccgggcacgttcctgtgctgcaagggccgtttcaaggccgaatatctgcagggcatcgacgaacgcggccttgccgcctatgtgtcggagaacgacttctccgacgccacgcaagctccgggccttattgtggatgacgtgcgcaaggccatggctttgctatcggctgaattctatggtcgtccgcaggaccagttgaaggtggtcggcatcaccggcaccaaaggcaagaccaccaccgcctatctcacgcaggcgatgctcaatggctgttccggcggcaagtgcgcgctgttttcctccgtggacaattgtcttgacggccacacctacgtggaatccgatctgaccacgccggaatccatggatgcgttccgcatgatgcgcgaggccgttgataacggcatggaatatctcgtcatggaggtctcctcgcaggcctacaaggtggaccgcgtgttcggtctcacattcgacgtggccgcgttcctcaacatcagcccggaccatatcagcccgatcgagcatccgacgttcgaggattatctccactgcaagcgtcagatcgtcaagaactgccgtgccctcgtattgggtgccgattgcgcgcgcgccgacctcatccggcaggacgcacgtcatgccagcgttcccgtcaccacgttcgcgcttggcggcgattccacggcagacgtcatggccgcgccggcgaatgacgatcacagccgcttctccatcgtcatcgacggcacctcgatcggcgagttgagcctgacattggacggcgatttcaactatgcgaacgcggcggcggccgtcgcgatcgcccgtgcggccggtttcgatttcggttccgcacaggccaaggacgcgttgcgtgagatggagccggtacgcatcgccggacgtatggagcatttcaaggacacgcggtcgaacaccatcgccattgttgattacgcgcataactacgcgtccgtcaccgcgttgcttgactacgtcgatcagcgttacggcagcgaaaagccggaaatcacgctcatcaccggctccgctggaaacaaggcatacgatcgccgcgccgaaatcgtccacgccgcgcaggaccgcatcgaccatctcgtgctcactttcgaagacaccgacgacgagcctgtggaacaggtctgcgcggacatgaacgacagcgtcaccaacccgcagcttgacgtgaagaccattctcgaccgtgccgaagccgtggagaccacggtaagccgcgatcgcaaggatcccgagcatctgcacatcatcctcatcatcggcaagggcaacgaacgttggttcaaagaccacggcaagcacatcccttacgagggcgacgaccgcatcgtggaacgcgtgttccgtctcaaataacaactaaggtgaaggcattatgacacgattccaaccgattctgctgggcagcgacatcaacgtctacggcatggccagggcgttccatgaggagtacggcatcgtttccgaggcgtatgcgtatttccagctgagccccacgaaattcagccgtatcgtcaacgtgcacatcgtcgacgatttcaacaacttcgtcacgttccgtaatttcatgctcaagctcggcaagcgtatgaaggccgaggatccggaacgcgtgctgctgctcatcccctgcggcgacgtgtacgccaatctgctgagccagtgcggcgacgatcttcgcgaatatttcgtatacaacacgcttgacgtgaacctttcgcgccggctcgcctacaagtccacgttctaccagatctgcgagcagtatgatctgccccatccgaagacgcgcaccgtcaccgccgatgaggtgaaggcaggagcctaccgtgatttgccgttcagctatccggtggccatgaagcccgcgaattcggtggaatggctcaacatcgatttcgagggccgtcgcaaggcctacatcttcaacgatccggccgaattggagaccatcatcaagcgtgcgtacgatgccggatacacgtccgaaatggtgattcaggacttcatccccggcgacgattcccgtatgcgtgtgctgaacgcctatgtggaccagcatcatcgcgtgcgtatgatgttcctcggccacccgctgctggaggatccctcccctgtcgccgcgggcaattatgcggccattctgcccgactacaacgagggtgtgttccgtcgtatcaaggctttcctcgaggacatcaagtacgagggcgtggccaatttcgacatgaagtacgacgaacgcgacggcgagtacaagctgttcgaaatcaaccttcgccaaggacgttccagctatttcgtcacgctgaacggcttcaatctggcgaagtatttcgtcgacgacctcgtcgaggacacgccgttcgacggcaacaccctgttcggccgcggttcgaaactgtggcttgagattccgaagtcgattttccttgattacgtcgcagaaggcgctgacaaggaaaccggcaagcgcatgctcaagtcgggcgattggggtaccaccttggagtattccaaggatatgaatccgctgcgttggctgatgattcggcacatgttctcgatttacaagaagagctatgccaagtacttcaccaagaagggcgagcttaagtgaaacgaccgtttttcgccgtactgggcggcatgggcacgctggccaccgaaagctacatccgcttggtcaaccgcgccacgcatgcccattgcgatcaggattatctggactacatcgtcttcaacgattcctccgtgccggaccgcaccgcgtacattctcggcgaatccgacgagaatcccttccccgtactcgccgacgatatcgagaaggcaacggcgatgggcgcgagtttcattgtgctcacctgcaataccgcgcactatttctatgacgatttccaggcgttgacgacggtgccgattctacatatgccacgcggcgcggtggcacgcatggctcagcgttatccgaaggatcgttttccgcgggtcggtttcctcggcaccgtgggttcgagcaaatccggcgtgtacaagcgtgccgtcgaagaggccgggtacacgttcgtcgaaccgaccgacgagttgcaggcccgtatcacttcgctgatttatgacgatgtgaaaggtagtggcgagctcaatctggaacgctacgaatcggtgttgcgcgatatgctcgatccggcaggcccctgcgcgtgcgacacgctgatattgggctgcaccgagctgagcgtgctcaacgaggcgtttccgctaccccagctgccggtcatcgacgcgcaggccgtgctggtggaagataccgtggcgcgggccgaagcgttgcgcgcgtagctattatttgtcacgcctatcttcgactgcttaggcgtcggacgataaaacaagattgtgggtgacttcccattgcctggggagccacccacaatctgttttacatggacggtgtacgccgcacgtatggcgtcatcgtccgatgttgtttcgcttcgtcacttcgtttcgttttccgaagccgtttccgcatccgccggttcgttggcatccgccgcctcatccatttcatccgcatcggcgtctgctaaaacggaatcgtccggaccgacgctgccgaaatcgttgatgttgaaatcagggttggcgtcggattcgaaatccacgtcagcctcgtcctgctttttgcgcggttccggatcgacggcttcctggaacacacgttcggcctttggcttcttcaggtcggggttgatcttctcctccagcatgagtcgcgcatcaccggcggttgtgaagctgccacagacgagcacgccatgaccgtagccgacgcccagttcgtcatcggcatcaaccatgttgacggcttcctggatggcgtccggcaattcgggaatgcaggtgacgcgttccggcccgaaaacacggtccgcgatcttcttcagatcctcagccggcatcactcggtcacgccacgagttctcggtgacgatcacatggctcagcaacggttcgagcacgcccagatactcctcgacctgcttgtcccccatcatggcgaccacgccgacgagctgctggaaatcatagttctcttcaatggcggcacgcagcgattcggccgcgttcacgttgtgcccgccatcaaggatgatggtaggcgaggtacgaatttgttcgatacgtcccggaatgcgtacgctgctcaacgcttcggccaccaaatcgccgtccaacgcgccgttgacgggaatcaccacttccgccgcgcacagtgcggcgagcgcgttgtgtgcctgatgctcgccgaatttggcgatcggtacttccgtgtaagtgccgttcggagtgcgcagggtggccacctggccgccaacggccggcactcgggtaacgacttccgattcgacgccgtcgcgcaccaagctggcgtggttctccttggccgcggcctcgataatcggcatgacctcgtcctcgtgtggctggcggccgatgatggcggtgcagttcggcttgatgatgccgaccttttccgtggcgatttcctccacggtgtcgccgagccatgccatgtggtccatgtcgaccgggccgatgatggccgcgtccgcgtcgagcacgttggtggcgtcccatcggccgcccatgccgacttccacgatggcgacgtcgaccggcgcgtcggcgaatttccagatggccatggcggtgagcacttcgaagaagctcatcttcggcttgcccagctcgcccattttcatgtccacgatggcgacgaggtccttgacctggtcccaggtgtcgacgaaatcgtcgtcggacagctgctggccgtcgatggcgatgcgctcgttgacgtgttccagatggggcgaggtgtataggcccgtacgcatgccgtaggcgcggcagatggcttcggccatacgtgccgtggagcccttgccgttggtgccggtgatgtggatgacgcggaacgactgctccggatggcccatgatgtcgaggatcatcttcatgcgttgcaggtcgagattggtggtgttgcgttccgatggacggctcatgatgtcgcgttcgacgtcgatcatgctttcgttgttgcgattgggatgttcgaatgacatatttcccgttttcctcccgtaccttgcggacagcacactaaacttttcccattctagatgtccgcatgaacgttgcgcgccgggaaaagttataggatgggttgcggtaatttccgtacgttacgaatgcatgttcaggagatgtgatgggcgaagtcattactgacaaggacaaggaatacgagaagatggagcgggaggccgctccgggaccggatcaggccatgagcgatcgtgtgaacaatcgttcgctgcgtccgcgttccgaggcgttcaaggagttcatgaccaccggttgggatgacaacgagccgcagatcgagccgttggagtcctccaagtacacgccggcgcgtctggaggcgttgggcaaggcgttcccgggcgagcgtatcgtgattccggccggccagccgaaggtgcgcaacaacgattgcgattacgcgttccgtccggatacgacgttctcctactacaccggtttgggtgaggatttcgaggccggcgcggtgctggtgctgaatcccgtcgatccggattctccggaggcgaagaccggcaagacgcatgttccggaactgttcgtggctccgcgtgccaaccattacacgcaggactttttcatgaacgcccattatggcgagtattgggtgggtccgcgtgccggtgtgaaggaaatgaccgcgatgaccggcatcgaaaccaacgacatcgcgcagctgcccgacgcgttgagcaaggatgtcggcactgaggccggcgcggtgcgcgtgcgcgtgatccgcgaagccgatccggcgattaccagcatggtcgaggagatccgtgaagccaacggtttcgccgatccggacaacaacaccgctgccgatgacaagctgcacgaattcgccgccgaggcacgcatgtgcaaggatgagtatgaggttcgtgagatgcgcaaggcggtcgcggcaaccaagcatggtttcgacaacattctgcgcaagattccgtcttcccttggcaagccgcgttcggagcgcatgctggagggcgcgttcaacgccatctcccgtgaagaaggcaacgaggtcggctacgacaccatcatcgcttccggcgcccacgctccgattctgcattggatgcgcaataccggtaccgtggagtcgggcgagctgctgctcatcgacgccggtgtggaggtcaacagcctgtataccgccgacatcacccgcacgttcccgaccaacggcaagttcaccgatttccagaagaagctgtaccaggccgtgttggattcccagcaggccggtttcgaggcggccaagccgggcgccacgtattcggacatccatcatgcgtgcatgcgcgtgatcgccgaacgtctgcatgactggggtattctgccggtcgatgtcgaggagtcgctctcccctgaaggccagcagcatcgccgttggctcgcctgcggcgtggcacatcaccttggtcttgatgtgcatgattgcgcgcaggcgcgttatgagtcgtatcagaacgccaagattcgtccgggcatgatcttcaccatcgaaccgggcctgtacttccgtgaggatgatctgctgattccgccggaataccgtggcatcggcattcgtatcgaggatgacgtgctcatgacggaggatggtccggaatggatttccgcgggcattccgaagcggatcgacgatgtcgaggcgtggatggccgatatggccgccgaaggcgtgaaggcctgaggacgcatcatgcccacgcctgaattcgtactctcgctacgtgaaaaaataggccacgatctgttatggctcatgggcgtctccggctatgtcgaggacgagcagggccgtgtgctgttggggcgtcgttccgacaccggcgaatgggccatggtgtatggcatcaacgagcccggagaggaaccggccgataccgttgcccgcgaggtcaaggaggagaccggcgtggatgtggtcgtcaccgatctggtgtcggtcaaatcgtccagaaaggtcctcacctatgcgaatggcgacaacaccatgtacatggatcacctgttcatctgcaggcccgatccgaatggcaacacggagccgttcgtcggcgatgaggaaagcctcaacgtgggctggttctcccctgatgctctgcccgagccgttggcagccaccacggtggaacgcatggcttacgtacgcgaatatctgaaggccaaggcgaatggcgattcccatgcccagtttgccttcaacggcaccatccgctgaaatcgccttccatacatcataaaatggaatccccgcaacgtttcaagcgttgcggggattcctttttattagattccgtggatcagctcactgctgggcggcaagcagctcatgcagatgctcgcgatgcttgcgctgttcgcgcggatcgggcaccggcagggaggccagcagcttctgcgtgtatgggttctgcggattctgcatgatctggtccgcatcgccatgttccacgatctggcccttgtgcatcaccatgatgcggtcggcgagcatgtcgaccacggcgagatcgtgggtaatgaacaggcatgcgaagccgatttcggcctgcagcttcttgaacagttccagcaccttcgcctgcaccgacacatccaacgcggaggtcggttcgtcggcgatgagcaggctcggcttcaacgccaacgcgcgtgccaaggaggcgcgctggcgctggccgccggacagctcgtgcgggaaacggttcatgtaggcgcgcggaagctgcaccatctcaagcagatcgcccacatacttgcgggcgtctgataccgacgagaacttcttgtgcacgatcaacggttcggccacgttttccgcgatggtcatcagcggattgaacgagctgcccggatcctggaacacgaagccgatgtcggcgcgcttgggcttgaaatcacgttccttcacaccgttcatttctatgcctagaacgttcagggaaccgccggaaaccttctgcaggcctgcgatggcacggccagtggtggatttgccggaaccggactcgcctaccagaccgagcacttcggaacggtggatggtgaagtcgatgccgtccacggccttgaaatcaggctgcatgagatgacccggatacgtgatggtcagtcccttggcctcgaccgcgatgggctgatcgcgccaatccttctcacgttcgatgaccttgccatcggcatccttgacgaccagtttctggccaatacgcggcacggcggtaagcagacgcttggtgtagtcgtccttcggcgagtagaagatctgctcgacgctgccctgttcgacgacgtggccgcggtacatgaccacgacctcatcggcgatgtcggcgatcacgcccatgttgtgggtgatgatgagcacggatgcgtcgaactcgtcgcgcgccagacgcagcaggtcgaggatttcggcctgcacggtcacgtcgagggcggtggtcggctcgtcggccagaatcaggccggggttgagcaccagggccatggcgatgacgatgcgctgcttctggccgccggagaactggtgtgggtagtagtcgatgcgggtttccgcgtccggaatgccgaccttcttgagaatgtcgatggacttggcacggagttccttcttgtccttcatgccatgggcgcgaaggccttcctcgatctgccatccgatggtatacaccgggttgagcaccgaattgggctcctggaacaccatggccgcttcggcgccgcgcatttcgcgcagctgttcgccggacagcgacagcacttccagctcctcggtgcccgcgcggttcgacaggtacaccgcgccggaggtcgtagcggtctccggcagcagcttgatgagggagcgtgcggtcacggacttgccggaaccggactcgcccaccacgccgatgaccttcttacggggaatttcgaagctgatcttgtcgatggctttgatggaaccggcgtcggtcatgaacgagacgctgaggtccttgatctcggcgagattgccttccttgatttcactcatcggttcactccccttcctcggaagcccattcggaagccacgaatgacggatcacggtcggtgacggtcaccggtttgtcgctggctcccatcggattcttcgccgcctcaagttcggcgacgacctcgttgcgcttgcctggctcctggctggggtccacggacgtgtcttcgatggaacccaccacttcgcctgcggacttgcgggcgcgcagacgcggatcggccagatcgttcagcgattcgcccaccagggtgatgcccagcacgatgagcacgatggccagacccgggaacacggcggtccaccagatgccggcggtcacatcggagacggcgcggttgaggtcgtatccccattcggcggccgcggtcggttcgatgccgaagcccaggaagcccaggcccgcaagggtcaggatggcttcggaggagttcagcgtcaggatgaccggcagggttcgtgtggagttcttgaacaggtgcttggtcatgatgcgccacgtggaggcgccgaccacgcgggcggattccacgtacgcggattccttgatgcggatcacttcggcacggatggtacggaagtattgcggaatatagaccacggtgatggagatgccggaggcgaagatgccgctccacaggccggactggccgtgggagatcatgatcgccatcagaatcgccagcagcagcgacgggaaggagtacacggcgtcggcgatcatgacgagcacacgatcgacccatccgccgaaatagccggagaccaggccgagcagcacgcctgcgaaaatcgacagcaataccgcgacgacgatggcgatgacggcggtgcgggcaccccagaccacacggctgaacacatcgtagccacctgcagtggtgccccagatgtgttcggaggacggtgccgcctgggccgggaaggaaacgccgtcggcgcccttgagctgcgcgtagctgtatggcgcgatgagcggcgcgaaaatggcgaccagcaggaagaacgccgtgagcacgaggcccgtgatcagcatgcctttctgccagccgactgcgacgcgtagttccttgatgatcggaatcttatgccagaatggcgtcttgttgccgagcttgagctcgtccagacgattgtcgcctggaacggtgaccttgttggcagatgctgcggtcatgtcagtacctcactctcgggtcgaccaacgcggcgatgacgtcgacgatgaagttgacgacggccacgatgatggcgattaggataacgatgccctgcacggccacgaagtcgcgtgccttcaggtactgcgacagcatgaagccgagtcccttccattcgaaggtggtttcggtgagcaccgcgcctgcgagcatcagggcgatctgcatgcccatgacggtgatgattggaatcaacgccggcttccatgcgtgcttgttgagcagacgcttctcggagacgccgcgggaacgtgccgcctcgacgtagccggaattgtaggtggcgatcacgttggtacgcaccaaacggatgaacacgccggcggtcagcaggcccaacgcaagggccggcagcacggcatggcgcagcacgtcaagcagtacggacatatcacccaactggatcgcgtcgatgatatagaagccggtcggcgagaccagtcgggagaactgcatctcgctgccaagcgatgagcgcccggatgccggcagcacgttcagccagatggcgaagatgagcttcagaatcaggccgaggaagaacaccggggtggcatagcacaggatggcgaaggtgcggatgcccgcatcggccgcgtggtcacgcttgcgtgcggcgatgcgtcccaagccgatgccgacgatgagcgcgacgatgagcgcgaggaacgccagttcgaatgtggcggagccgtagtggacgaggatgctgctgaccttctggttgtcggtcagcgtggtgccgagatcgccgtgcagcaggccgccaagataatcgatgtactgcacgatgagcggacggtcgtagccggccgcatggatgcgcttctgcagttcttccggggtcaggcggccgccgagtgcggcggagatcgggtcgccggtggcgcgcatcacgaagaaaacgatggttacaagaatgaatactgtaggaatgatcagcagaaagcgtgtgagcacgaaacggaagaatccgcttgaaagcttgtttttcttggctttcggctgagcctcggttgcgctttgcgtcacgtcgggctcctttttccttattggtgtttcagatacaaattgagcccctgcccatcttaagggtgggcaggggcgatcaaaacctttatcaggccttggtcacggaagcgtagcggaagcggaaggaggcgtcgaggacgacacccttcacgctggatccggtaaccgcgacctggtcaccctgcagcagcgggatggtggaaaggtcttcggtctcgagcttctggatttccttcagggtgtcttcgcgggccttggcgtcggtctggccggcctgcttgacgatcaggtcgttgacgtccttgttggaatagccgttgttcacgaagttgccgtcacggaagaacggggacaggtagttgtccggatcggagtagtccgggaaccagccgagctggtagaccgggtaggaaccgtccgaatccttggtgacgttacggtccttgttgtactgggtccattcggtggactgcaggtcgaccttgaacaggccgccttcctcgagctgggccttgatggccgcatactcgtcggcggaggactggccgtagtggtccgggttgtactggagcttcaggtctaccggggtcttcacaccggcggcttcgagggtcttcttggccttggccgcatccggcttgccggaaccgtcgccataggctgccttcagggtgtcgtcgtggccggacaggccatccggaatgaaggagtacagcggggtgtaggtgctcttgtagaccttggtggccagctcgttgcggtcgatcaggcttgcaacggcctgacgcacggccttggccttgtcggcgttcggctcgctggacttctcgccgtacggcatgatcttgaagttgaaggcaaggaagcgctcttcgccgcccggtcccttgacgaccttgaccttgttgtccttggacaggtcctcgacgtcggtcggggtcatggagcggtaggccacgtcgacctggccctgctgcacggccatcttcaggttggaggagtcggcgaagtacttgacctgcacaacgtcgttcttagctggggtcaaacccttgtaggaatcgttcttggcatatgccagggcctcgttcaccttgtaggaggtgagcttgtacgggcctgcgaaggcgttgtccttgacgatggtgttggcatcggtcagcttgtcggcggagaaggactcttcgtcgacgatcgggccggccgggctggagagcacctgcttcagggtcacgtcgtccttgaccgcggagtggaacacgacggtggtgtcatccttggcctcgacggactcgatgttggccagcagggaggacgggccgttctcgtcgttaatcttcttgatacggtcgaaggagaacttgacgtcggaggcggtcagatcgtggccgttcgcgaacttcaggcccttcttgagcttgacggtgaactcggtgccgtcggcgctccaggtgccgtcatcggcggcgatgtccggagacagctcggaagtgttgtagttctgcgagtacaggaacgggaacacctgaatctgcacggcgtaggaaccgttgtcgtaggagccagccggatcaaggctggtgatcttatcggtcgtgccgacggtgatggtgttgccagttgcggcgccaccgtccttcacgccgccgcaggcggccagggaagccagagccgcgacagaagccagagcggcgataactttcttgcgattcactatggaatcctctcttttctatccgaatcgcccctgtgcaaggcgatatagtgacaagaatcggcgcgcaatgttaaccgtacgtttcattggaggccattttacccacctaccttatattcgccgttttctgctatgcattaaaacggcgaaattccaacgttttaacgactagtgaaagaaaataagaaaaaccagccattttatgagacgggcccagccaaagtcgcattcaaggtctacgtccttcttttttactcattgctttcgcacagagagacccagataagcgcgcgacacgcggcacaacacgaattgcattaatcaattaacagcgttaatatattaagaagttcaacgagggtccatgcactgtcgcaaggaggtgagcatgagtaggtacagcgcccaacagtcatcgatctcggaaaacaaccgttcccgcatcctgcaatacctgtaccacaatggcatctgctcacgcgcgcagatcgccaaagccatcaagctcactccggcggcaatcaccaaaatcaccgcgaaactgctggcgcagggcatcatcgacgaaaccggcgacatggacggagacaagaaccgccgttccatcggtctgaatctcaattgcgccaaataccacatcatcggcgtgaagttcgcccgcagtctggtgcaaatcgcggtcttcgacctcaagtgcaaccgtatcttcctgtccgacttgcctaccgtcagcgaagagcacatccccgaaacggtggagcgcattcgagataccgtacgccagctcatcaaggacgaccccagcatcgtggccgtcggcatggcggttccggggccctatttaaaggacgaaggacgcaccgctttggtctcctccatgcagggctggaggcaaatcaacttcatcgacgaattcagcaacgcattcagcgtccccgtgttcgtcgaacaggacgcccgcgccggcgcgctggcgcagttcctgctcaatccggaactgtcggaaggttccctcgcctactatctgcttggcgaaggcatcggcctcggagtcatcgacaacggcaccatctactacggcgagcacggcaccgccacggaaatcggacacgtctccatcgacgtgaacggcaagccatgcgactgcggcaatgtcggatgcctggaacgctactgctccgccaacgccatccacgaacaactcaacgccaacccgagcatcgttcccggatgcgagacgatgacgcatgcgcaggcttgcgcagcactgttcgccaaggcgaacgcgggagacgagaccgcgacgcttctgatgctcgatgttgcccgatacgttgggtacggcgcggtcaccatcatcaacgctttcaatccgacacacatcgttcttggagacatcatcgcgcaagccggccagccgttgctcgacgaagtcacacaagtcgtgcgcgaacgcacgatccccgaaatcgggcgcaacacccgaatcaccctgtccgccctgcccaccgacgccaccgttaccggtgccgccgccgtggcgataaccaattttctggaacatccttcgatgttcttcgacgtcgcatagcacgccgcccaccaaagaaaggaaccacccatgtccaagccaatcgtcatcgccctcggtgaaatcctgtgggatatgctccccaccggcaagcgcgccggcggcgctcccgtcaacttcgcctaccacgcgtcccagaacggcgcggaaagctacgccatcagcgccgtcggtaacgacgagctgggcgccgagctgctcaacgatgcgcacaaggccggcatcaacacgctggtgcagaccaacgaatacccgaccggcaccgtcgccgtggcactgaccaacggcattccggaatacaccatcgtgcagaacgtggcttgggaccacatcggctacaccgacgaactcgccgaggccgtgtccaaggccgacgccatctgcttcggcacgctgggtctgcgttcccaggaatcgcatgacaccatcatcaaactgctccagcatgccaaggaaggcgcgctgaagttcttcgacatcaacctgcgcgccaacttctactccaaggagctgatcgaggagctgctgggatacgccaacatcttcaagatcaacgacgacgagctcatcatgatgcgtgagatgttctccattccggagggcaacgacgaagaggcctgcaagtggttcatggatcgcttcgatctggagtacaccatcctgaccggcggcgcgaccttcagcaccatcatcgccaaggacggcgagacctccactctgctgaccccgcatgtcgaggtggccgacaccgtcggagccggcgattccttctccggctccttcaccggcaagatcctgtccggcgcctccctcaaggaagcgcatcgcgcggccgtgaacaccgccgcctacgtgtgcaccaaggaaggcggctggccggcctacccgaccgaaggcgttccggattacctcgccgcagcagccaagtaagcgtatcttctcctttcatcatcaccgattccgcatgccgtcaaataacggcatgcggaatttttttaccggttttgcgaagtttcgtcggtatgatgaatcgccgatagcataatttggtttgtcggataaaccgtggtatcttgaaatgtctggctataaagccggaaggtttgataattcaatatttggggatgatcggtttcgacggtgacctgttcgtcgcagggaagcgtgccgagaacgtagggtccgctcgtgaatgccccctacaaaagaataagtgctaaatctaaccgcactgagttcgctctcgctgcctgagcttcgcgccaggattaaccagtgggcagccgctccgttcactccccctcgtctttggggggatgttgagcgtcgtttagaagacttgccttaccggctgagccacagggccggcaagggacttttactgtagatatgctcgccatcagttgtctgcgacatcgatgggggcagaaaaaccgccgcacggccagcagactacgcacgtagaagactgagggttcggtcatcggaccggggttcgattccccgcatctccacggattgaaagccgccagaaatggcggctttttcctttatttccaacggtttccgccacttttgcaattcgctgcaattcaccctttatcgcgatatttctcaaaaacatgggcaaaatgtgggcacgaatcatgtgtcagcaatgacggctttctgtattggtaatcacatttctcgtttggtgaaacaacgcatgtcggcagcaacgcctccgtatcatcgaaataaccgtccggcgccttccaatattacaagccgccggccagccaaccatcgaaagggacgatatcatggcgaagcttacagaggaaatgaaggatttcatcagcagcaatctcgcttgggtggccaccatcggcaaggatggacacgtcgatttggggccgaaaatgagcacgttcgtcatcgatgacactcatatcggctatcacgagcgcaccgccggtcaaatgtaccgtaatctgctcgacggcagcgaactggtcatcgcagtggccaatcttgagcagaagcgaggttatcgtttccgtggcaacgtcactctgcattccgatgatgcgatctacgatgagcaggtcgccgtggccgaacataacggcacgaagaagcccatgaccattcccgttctggagatcacggagattcaggacttgacgccaggggcgaccgcaggcaagaccatcgtcaaggactgacgcccgttcaacgcatacggctaataccatccatccaaacgcggaaacgcgctctggccctcccttggaaagaaggtccagagcgcgtttcgtttttctgtcaagacaaaaagagctagatcaaagtatttccgctccgtcatgcagtgacgttgcgcaataacgctatttgatgatcggtctcaacggcgcggacacgtccacgttatgcttgtctccaatcacgttcggatcattgacgatcttgtccaccaccgctttcttgagcttcaggtccgaggaatcaccccatacgatcacgcggtctcccccattgagttccgtggtgatggaatcctgggtcgccgcggtgaccttggtgatggagttgcgcatcgattccggcagtgagctgagaatcttcaacgcttccttgataggacgcctagacaggctcgcatcgacgttctgcacttcgatgacgggaatgccttccacggaaacgccgctgacggaattgagcacgcggcccttgctgtcgaccgccgtcatatggtcctcgctggttttgagcatggccgcgggtttctgcgccttgatcgtcacttcaagcgagttcggcagctgtttcttcgacttggctgacgtgactcccggaatcgccttgatctgcttctccacggctccatccgaaaccaggaacaacgattttccggactgctgcctcgcgatgtcaagcacctgcgattcactcacccattcgttggcgccgaccacgctgatgttgcctggctccaaacggaacaccgacgagaagaggaacagccagacgacagctcccaaaaccacggctacgacaagaccgatgagcacgcgcaggactatggctcgcgcgccggcctgacggcgttccttgagccgttcgccgaaatcaaccactttcggacgtgtcatgatgccgatcgtgccggtggtctcctgcagggttttggaaaccaggtcctcgctttgcaaacgtcgcgcgtctacgaagccttcggcttttgaacggtccgcgtacccttcaatcgaccgtccttcggcatgctccgatgagatggaccgtccggaacgtcgtccgcccgactggtctgtctcctgcacatccttgccggaactgatgacccgtcgagccatcagccctcgcaatcccaacgatgcgcttcaagagcatgcaggatgacctcgtccatctgcgtgatgtcgccggcgcctacggtgaagatgacgtcgccatgatgcgcgcgcatcaccatcatctgggccgcggtgtgcatgtcttcgacgccacggatccagtcctttgccggttcatgctcaagcttgagcgcctcgtccacgatggtggccggagtcacgtcggggaaatcctcctgcttctcgcgcgcggggaagatgccggtaacgatgacgtcatcggccttggcaagcgcctgcgcgaattcagagctgaagaaacgcgtgcgggagaacaggtgcggctggaagatcacacggatcttggactgcgggtagcggcgacgggccgcatccagcagcgcagcgatttcggtcggatgatgcgcgtaatcatcgacgaccgtcacttggctgacggtgccacggacctggaagcggcgtgcggcaccgaggaacgaggtgaccgccgcggaggcacgttcgacgtccatgcccaacagcgcggccgcgataatcgccgcggaggcgttgcgtgcgttgtggatgccgggaacggtaagcgtcactgcgatgcggcgctcctcttcgccgatcagtccgcccggaatatgcagcgtgaaatgttcggctccgctttcggcggtttcgctttccgattcgatgcgtaccagcgtggcaccgttcaggtcgcccaattcggcggcgttccgtgttgaatagacgatcgtgcgtccggccacggtggcgtcaagcgcacgtagcacggcaaggttgccttcgtcgtcgccgcacatgattacggctttggtggcgtgtccggcatggtccacgaatgcggcccgatagttgtcctgcgtgccgtagtggtcaaggtggtcggcttcggaattggtgatgatggcgatttgcggatggtatttggcgaagctgccgtccgattcgtcggcctcggccaccagcacgttgcccttgccggcatggccgccgtccaaaatggcaccgtctttgccttggatggaaccgccgatggcatagctcggatcggcgagttcgccttctccggcgttcacgagaatgtgcgccagcatggagctggtcgtggtcttgccgtgggcgccggccacggtcaccgcacgtttcgcgttcatcagcagggcgaggatgtcgctgcggtgcacgatgcgctcccctgcctcatgcgcggcgacgatttccggattgtccggcttgatggcgctggagaacacgacggtgttcttgccttcgacgttcttcgcctgctggccgaattcgacggtgatgccgaggctttgcagacggtcggttttggcgcttggctcacggtccgaaccatcgacctcgacaccctgctcatgcagcatttcagcgagcacgctcatgcccgcgccaccgatgccgatgaaatgcgtggcacctaggtcatgcaccgtctcttcaggtgcgaacgacgcatgggttgggtcaagaattatggtaccggcttcacgctggttgtcagacacgattgctcctcgtaaattgttttcaagctcatttcattatggccgcacccatggtctcccacggggtgcggtcatgattgttcggccggttaatcagctggctgatcgattagcgcgagcacgcgcttcgccatgacttcggcggcgtcgcggatgccgtatttccacgcgttggcaccgtatcgggacagcttgtccggatcggcgagcagttccggcacatgaccacggacccaatccggggtgaaatcgccatccgccaccatcaagcccccttccgcgtcgaccacgggctgcgcgttgaagcgctgctcgccattgccgatcggcagaggcacgtaaatcgccggcagtcccaaagccgtcagctcgctgaccgtgccggctccggaacggcagatgatcagatcggcgcaggcgaacgccagatcgatgcgttccagatagggagccacacggtaatcgccatccgaaacgtggtcggggccaagctcgccgagcacgtcctctccggcgcttaccgacaccaaggaacgcacttcgtcgtctttgcccttaccggtcagatgaatcacctgggcatgcgcaagcagatccttggcggaagcggccacagccctgttcacgttcaccgcacccaaggatccgccggtgacgaccacgagcggacggtccggatcgacgccaagctgcgccgcggcggctttacgagtggcggtacggtcatgttccagatcggacgccaatcgtgcgattgccggacgaagcggcaggcccacgcgttcgacttcgacgcccctgcgtggtttcagtcctggctgggcgtatgcggcaccgatcatggacgcccaacgcgcgcccagcttgttggccatgcccgcgcgtgcgttctgttcgtgaatcgcaatcggaatgcccatgctgtgcgcggccgcgtatacgggtgcggacgtgtatccgccgaaaccgacgaccacttgggcctgatgccgggtgaggatgtcacgtactttggccttctcggccttccatttggctggaaactgcagcgcagccttgttgggcctgcgcgggaacggcactttttcgatggtttccagttcgaaaccggcctgcggaaccaaatcacgctccagaccgacggcggtgcccaccaccgcgatatccgcttccggttcaagctcgcgaatcacatgcgccacggcgagcagaggattgacgtggcctgccgtgccgccaccggcaagaacgatatgcttctgattgctcataatccacgagcttagcccaccatgcggcggcaggccacgcggcataccgccgccgatgcagatacttacatttcgtctacttttcttttgcttgcttcgcaactcgcatgacgggaaccgattacagtatgcggttctcggctttgacctgcggctgctccttcatcaggctgatggccacgccggcggcccccagacacatgataagagacgatccgcctgctgatacgaacggcatcggcacgcccatgaccggcagcaggctgacgacgacgccgatgttgacaaacgcctggccgacgatccataccgcgatgcacaccaacgccatggtgatgtaccggtcgcggacctgcacggccaccatcagcatgcaccacgtcatgacgatgaacagcagaatcaccatggctgctccgacgaatccggtttcctcgccgatgatggcgaagatgaaatcgttgtgcgcttcgggaagatagccccatttctcgccggaattgccgatgccgacgcccaacaagccgccggatgcgatcgcgtatttgccgtggaccgcctgatagcacacgccctgcaggtcggacggagagcaggtccggtaggccgccatgatgcggccgagtcggttggggctggtcagaatgaatccgacgataccgcatatgccaagcagcgcggctccggcaagccatttgccggggaatccgccaagcagcaatgcaatgccgccaattgcgagaataatcaagcccgtaccaagatccttgccggacatgaccaggcagaacgcgcacagatagccgagaataagcttggagtacgcgcggggcgcgccgaccttcttcacctgcttgcgcgcgttgatcagctcgttcggcatccagatgcataacgccagcttgacgatttccgcgggctgcatggtgaacacgcccggaatgccgatccatcctttgttgccgttgacttcgacgcccaatggcgtcagtgtggcggcctgcatgaccatggcgccaagcaggaaccagaagctgatctttcggtagaagctggccggcagcatcatcgtgatgaatgctatgaccaggccgaacacgcagtacatgccctgtttcagcgcctgcgcccatggcgactgcccgttggcgatcatgttcaccgaagagctggagaacaccatgatcacgccgaagatcgtgaggatgatcacgcataggcggaatccgtggaagcaccataacgggttggcgagattacgcgttccgccgttcttcaacggttctcgtgtctgtgccgcggcgccgtccgtcatgttcggacggcttgcggaagacgtgatgctacggctggcctcaggcttccccatgctcattcacccaacgctgagcctgctgcgcgaactggtttccgcgatcggcgtacgacttgaactggtccatggacgcgcaggccggagccatgagcaccacatcgccggattgcgcgtaggtgccggcagcgtcgatggcgcgggccatgacggtgtcgttgtccgtgggatcgatgatggacatgggaatgtcgggagcgcttgccttgaacgcgtccagcattggctgctggtccttgccgatgatgatggccgccttgatggtgtgcgcctggtcggcgacgagctgttcgaaacggcttcctttggcaagtccgccggcgatccacaccacggacttgtccgcgaagctgttaagcgacgccttggccgcatgcgcgttggtggctttggagtcatccacgaaacggatggtgccaccgtcggacgttttggcgacggcgacggtctggatgcggtggccgcccggcgtgaactgcttgagcgcggccaacgccttgtctttgtctgctccgagacccaacaccagcgccaacgcggtcagggcgtcggcgagcagatgcgggtagaccgtgccatccggctcggtcagatgcgtgaaatcggtgaccttcgccacttggaacggctttcccgcttctccgccggcaatgccggacatgtcgacgatccagccatctttcacaccgatctgcccgtccttcggctcggccaacgtgaagccgatccggcggcattccggcacggtctgggccgcgaacgccaatttggtgacgcgttcgtcgtcggcgttgtagaccagcgccttcttgacgttgtggaacaccttcgccttgtcggcggcatagttctcgatgccgccatgccaatcgagatggtcgtcggcgatgttggtgatcgccgcgcagtcgagttccagagaataggtgaaatgcagctggaacgagctcagttcgacgcagagcacgtcgttcgcggggtcgacggcggcgtgcgacacggctttgccgatgttgccgacggcgggagcggccaggccgcatgcggtcagcatttcggaggtcatttccgtggtcgaggtcttgccgttggtgccggtgatgccgatccactgcgccggcttgccggtggtgttgctgttcacgcgcagctgccaggccagttcgacttcgctcatgaccggtatgttgcgtttctgcgcctcaagaatgaatggcgtgcgcgggttgaagaccggcgaggtcatcaccatgtcggtattgtcccaatcgatttggtcgaaggaatgcaggtcggcgtccggcttcttctcatccacgcccagcactctgccggcacgggagcccagcacttccatcatgctttgcccggagacaccgagaccagccacgattacggtcttgccatccatattcatatccatcacccttcaatcggaaacgtcatttgccgtgatagcacactcatattgcgggcgtaaagccgcgcccgcaatcgtgtcacaggccggaacgggccacccaatcgccgtagaacagcaccaaggcgatcagcacgaacagcatctcgatcatccagaaccggaccacgaccttcacttccggccagcccttcaattcgaaatgatgatggatcggagccatcttgaaaacgcgcttgtgggtcatcttgaagtagccgacctggatgatgtcgctcatggtctcgatgacgaacagaccgccaaggatgatcgccaggaattcggtgtgcgtggcgatggacatggctgcgaacagaccgccaagcgccaaggagccggtgtctcccatgaagatggaggccggattggagttgtaccacaggaagccgaagcaggctacggccgcgcacgccgcgatgatggtcaggtcaagaggatcggacaccgcataggtgaagcctggatggtccgaacccttgaggtggtagaactcccagaacgcgatgatcgcatagccgatgaaggcgatcatcgaggagccggcggccaagccgtcaagaccgtcggtcagattgatggcgttggtccatgcggtcatcaggaaattcacccagatcacgaacagcacgatggccacgacacgaccggcgaattcaaagctgaagaacggcttttcgatgaagctcatgccggcctgggcgctggggaagccggatttggtcggcagaatcagcgccagcaccgcgtatatggtggcgaggatgaactgtccgatgaacttgcccttgacggtcagtccctcgctctgcttcttgcggaccttcgcgaaatcgtcgatgaatcccaagaatcccatcgacagcatggcgaacagcaccaacaccgcggaccacgacggcacctctcccctggtgaggaaccgatacagtgccgaggagcaccagccgagcaccaccgcgaggttgatgaccacgccgccaagcgtcggcgtgccgcgcttgacgagatgcgacttcgggccatcctgacggatgtactgtccgtaattgagcttgtgcaccaacttaatcagcagcggagtgcccacaatcgtcacgacgagcgacaccataatgccgatgatgagtgaaatcacctgatcttctccgtttcagtcagctatgatcggcacgacgccgattccgtcagttttgcgtccaacgctccgccagagcgctcaatccggacgcgtgggatcctttcagcaacaccactgtaccctcatggtcggtcgcaagccgggtgaccattcggtcggcctgttcggcatcatgcgcccattgcaccatcgtcgggtcggcggcaaccgccttgccgccctgcgccatggcctcggcaagcgcgtccaacgcctcgtcggaagtgctgccgaccgtcacaagcgcgtccgcaccgccctcgacggcgtatctgccgacgtcctcatgcaggcgatgctcatccggtccgagctccaacatggctccgagaaccgctattctgaacggctgctgctcggcgccggcatgccagcgcgacagaccatcgagtccggccttcatggaatcggggttggcgttgaacgaatcgtcgatcagtgtgaacgacgtttcgggcttggtgacggtggacaccgccatacgatgcgggctgatgctcgtcacgtcggataggccggaggccacagcgtcaatcggcatgcccaacgtcatcgccaccgtggctgcggcaagcgcgttcatgacgttgtgctgtccgcagatgccgagcgtgacgttggcgtgccggcctgtcttgtcttccagtacgaatgacggatggtcgagatcgtcgcagcgcacgtcgagcgcggtcgtgtccagttgcgcgtcttctttctgcggcaggccgaaccacagcacatcggccggagcgatggcgctcatcgcggccacatgttcgtcgttggcgttgaggatggtcaggccgcccggcaccagtccgcgtacgatttccgatttggcttgggcgatgcgttccgcagagccgaattctcccagatgcgccacgcccaccttgagcaccacggcgatgtccggcggaaccagggaggtgaggttggcgatttcgcccacgtgattggcgcccatttccgccaccaggaaacgcgtgccggcgttcaccttgagcgacgtcagcggcaggccgatctcattgttgaacgatccgaccggagcgacggtgtcgcccattttggacagcagcgatttgagcagatccttggtggtggttttgccgacggaaccggtgatgccgatgacggtgaacggcgattccagcgcgcgccgacgctcgatattatgcttggcgagcgctcccaacgccttgacggtgttttctacgacgatctgcggcacctgcgcgcccgcgatttcgtggtcgaccagtgcggccacagccccctgcgcgccgaccttcggcacgaaatcatgaccgtcgacgcgttcgccggcaatcgccacgaaaacggatcccggcacgatctggcgcgaatccgtgaaggcgctgatggccaccggttcgtcggtcggcacggtcgtcggcatcaaccgtccatcaaccgcctgcgcgatctccgtcaggctcatcggcatcatggtcgggctgctcactgtcgttactcctctaatggttgggtttgtgtttgatgtggagaatgtttcgttccacgtttagttcaggtcacgcgagacgcgtaacgcgcttttgatgttggctttcctcacgccggcggccagcaccatggcgatggacagggacagcgaacggctgtccgtctggccgtatgccgtcgcggcctgcgccgcaagcaggtcggattcctgggttcgtcccgcgatgcgggtctgtttgccgaccgcgcatccgaattttgcgacgagtttcgcaacctcggcatcgctcaaaccattgtcatcgcaggcaagcacatcgacgctgaccgattgcaacgcgtcctcacgcagggtctcttcatccaacgcgaggatcacagcggctgcgccgtcttcggcgcacaccgccatggtacgttgcacatcgatggccgacagaggatattccagattgaggaagcgttccaatgactgtgaatcggacgagctgatcacgccgacggggttgcccagcatgtgcaggaaatccgcgaggttcctcacttcggattccacgatctccctgttcttccccgtgatggcgaatacggccaatgcgtcggacggattgccggccatgtcgctcaccagtttgccgagctgtcccatggtgggttcggcgtagatgagcggaatctggatgtcgtcggtttgaccgcgcagcgcatggggcacaatcgcgccatatgctccctgctcctgagcctgcgacaactggtgcacgtccacatcggcggacgggacgaacagtgcgccgggacgcaccgattcgacatcatccgcgatggaagtgatcgtcacttcagccgccgacgtcggatcaagatcgaaaccgtatcggctggcaagcagccctaaagtcattcgtctgttcatggattcgctgaccgcgctcacctttccgcccctccgtgtctgaatacgtattcgctcaccaattcaccggaatagcatccgtgcgaggtgaagacgccggcacttcatacttctgcataaggaattcaccaatctccgcggtgacaggacccgccgtcaaaccgccgaagctgccttgggggtctttgagcaccacggtgatgacgaagcgtggattatccgcgggaatgatcgtcgagtaatcgctgatgatcgaggtcagtcggccgttcgctccggcgacttctgctgtgcctgatttcgccgccatacgatagccgtcgaccttcacgaaagtgttgtagtgttcagcggacgattccatggcgttgagcatctggctcgccacggattcgtcgatgacgcgtgtcgcctcgcccttggactgctgctcttcgacatgccccgcggtgtcggtgatggacttgatgatgcgttgcggctttttgacgcccttgttggctatcaccgaaaccgcgttggtcagctgcatgacgttcaccgtgtacccttgaccgaacagcacggtgttgcgggttcgcctgtcccagctatccgaggggtgcagcacgccttcggattcgcctggcaggttcagtcctgtggcctgtccgataccgaatttgctgatgaagttgtaccgctgctcgttggtcatcttgtctccggcaatgaccatgccaacgttcgacgactgttcgaggatgccggcgagcgtccaatgttcgttgccatggtccaccgcgtctttataggtctgtccttccacggtcaccgtgttcggtaccgtgaatttgtcatcgaccttgtgcaatcccagttgcagcatgcccgacatggccagcaccttgccgatggagccaggttcgaaggtctcgctcaccgcccgggaggcgcccatcttcgcctggtcgcttccggcctcggtcgtatcgctgtccgccaaagcgaggatgtcgcccgactgcacgtcctggaccatggcgatgccccaagcggaatggtatttgttttcgctgtcgctcagcactttctcggtgtaccactgcacatcccgatcgatggtgagggtgacgtcggatccgttgaccgcgtctttggattcggtcatggttccggggatttcgacgccgctgttgccctgttggtacacctggtagccgtcacggcccgtcaatgtcttgttttccatctgctcgatgccggccacgcccttgccgtcggcgtcgacaccacccaatagcgagcccatcaaagtgccgttggagtacagacgttcgttgcttagttccgcgtagacgatgccgccgaggttcagcttggagattttacgcttgaccgcaggcgtcacgtccttcttcaataccacgtattgcccgctgatcgacagtttggcgcccagttccgtggcgtccatgcccaatacgggggccagcagacgagccacggctgcggctcccgtcacgccgaccggcttgccgttgatctggtggcagttgctgccggtctgtttggtgcaggtggtcggtatgaacgcctgcgcctgttcggggttgccgatgatggtgtagcgttcgacactttgcgcgagaatcgcgccattggtatccatgatcttgccgcgtcgagccttcaacgtcacggtggtggtgcggctttgcgccgcggcctgcgccatccctttgccgttgaccagttgaatattggcaagttggataaggcaggtggtgcccatcagcgccagaacgacgccgatggccatggttttcgtcaacaggttcttgtggaagaacgtgtagatcctgcggatagggttcaccgggtcttgtctccacttgcgtttgcctgatagccgttcagatcgatggtcaatgcgcctttctgcgggaccatgcccatctcttcggccttgctcggcaatgaggcgtcaagttcgtcgagcttggcctgatcgtcctcgacgtcctgggtcagctgggtgatatgcgtttcgatttggctcgcctcgaaggaattctgcaccatttgggtacgcagcatcagtgagcccagcaggcatacaccaaggaacaccgcggcgatgaccaggtgcagcagcggcgtgctgcgggtccgcgtccatgtgatgagttgttcgaagccgtgacggatgccgttgccttcgactctgctccctttgatgacgtgcagttcgggacgcgtggtgccgatggtctcggtctggcttttgcggccggccggagccgcattcgaagcgatcgttcttggtgccgccacttcagtcccttcttccttgtctggtcatgcttgcgtaatccgcgccttggtcgaaccgtttgcgccatcgtgcgggaatcggtctggtcaattccaccgcgcgcaatctgacggacgccgatcgtggattgttggcgatttcctccgcgtccgccttgatggcgccgcgggtcagttccttgaagaacggcatcatgtcgggcggcaccacgggcatatccgccggagcgtcgaccttaagcccttggttcatgaaggctttgacggttttgtcttccaacgagtggtacgactccaccaccagacgtcctcccactgcaaggtggttggcgatttgcggcagcgtgccggcaagcttgtccagttcgccgttgacttcgatgcgcagcgcctggaagacgcgtttcgcggggttgccggcgggacggtgggcctgcggcacgacctcgtccaccaaacgattgagctggcccgacgtggtcagcggctcggtttcacgccggcgtacgatttcccgtgcgatctgcttggagaaccgctcctcgccgtatgtgcggaagatacgcaccaaatcggcgaacgaatattcggcgagcacctgctctgcggtcaggggctgcgtcacgtccatacgcatgtcgagcggcgcgtcatgggaataggagaagccacgttccgtctcatcgatctgcaggctggacaatccgaggtccatgaacaccgcgttgaccttgtcgacgccttggtcggaaagcacttgggagaagtcgtcgaatgccgcgtgcacgggcgtgaaacggtcggcaaggccatccatttccatgcgtttcgtggcgagcgcgagcgcctcggtgtcccggtcgatgccgatcaggcgggcgttggggcttgctttgaggaacgctgtggaatgcccggcgaggccgagggtgcaatccaccgcgatcgagccgggcttcgccaatgccggtgccaccaagtccacgcaatcgcggagcagcaccggctgatgaatcgtcgtcacgtctgtcattagaactccatcgccggcaatacgtcatcggcaatgtcggaatatccttgttccttgtcggccaagtaatcctcccatgcctgtctgttccaaatctcggcccgggttcccacgccgatcaccacaatgtcgctgtccagattcgcgtaatcgcggagcatctgcggcacaagcacgcgtccttgcttgtctggctcctggtcgaccgcgccggaaaggaacacacgcaggtagtcgcgtgccgccttgtttcccatggacgtgcgttggatctgcaccgcgatccgtctgaattccgattgcggcagcaggtagacgcatcgttcctggcctcttgccatcaccatgccggagcccagttggctgcggaacttcgcaggcaatgccatacgtcctttggcgtcgattttcggagtgtaggtgcccagcagcaatggcggcaagtccgccatcatgccgccggattgagccgggtcatcgtcggagacggattctgttccaatgtcatggaccattaccgcacctcctttttgcccacactcggcccaccaatccgagacactttccccactctaccccactgctcaccatttttccccacgaaaaagcaaaaatgcctcaaaatattgtcgatttctccccatatttgagattgcgcgtccgcaccgtacagttccgtcgctgtcagaccgtcgcgattcgccgcggtcactcgccgctcgtagaagccttggggtacattagagtgccttaagtttttgatgaagggacagcaatgtcgagttattccgcccagttgcgtgaggagcaacaggccgtcagccgcgcatatgatcgtctggacgcgttgagggcgcaggctcggtcgcgtctcgacacggtccgggccgcaggatcgcacggttcgcccacgcaacgcaccgaacgcgattccttcgccaccatgtacgaggaccgtctcacccagcttcgtgcggtggaggatcgcctggttttcggcaggctcgacgacgtgcatggcgcgcatcgctacattgggcgtatcggcctgtccgatgaggatcatgagccgattctcaccgactggcgtgccgacgcggcacgcccgttctatgaggcgacgccttcgaatcatggcgacatcgtcatgcgccggcatatcacgttgagtttccgggaagtggtcggcgtcgaggatgaggtgctcgacgtgcattccgatcaggtcggcgaggcgtcctccaatggcacattgaccggcgagggtgctctgcttgcgtcgcttaacgccaaacgcaccggcaagatgaccgatatcgtggccaccatccagggcgagcaggaccgtatcatccgtgcggacctcaaccaggcggtggtggtgcagggcggtccgggaaccggcaagaccgcggtcgcgttgcatcgcgcggcctacctgttgtatacgcatcgtcgcgcgttgcagcgttccggagtgctggtggtcggccccagctcgacgttcctgcattacatcgaccaggtgctcccctcgctgggtgagacgggtgtggtcagccgtaccatcgcggatctgattcccggcatcatcgccaccgcgcatgacgacccgtatgcggccaagctcaagggtgaacgccgtatggccaaggcgatcgccaatgccgtggcggctcgtgaacgcgtgccttcgcatctgccggtcatccgcatcaacggtttcaacgtgccgatggtacgtgcggatatcgagcaggccatcgccgatgccaagcgcacgcggcagccgcataacaaggcgcgcgagaccttcgtgcgcgacatgctgtcggccatgcgcaaccggtacgtcgaacggcttgactacgagccggagcaggccgagcttaacgatgtgatgcagcagttgcgtatgaacgacgatttgcgcaagacgctgaacctcgcatggctgccgatgaccggcgaatggctggtcgaccagctgttcgcgaaaccgcagcaattgcgccgtttcgccccctggctcgaagagcgtgacatcaagacgctgacgcgtccgaagggctcgcccttcaccgtcagcgacgtacctctgctggatgaggccatggaattgcttggaccggatccgaaggccgtggccaggcagaaggcgttggatgccaagcgcgccgaggaagagcagttcgccaaggacacgctggcgcaggccggtatcggttccggcatcgtcacttcgcagatgctggtggacaatatcaatggtatggacgccgaattaaccgcgcagcgcgccgcggccgaccgcgagtggacgtatggccatatcgtggtggatgaggcgcaggagctgaccgcgatggattggcgcatgctgatccgtcgttgtccgtcgcgctcgttcacgattgtgggcgacgtggcgcagacctccgcgttgggcggcacccggtcctggcgtcgcatgatggacccgctgttcggcgaacgcaactggcagctcaacgagttgacgatcaactaccgcaatccgaaggaggtgtcgcagctcgccagcgatttcgcctcgtccgaaggcctgtacatctccacggtgaacgccgtgcgtggcgtcccggattcagtcaagcgtctcaccttgcgtgacgatagcctgatcggcgacgccgtcgcgcagcagaccgtcgagttggtgcgcgcctacgtttcctccgacggtaccggtcgtgtggcgatcatcgcgccggacgatatgctcaagccgttgcgcgcacgcgtatacgcacaacttcaggatgagctcgacccgaaggaattcgacaggctcgatgcccagagttcctgggacgagcaggtcaccgtatgttccacacagaccgtgaagggtctggagtatgatgccgtgatggtggtccagcccggacgaatcgaggagaacgcgccgtcgcgtatcgtagcggcctccgatttgtatgtcgccatgacgaggcccacgcagcgtctgcttatactgcggacaaaagacgacgaaaagctgctcaagctataaggtaggaaccatgcctaaagcattgttacttgaaaacatccatcccgacgcggcgcagtcgctgcgcgaccatggcttcgaggtcgagtgcctcaagggagccctgagcgaggacgagctgattgatgcgttggaaggtgtcgacctgctcggcatccgttccaagaccagtgtgacccgcaaggtcatcgacgcgcgtccgacgctcaccgcggtcggctgcttctgcattggcaccaaccaggtggatctcgaatacgcgggcaagaacggcatcgccgtcttcaacgcgccgtattcgaatacccgttccgtggtggagctggtgatcggcgacatcatctgcctgatgcgccgcattcccgcgcacacccatcatatgaagcacggcatgtgggataagtccgcctccggctcccatgaggtccgaggcaagacgctcggcatcatcggctacggcaacatcggctcccagctttccgtcgtcgccgaggcgcttggcatgcgcgtgctgttctacgacattgaagagaagctcgccatgggcaacgcccaccgttgcgacacgctcaacgaattgctggaacagtccgatgtggtcacgcttcatgtggatggacgcaagtcgaacacgggattcttcggcgaagaccagttcgagcatatgaagcaggatgccatcttcatcaacctgtcccgtggtttcgtggcggatttggatgcgttgaagaagcatctggattccggccatctgtccggcgcggcggtggacgtgttcccaatcgaaccgaagaagaccggcgacgagttcctgaccgaccttgcggacgaggacaacatgatcctcaccccgcatatcggcggctccacgcttgaggcgcagaagtccatcggacagttcgtctcccagcgtcttgaggattattggttcaagggttccaccatgttgtcggtgaatctgccgcagatcaccctgtccgacatcaagtcgaatttccgcatcgcccacctgcatgcgaatcttccgggtgtgctggcacgcgtcaaccgtgtgctgggcgaggacggcatcaacatcgccgcccaggccttgggcacagaaggcgagatcggctatgtggtcaccgatgtggcgcagcgcccggaccagagggctctcgaccagctcgcctccatcgagggtacgatccgcatgcgcgtgatcagctgagcacgcaatacgaaacgttacgataatgcgggcggggttccaaccatcaggattggaaccccgcccgcattatatatgctgtatttgcttacggatgcgacacccgtctcacgccatcattcggaacttgcgcccttcagctcgtcgatggccctttggaagtcctccagattctcgaaattctggtagacgctggcgaagcgcatgtacgccaccatgtccaagtcacgcagcggcttgagaatcgccttgccgacctcatcagatttgacttgggccaatcctcgtgaacgaagatcctcctcgaccttctgccccagcatcttcagatcgtcctcgttgatgggacggccctggcatgccttgcgcacgccggaaatcaccttattgcggtcgaattgctcgacgtttccggaacgcttcacgaccaatagcatggtcgtctccaatgtggtgaatcgcttggagcatttcgggcattcgcgcctgcgacggatggagtgaccatcgtcgctaatacgggtatcgaccaccttggtgtctggattctggcaaaacgggcaatgcatgttgtccagaatagactgagcccttgaaataagccacgcttggcggcccctacgcctcatggggaacaatgaggcgctgccccgcatgcaaagacaccgtatcaaggttgttcagccgcatcagttcatccaccgtatctccgacattgccaccctccggagtgatgctcgccgcatacctccacaaggtgtcgccgggttgcaccgtatacacgacgacagcggtggaatccggcgcggactgcgcacttccgggcgcgatgaatccaaaaagacaccaggcaagaccggccgccatgatcgccatggcgattcgatttgccacatttccgatattcgccgcaccgttcaccacgccactccttttcgaacagctgttctatcgaacgcttgttccaagtatggcacatatgttcgataaacgcaaacacacctcgaacagatgtttgattttatcggcgtttcgcgttatgcttctaaggaactacgaaaggagcccatcgtgagcaccatccccttcacgcccaagaagagcgacgaacgtccggatgaaagcacgttgaccgaccgccagcgcaaggtgcttgacgccatcaaaacgcatttggccaagcagggattcgctccttcgttccgtgagattggtgaggccgcagggcttaaaagcccgtcatccgtcaaacaccagcttcaggttcttgacgaaaaaggcttcatccgcatgaacgcgaacaaggggagggccatcgaagtggtgaacctcaatgacgaggagccgaatggaaaagtcgcccaggtcatcccgttccccagtcaggacgatgcatgcggctccatcatggcctcgcatgacgttccactggtcgggcgcatcgccgccggcgtgccgatcacggccgagcagcatgtcgatgatgtgatgaggcttcccgaacggcttaccggcaccggcaatctgttcatgcttgaagtgcacggtgattccatgatcgacgccgccatttgcgatggtgatttcgtggtggtccgcgagcagaacagcgcggagaatggcgatatcgtcgccgcattgctggatgacgaggccacggtcaagacgttccgcaaggatcacggccatgtctggctgattccgcacaatccggcctactcccccatcgacggcacgcatgccgagatcatgggcaaggtcgtcaccgtgctgcgcaagatctgattgctttcacacgttaaacggcaaagggcgtcgaacataccattttgaggcatgtccgacgccctttgccataccctttgccataccgcgcggttgtgcattcaccttgcgaatccatcaagaatgaacgcgagggcatttcaaaatgtcgtcgcattcttgaagttcgggagcacggttcaggaatgcagttccttgcggctgtccgaatcgtatccttcaggttcaagctggaaggtggtgtgcggcacggatacggggaagtgctcacgcaggcagttctgcaattgggagaggatgtcggcggcatcatccatggtcagcccgcgctccactaccacatgggccatgacgacgggcatgccggtagagacggtgctggcgtgcaggtcgtgcacggccaccacgtgcggcacctgctcaagatgttcgcgcacctcgtccagatcgagttcctgtggggtttcctccagcagcacgcgcacggcgttgcgcagcagcacgaacgcccgggggatcatcatcaatgcgatgatgccgcccgcgacggcatcgaagccggcccagcccgttgagatcagcacgatggctgaaacgatcacggccacggaccccaatgcgtcgttcatgacttcgaggaacgcggctttcatgttcatgttgtcctcgctttgccccgcgaggatgaagatcgaaccgacgttggcggcaaggccgagtatgcccatgaacagcagcaaccgcacgtcgtgcacttcgtcggcggctccgccgaacagcctcatgccggcttcgacgagcgcgtagatgccgacgatcaggagcacgagcgcgccgaccgcggcggtgagcacttcgagtcgcgcccatccccaggtgcgtttgttgctaggtttgcgttgcatgagcaccgcggtgacggtggaggcgatcagcaccgacatgtcggtgagcatgtggccggcgtcgaccagcagcgccagcgatccggtgacgatggcgctgaccacttcggcgatgaacaccgtggaagtcagccccaatgacatcatgagtcttttctggtgttcggccccgcttgcggcggtcgtggcgtccacacccgcatggctgtgtgccatgatgggtttcctttcgtcgtctttggttcgatccgcggctattgaaaccgcttctcaataccattttcattcgtctcaaaacgcaggaaaccccagtccgaaggctggggtttccaagttctgctgacagtctagcggctcaccgctcccctgtcaataaagtcaaaccgtcaattaaaaaccgaactgggcggcggtttccttcagcgtctccgcggagcgcttcagggccgcgagctcacggtcggacaccggggtgttgatggcggtattgacgccggaacggttgagcagggtcggcacggacatgcacacgtcggagatgccgtggaagtcgtgcagcatggagctgactggcaggatgcggttggagtcgcgcatgacggcttcgatgatgtccacgccggacatgccgatggcgtagttggtagcgcccttgccgttgatgatcttgtaggcggcgttcttgacttcctggtggatctgctcacgcacttcggcgtccagcggatcgtggcccggcagcggggtccagtcgcacatcgggacgccgccgatggtggcggaggcccacagcgggacttcggaatcaccgtgttcgccggcgatgtaggcgtgcacgttcttgacgttgacgccggtctgctgcgcgatcaggaagcgcagacgggcggagtcgaggttggtgccggagccgaagacctggttggccggcaggccggagatcttctgggccacgtgggtggcgatgtcgaccgggttggtgatgagcatgtagatggcgttcggagcgaccttcacgaggcccggaatgatggccttgaggatgttgatggtggcaccgaccagctcgaggcgggactggcccggcttctggcgcgggcctgcggtgatgacgatcatgtcggcgtcacggcagatctccggatcgtcggagccatcgatggtcacggtcggatagaagctggagccgtgctgcatgtcgagcacttcggcctcgacgcgttccttggcgatgtcttcgagcacgatctcacgtgcgacgccacgctgagcagcagcgaaagcgagagtggagccgactgcgccggcaccgatgatagcgagctttgtgggcttgattggtgaatccaccatgtgctttacctctctttgagcaagaagaacgtcccgcgttgtggcagggtattttctttcgatttcaaccctactttatccatacagcatgacgtttcgccgtgaatccgcatgatttgcaaccactgaaaagtgattttcgtcacagcttttgtgagcgctcacatacactgcgcccgttgaaatgcagctgttgcaatccgttgcagcgtttgcacggccgctccggtaaacgtcatcgggaacggcttgcgcggaagctcagtcgatggcctgctccacgatctgcgcggccagctggtcgtcgacctccgcttcgagcatcatgccgtcgtcgcggtattcgacgttgatcaccttgccgtattcgcgcacgcgggacatgagcgagccggctgtgtacggcagcagcgcctcgacgtgcacgttcggcgtgggcagcatcgattccacgtgctcgcgcagtgcgtcgacgccctcccctgaaaacgcggagacgatgtgcgcttccggcatcagcgcctcgatacgttcgcgtgcggcctcgtccatacggtcggctttgttgaacgccacgatcgtggggatcgtctcgacgccgtcgatgtcggacagcacgtcgttgacggcgtcgatctgggagaacgggtcgggatgcgagccgtcgaccacgtgcacgatcaggtcggcgtcggcgacttcctccaacgtggatttgaacgcttcgatgagctgcgttggcaggcggcgcacgaaaccgacggtgtccacatacgcgtacagtcgcccgtccttggctttcgcacggcgtacggcggtatccaaagtggcgaacagcgcgttctccaccagttccgcggaaccggtcagccggttggtcaacgacgatttgccggcgttcgtatagccgaccacggcgacggtcggcaggccgaagcgacggcgcgcgccacgtttgacgtcacgcgcgggcgccatctgtgcgatctgccggcgtagtttggcgattctgctgcggatcacgcgacggtccatttcgattttcgtctcacccggaccacgcgagccgatgcccgcgtcgcctgccgcgcggccgcccgcctgacgcgacagcgacccgccccagccgcgcagtcgcggcagcatgtattcgagctgtgccagctccacctgcgccttgccttcgcgcgaagtcgcatgctgtgcgaagatgtcgaggatgacggcggtgcggtcgaccaccttcactttggtggcgtcttccaatgcgcgtcgttggctcggcggcagatcatcgtcgacgacgatggtgtccgcctcgtcctgcgccacgatgccggccagttcgcgcgccttgccggaacccacgtatgtggccgcatccggcttgatgcgatgctgcagcagaccgtcgcacaccacggcgcccgcggtttcggcgagcgcggcgagttctcggagcgattcctcggccgcggcctgcgtggtctcgcggctggaccatacgcctacgagcacgacgcgttcgagcctgactttacggtattcgacttcggtgacgtcctggatctcgcccagacccgccacatgcttcaatgcgttgcgggattcgcgttcctgccactgttcgtcgtgggtttcgcgaaagtgttccccgccgtcggtatcaagcagcacgtcggattggtcggcgagcactcccccgacgtcgcctgcggtcatgctctgctcgatatcgttctcttggctcaatggcacctctcacggttaaactatggtgtctttattatcatcattgtctagagacatgggcatcaccgttttcgccacgtggacgcgattaccgcgcggatgccggaggacgaacgtttgcaaggagagagcatggcacaggccgagcagtatttcgcggcggaaccgcagtcgaaggacgtgcgcaggaagctgcatgtcacgttgcgtggcaatgaggcggatgtggaagtgtcgaaaggcgtgttttccggcaatcgtgtggatttgggcacgtcggtgctgcttcgccaggcgccggaaccgccggaggagggcacgttccttgatctgggctgcggttggggtccgatcgcgctgacgttgggtttcgaatcgcccaaggccgatatctgggcgttggatgtgaacgaacgcgcgcttgagctcacgcgccgcaacgccgagttgaacggcatgggcaatatccatgccgtcaccgccgagcaggttccggccgttctcacgttcgatctgatctggtcgaatccgccgatccgcgtcggcaaggaggctctgcacgagctgctgatgacgtggctgccgcggcttaacgcgggcggtgccgcctatctggtggtgcagaggaatctgggttccgattcgctgattccgtggctcgccacgcagttgggcgacgggtttgaagtgggcaagtacgcgagttcgaaaggcttccgcgtcatcgaggttgtgagggcatgagattcgaatatccttccgaactgccggtttccgcggctcgcgacgaaatcgccgaagccgtcaagtcgagccaggtggtgatcgtctccggacagacgggttccggcaagaccacgcagctgccgaagatcctgcttgagctggggcgcggttcgcacggcaggcagatcgtgcacacgcagccgcgcaggcttgccgcacgtaccgtcgccgaacgaatcgccagcgaaatgggcgtgacgttgggtgaggaagtcggctatcaggtgcgtttcacggacgaaagctcgccgaagacgcgcctgcgcgtcgtgacggacggtattctgctggcgcagatccaacgcgatccgaagctcatgcagtacgacacgatcatcatcgacgaggcgcatgagcgcagtctgaacatcgatttcctgctcggctatctgacggcgctgctgcccaagcggcgcgacctgaagctcgtcatcacgtccgcgacaatcgattcggtgaagttccaggagcatttcgaacacgcgctgcatgcgaaggtgccggtcatcgaagtgtcgggacgcacgtatccgatgcaggtcgtgtatgagccgttgggcaccgcgccggcgctgatgcgttcggtgccgggtttcgaaacgggcgcgatgcccggcgacgcggattacgaggcgctgtcggccgcgccggatggcagggacggccgtgattcgcgcgacacgaacgtggacatgcccaccgcggtggcgcgcgcctgcgccgaattggtgatccattccacgcacgaccgtggtccgcgcgacattctcgtgttcgcttccggcgagcgcgacatccacgatttcgagaacgcgctgcgccgccattacggtccgcgcgcggcggatatgcgcaggccggatgcgatcgagatcgtgccgttgttcgcacggttgtcttcgaaggaacagcataaggtgttcgaaccgcatacgcatcagcgtattgtgatcgccacgaatgtcgccgaaacgtcgctgacggtgccgggcatccgctatgtggtcgatccgggcacggcgcgtatctcccgctattcgaagacggcgaaggtgcagcgtctgcctatcgagccgatcagccaggcgagcgcgaaccagcgttcgggccgttgcggccgtatcgccgacggcattgcgatccgcttgtattcgcgtgaggatttcgagacgcgtcccgaattcacggagccggagattctgcgcacgtccctgggcgcggtcgtgctgcacatgctgtcggtgggtgtggcgcgtacggcgaaggatgtgacggatttcggtttcatcgatccgccggatatgaaggccgtgtcggatggtttcaacgagctgaccgagctgaaggccgtggcgcgcaagcatggcgaggtggtgttgacgcataccggccgtctgctggcacgtattccgatcgacgtgcgtttgggccgtatggtcatcgaagccgcgaagtcgaccacgccgaacactctggcggcggtgctggtagtagtcgcgttcctgagcctgcaggatccgcgcgaacgtcccgacgagaaccgtgaggaggcggatcggatccacaaccggtatgcggacccgaccagtgatttcctgaccgcgttgaacctgtgggaccgcgtgttccaagcggatggcgagccgagcaattccgcgctgcgccgcatctgcaagaccgagtacttgagttggctgcgcatgcgccaatggaaggatttggtcgcccagctgcgcgaaatgtgccaggagttcaaattcaagcttggcgagccgattcccgtgtcccgtccaccgttggagatccgccagctgccgcttaaccagcaggcagcgcattcgctgtgctgctcatgggacgcgcagggcatccacacgtccatgctttccggcctgctgtccatgatgggcatgcaggtcacgcgcgagccgaaggcatccgatttcgctggtttgaagggtgcggcacgcgctcgtgcgatgaaacgcgcgcagaagatggcgaagaacgactatcagggcgcgcgcggcacgcatttcgccctgttccccgcctccgccgtagccaaatcgacaccgcaatgggtgatgagcaccgaactggtggagacaagccggctgtgggcgcggtattccgcgcagattgatcccgcatgggcggagccgctcgccggagcactcacccgtaccacgtacgcggatccgcactggtccggttcgcgcggctcggccgtggcgagcgcgaaggtgctcctgtacggcctgccgatcgtgcaggaccgcaccgtgcagtgggggcgcatcaatccgcttgaggcgcgcgatttcctcatccggcagggtctggtggagggcgacatccagcaacggttctcctatgatgatttcgtcaccaggaaccgggacatcctcgaggatgcagccgatgatgcgagccgcacccgccaggtggcgcagaccgtcggtgacgaggatctgttcgacttctacaacgccattatccccaacaccgtcaccagcgtggccgatttggcgaaatggtggaagacgaagcacgacgagcagcccgatctgctggatttcgatccggacaaggtggagcgtctcgccggctccgattcggtgtccctggacgactatcccgaccattggcatacgctcggcaccgacggctcccccatcgatctaaggttgagctacatctacgacccgcacgacccaaacgacggcgtcaccgtgcatgtgccgttgaaagcattgtctcgactgactccggaacagttctcgtggaatgtgccgggattgttggacgagctgatcgtcggcatgatcaagtcgctgccgaaaacgttgcgcgtgcagttcgtgcccgctccggacacggcacgcaaaatccgcgcctggatcgacaaacgctatcccgacctgccgggctccggcagccagcaaaagcctgacatcgcccccgaaaacgaggatggcatggccgcatggcccgacctgccgcacgtgttcacgcaggcggccatcagtatcgtcggcgcgcaaatccacccggaagtcctcaccggcgaactatggaacaagctcgcgccatacctgcgcatgaccttcgccgtggaacagcagctgccgcccaaccgcaagaaccagcacggccgacgacacgcgcgaggacccgtcaaaacgctcggcaccggcaaatcactcgtcgaactgcaacgcagattcgccgaacaagccaaagcctccgcacgccacatggtcgaaaaacaagcccgaaacgcaggagaccaaggcaagttcgtcgaacaagccaacctgctcaacaaagcgggagcgaccaccgaagcacgcgccaccatgctctggcaaggcgcgctcgacacgctgcgcctgcccggtgaacgcatctcctcacgctggctcggcacggaagcgctcatgctcgcctctgccccctacaagtccacgaaggagctcaccgaagacctgcagctggcagccgtcaaacggctcctgcccaacatcgaccagctgcccgacgacgaagcgctcgccgacgcagtgctcgatgtgcgcgaagtgtacgaggacaccgtgtacgcggtggcgcatgacgtgatcgccatactgaaacggtatgcggaagtcgacaaagccgtgtccggcaaagcggacctgccactgctgagcgtgctgcagtcgatccgcgaacacatcgccacactcgtataccccggtttcatcggcaagacgccgccagaggcattgccgtccatcgaacgatacctgcacgccgacctgctgcgcctcaccaaggcgaaaaacgacaagaaccgcgacgtgcgatgggcttgggaagccaacgaagccaaacaacttgccgacaaggccgtggcgaaagcacaacgtgaaccagccggcccacgccacgaaacgctgatgaagcaggcggaaaccgtacgttggatgctggaggaattctacgtgtccctgtgggcacaggaactcggcacgccgaaaccgatcagcctgcaacgcatcaaaaaggcgatcgcctagccaccagccaaaaccccaacggattgttccgtttcttcaaacccgtcaacgcttcttgaagaaacggaacaactgcgattcacgaatcaacaaccccaccaatagactcgccaccatgacaccggcgaacacagccaacggcgtgcgcaccgcagccgccaacaccgccacccaatcggaccggctcatccgcaccgcatacgccaacaacaacgcacacgaagcaaacgtagccagcccggcccaaacaccggtctccacaccaatacccagcaactgcgcacccttcgactgccccgaatgcaacgcacccgcatactccaacctacgccggcgcacaccaaacacaccaaccaacacgccaatcgccaaccccacccacggcatccaccgcgtcgaacgattcagatacgacgcacgcgcgtcataatgcgcatcaaaccccttattcacctgcgtcacacccgcattcgacgagccggaacccgccaccaacgtggcatacagcagattttccatctgtccatcggccggccaccgcttgacccaacattcgttgaacgtcgaggcgctcgccgacaccggcacgatgaacgcgtaggcgaaacgcgtgtcacgcccatcgttcggccagtcgaacacaccagccacacgtgtggtgccttcgcgtgtccgcaatgcgctgcccacggcgagcccgaagtccttggccacgtcgcgcggcacccatacgccggacacgtcggccttggcattgccggcgatcagccggatcataccaggcgtcacgtcatacgatgagatgtccttgccgggtgtcgcgagtggcacgacctgttcgccggcacgcatcgcaccagccaaggttcccgtcattccatcgccggcgtcggacaaccggtcgcatgcggtgccatccaccgttccaccgacgatggcgttgacgtcaacgtacgcgttgatgcgctgcacggcctgcgattccaagtcaatcacggtcatcgcctcatatccgcccagcagcgttccggagagcagcactgcgaggaacatggcgaacgcgcggctcacgcccgaaccgatgttgcgcagcgcttcggaaagcaccgatccaagtctcatatacgctcccttatcggcggtttcatgcggttttcacactgtttggcgaagctcaacggtttcttgcgattcatccgccgactatttgcaaaccagcccgttgagcccgctgccgatttcgacgttggcgatcgcggacacgtcggcatcctgcgtctgcaccagactcacgcccagctcgctgcccacaatcgtcaccttcgccggcgtattagacgcattgtgggattttggtacgatgcagccgctgctgccgtcgatgccaaacaccgctcccgccggcacacgcagcacctgtaatggttccttcaatgccacggtggcatcgagaccggcctttttggtctgcatgtccatggactggaacgtctcgcttgccgacacattacgcaggaattcggcgtcggtgatttccgtgctatcggccggcaatattccattgacgccatacatgcttatggtgcgatcctgtcctaccgccgcgccgtttttcacggtgagtttcgtcaacgctcccggtatttttccgattgccgtaccgcccgtcaccatggaaccggtggtggccgtccactcgtcgaccgcgactgcgttttcaggaatccacatggtgtcggcaagcgcaagcgtgccgtcggaggggttgccgttgtcgttcatgagttgccgccagccgtcggatgttgcccaccagtaggtgtcggaaccggccacgctgttgtatccgagtcggctcagctcgttgttcagtgcgagcacgtcgtcgcccttgtctccggttttgaggtcacggtataggggtgtggcagtgttcaaggccacgaccacgcggtcgttgactttgtatgcgcctttgccggaggcgagtccgtctgcggaccagtcggcggtgacggtgccgttggcgttgccgagaagattacgttcggtggagatagtgggcacaaccgtcacttgctggctgccggagtattcctgcacgctggctggcgcggtggtcgtctcccctgccgagccgagcaatgccggcgcgcgatccggcaggagcagcgcgcatgctcccacggacacgcagatggcggttgccacggcgagcaggctccaagcccatgcgagtcgtccgcgtccggcaccgttcgtcacggctgtggcgttatgtttctttcccatgagtcgatgcctttctattcgtctattcttccaattccggttcctgcgatttgctgccgcctggcgcgtagtcggcgaggtcgagcacacggtcgcaggcgtcgcgggtgtcgggatcgtgtgtggccacgagcacgatcatgccttggccggaaaggttgttcagcacatggctgacggaatgcgcggtgcgcgtatccaattgagcggtcggctcgtccacgagcagcatgtcgggtttggagcagacggcgcgtgccagcatgagacgttgcgcctcgccgccggagaggtcggagaaccggcggtcggccgcgtattcgaggtcgaacagccccatggcttccaaggctttgagctccgcttccttgcgccgcatgcctttggcgagcagcgggaacaccacgtggtcgagcgcggtgcgttccgccacaccgtacgggttttgaaacacccatcccacacggttcacgccttcacgggttacggttccggcatatggtttctcccaaccggcgagaatcgacagcaatgtcgatttaccacaaccggatggtccgcataccgcgatggtggagccaggttccgccacgaaatcaagatgctcgaacagcaggtctgtccccgggaaccggtgggccagcccttccacaaccactcgcatatgagccccttcgcgcatcagactacttcagcggataccagaccgtctcatccgaggcggtcacgttcactccggccgtcaccaagcaggtcagcgccttcctgttatcgcgcagtcctgcgctttctccggattccaaatccttctccagcttatcggcggtgtagtctttgggctttatgccttccttgcgcagacagtcggccgccacctccttgtcattgagcagcagcttcggattgcccaactggagcctgtacacggtgttgatatccgtgacatgcagcatactgcaggatgtcagatcgtcattgagtttgcggatcgcctctttgctggcaccatcggtgttgtacgagggcagagcgtaaatgccgttgtcgtacttgtcgaacgtcggctcggcatagcctttgtctatgatgcactgcttgtaatccgcccatgcgcgttcgtagtcggcctgactcacctttccgcccgaagcggccttctccagtgcagacttctgctgatcggatattttgccgccgtcggaatccaacaacgatcgcgcataatccttcagcgacgacgcgattcgttcaccctgttgcgatgattgaccctgctgggattgacgctcccgtcgcgagctttctttcagtgccccgcagcccgtgcagccgacaagcaaagcgagacagcatatgacggcaatagctttgccacgcatgcccgttttcctcgacatcgtcatcagccccctcacaaacgacgcagccgtcaggccgccatggcccgctttacccctattctatacccccaagacttgcctccatgcgcggcatacccaatatgggtatgtggaaccaggtgttccccagcatcatccaccggctcgttgcatttaccccgttctccgcgccggaaagccatcagtcaaacggaatgcgcgcgtggaacatccatatgccgttctcgcaatcggtggaaagacttcctccgatatgctcgatttcagccgcgaactgtctgagaccatggccgccgggcaggctgccggaatgccaggcacccatatcattcacttcagtgatttccaaggaatcgtcttcaccagaaccgacacctcgtacttgcctccggaaggcacatgacgcgaaacgttcgcgtacacctcgccaatcaaccggccgatcacatccttatgataggcatacggacgcgcgcacgggaccagaaataggcgagaccggtcagcataatctgcatgacggtaaacatcaatgccattggcgaaccggggtggcacaccgcctcatagaccatcagaagttcgcacgtcatgatggccgcaagacggaacggatgtttgattcgcggcatatccgacaaccggaacgctccgttcttttcggtcatgtcagcgcccgttcccacgtttcagccatgtgatgatggcttgccgttgcgtacggcagttcagtcgtttgacgatgttctgcatgtgcttgcgcacggtggcaatggatatgccgagccgttcggctatctctccatccgtcagatactcgttcgcgcacagattcatgatggtttcctgcatgttggtgagcgtggactccgcttgagtatcgcatttcagcttcgcataagccgccatcggagtttcaaaaccgggcaggaaacatcctgaaaggacacgggagacggcttgttcgagctgcatctcgtcacccttaccgacacagccgccgccagcggcacgcgataccggttcagactgaagctggtcatgccgagaatcggcgtggaacagtccatcaaccgcatgcgacgacagacttccgggccttgcataccttccaacgacatatcaagcagcacaagagcatattggtcggcattcgatgcaaacaattccaaagcctcaacgccgctggtagccgaatcgacgatactcaccgccggaagaatccgcttgaataggtcagtcagcgcttcgacgacgattttgtcatcgtcaacaagcaatatcttcggaccaccaaccgttttccccgtcatggtacaacgctccttcccctgggaaacatccccctaccgcaatacaatacatcatttcatcaccgccccttactcatattgagtacatcgttcgcaataaccccgtaaaacaactcatatcatatgaatcaccgggccaaggcggttcgatatgatgatgaaaggtggacgatgatgtcctggatgaaacacaataaattgatgaaaacgctctccgcatcagtactggctgtcggaatatgctatggaacactaccaatactcgtgaggctctcctagattgtcaaagatacaaacaaagcagaggtatatgacaaacttttcgatgagttgccgctgcatggccatcggtctgacggtagtatcacttttgtccggatgctcaagacaagtctccgatacagcatcatctcccgaaggcggtggaactacttcttccgaaccgatcaagcaatatatagcatcggtgatcaaagacaatgacgatcctcgcgcgacgtatccgatgaccaaagcccaacgggagattctcaaacgttcggaagcggctggaggcgtgtcctctaccgattacgaactcgcttggtcccattacaaacaatgcgtggtcgacaaaggatattcaaccccagtacttgaccgttatcccaatggcctgtatttcgtcgccagaataaacgccgagggcatgaccgacgaacaacgaaacaaattcaacaaagacgatggcgtttgtttcaacacggaagtgatctacatcaatgacacatatgccctccaattgggcaatccgcaaatgatcaacgatgtcaatcaagcggccgtcaattgcttgaagagggagaatgtggcaccgaaaggctatacgaagaaactgttcgagcaagacgagaaaaaccgcttgcaggacgagcacactgagctgaattactcggatcccaaagtccaaagctgtctggccgcgctcggcatcaccactatggaaagcgataaggtgtggagacctgcgaaaacttccagctaaggcaatacaaaaaacaaacaacgaaaccccatcaaggctcgtctatcacgagaaaggagatggcgatgatgcaactgaatatgggtacatggcgaggaagcgtagccatcgtatgcttcctcgccatgcttatcggctgcacgggttgtgggacggtcggcgatcggcaggatacgcaacagcagactgaaagtgccggcagtgacgcttccaagaccaaaatcgcgaattcgataccggattacatcgattttcttcttgatttggacgccaaacccgataccaagtatcccatgagcgacgctcagaagacgattctgaaacgttccaggaagtcgggaagcgtatcgaaaccggattacgagcttgcctggtcgaattacaagcagtgcgtgaccggctatgggtatacgacaccggtgctcaggcagttctccaatggcctgtacatgatcgccatgcgggataccaccggcatgagcgaccaacagcgcaagaagttcaacgaggatgagaacaaatgctataacactgaagtcattgcggtgaccggtgtataccagatgcagatcggcaatcccggcatgctttccgatggcgaccaagccatggtcgattgccttcataaggccggtatcgtgccgaaaaactacgacaaggaagcgtacaagaaggatttggacgcgcacgccaaaaaccagcccaccacagtggatttctcaaacgcggaaatgcaaagctgttgggtggcgaacggcgcgtcgttcggggacgtcaatgacaccgatcagtggaagccgctcggctgaccaccgtgttccccgtcatatatcagcatagaagtctcgttcctgcgcgacgaacgggcgcaggaacgtggtgatggcgatggcgcataccaggaacagcgcgccgacggggccgagccacatcagtccgaaatggccgttgattagacctccgaccgcggaaccaagcgcgatgccgatgttgaacgacatggagttgagcgacgcggccaggttcaacgatccgggatgcgactgcgaggcgacgtccatatacagcacttgggacgcggaattttgcaggtacatgaacatgccgagcaccaccagcagcagcgcgccgtataccggtacccaatgcgccacgacaagcgacgccatgagcaccgcatgggcgcagtagatgggacggatgtgcgtcagcggctccactcccctgccccggtccgcgagcttgccgccatacaggttgctccacaggcaggccgcgccgaaaaacaccagtccgacactcaagtactgttcaggcacatgcacttcatcgcgcatgatcggagtcaggtatgtgtagaacacgtagctggcggccgcgccgcacaccacgtcgagcacgcccaactggatgcggcggtcgaagaacaggcggaactgcggcaggaatccgatcttcacgatgtggctgttgcgcggcagcgccacgaccataccgacgatgagcataatggtgagcacattgatcatatggaacgcccaacgccaaccgaacgtgttggccacccatgtgccgaccggcacgcccaccacggatgcgatggagaagccggagaacacccatgcgatgaatttcgtacggaatctgtccgttgtcacatcgggcgcgtacgtcatggccacagccaccaacgttccggataccaaggcgatcatgatgcgcgccaccaccagaaccgcgtagttgggcgcgaacgcgcataggatgttgcctgcgaggaatatgccgatcagcgtcagatgcgtagcgaatcgcgggaaccgtgccgacagcgcggatccgagcggcgtgacgggcgcgtacacgaaggcgaacagggacaccagattgccgaccgtcacctccgatatcttcagatcggctgcgatgtcgggcaggatgcccaccacgatgaattcactcatgccaagcatgaaactcgatgcgatgagaatcaccaccggcagattgaagaaccgttccttgtcgattcgcacttttccgctctccgcttccgttcgcattcccctattcgtttcccgatatttcgatttgtttagcatcgcttacgtcaatcgattgacgatttactttcttcaggaaaggataaaccgcgcgcgatacaatacggtaccgatgacacgcaagatgacacgcaaaaccaatcggagcggaaacagcggcgggaaaaccggcggaaacaggtcacgcaaccgcaaaacaagcaatcgcaagacgggcaaccgcaaatcccttgttccaaagaatctgcgcagaaaactgcgcaatacatggaacaaggcgagcctcaagcaacgcatcggcatgatcgccactacattggtggcgacggtcgcggcgatagccatcattgcgggcctaatccgctttgtcggctggcgtgtgcaggtcagtgaggcgaaagcggcgcagagcgagatgcgatcgctgtacgatttcaacccgggcaacatcatatccgacggcgcgttcttcaacggcaacgcgttaagcgagcggcaggtgcagaccatcctcgaccagcagggcgcgacgtgcaccggcgacaagtgtctgaagaccatgacgttcaccacgcaatcgcaagcggcggacgaatattgccaagcgtataagggcggacagaacgaaagcgcggcagccatcatctataaggcgggcaacgcatgcggcatcagccagaaggtgctgctcaccgtactgcagaaggagcagcatctgctcaccgccaccgatccaagcgattttcaattcaaatctgcaatgggcctgagctgtccggacgacgcgaactgcgatgcgaaatacgccggattcttcaaccaggtgtacggggcggcgaagcgataccagtactacgtgcgccacgaatcgcaatacgcgtaccatgccggcgctctcaactacgtacgatacaatccgaacgcaggctgcggcggcagcgacgtctacatcgagaacaaggcgaccgcgctgctgtacatctacacgccctaccagccgaacgaggccgcgctgaaggccggcgcaggcgaaggcgacgcgtgctcgacgtacggcaaccgcaatttcgcgatcatctacaattcgatgttcggcaatccacgagactgatatttcggaaaaattccggtagaatacctctaggaaggaatgaaccgaaggagcctcatgggcctgctcaacaatgacaactacatcgacccattcaagggagccgattacatcgaccccggcaaaaacgccgaaaaactatccagcaacgtggaccgcgagcatgcacaacgcgaagcatacgaacagcagcgctacgccaaacaacagcagacaccccaacgcacccccacacccccacaggagccccgtcacacaccacaacaggcgctcgtcaaccgacagacaccaatcagccgaacgacacgcacaagaaaatcaagaataccgataatcatcatcgccatcgcagtgctgacgatcatcgcgatgaacctcgtcggcacaatcgtcagccacggcggactggactcaatagcggacagacttgatccgaacaccgaaaaatatgagcagctctccgaacagaagaccatcaacgaaaccagcggcaatctgtactcatacggtgggatggcgctcaccgtcaccatcaagaacatggaagtcggaccaactgacatcaacggacagccgacggtgaaagtgacctatggatgcaggaatctgagccggcgcgcgatttaccccaacgccgtggccgattccatcgtcacacagaacggcatagagttacgaaaagcggtggtgacgggatacaacgggaatcttgatctggccagcaagaaaatcaaatcaggtgaaacatccgaaaaagtcagctatcatgtactttccgacatgcagactcccatcgccatgcaggtaagcaatttcagacacaagaatctggttcgttccgcgttcgccttcgatggcagcaacgagacactgaccagaatcgactattccgacgtgccggaagcaccgaaggtcgataaagcggcgttcgtcgaagacggacgcgttgaagaattgaacggtaccatacttcatttccgattggactctcttgagatacagcagaatgatgaagacgaaccacttatggtggcccgcatttcctggtaccttgagaacacttccacgtatgaaacattctcataccatgcgagcgtcaatgcacgacagggaaccgagacgcttgaccaggattatctgtacggcgacgactctagcttgattctcagagcccaagcggatgtgctggccacctctatctacgcttatgagctggatgatgagcggacctctgtgaagctcaccattgaaggcgatgacaccgtactgttcgagaaggatttcgaacccagcagtggcactgtggtgtagtcgacgcggcttccatctcaacaagaagcctaatcccagctccgcataaacgacaccgaaggggccgtcatctggaaatcaacccggatgacggccccttcgatgtcgtttatgcactaacctgcgattacgcaatcacagcttcggcagatacttcttcagctcgaacggggtgacctgcttgcggtactcatcccattcctgatgcttgttgcgcaggaagtattcgaacgcatgctcgccgaggacgctcgcgacgaaatcggatttctccatgatcttcagcgcctcatcaagcgattccggcaacggctggatgcccatggcctgacgctcggcgtcggtgagctcccacacgtcgtcgctggtgggctcgcccagctgcatttgcttgtcgatgccgtcgagaccggctgcgagcagcacggaatacgcgaggtacggattggcgaccgggtccaacgcgcggaattccatacgggcggagttgcccttacctggcttgtactgcgggatgcgcagcaacgcggaacggttgttatggccccagcagatgtagctcggcgcttcggcaccgccccacagcctcttgtaggagttgacgtactggtcggtgaccgcgcagatctcggccgcgtggtacaggatgccggcggcaaactgacgtgcggtgacggacatattgaattcctggccggcctcgtagaacgcgttggcgtcaccttcgaacaggctcaagtgcgtgtgcatgccggagcccggagcgtcggcgagaggcttcggcatgaagctggcatggatgcctcgctccagcgaaatctccttgacgacggtgcggaaggtcatgatgttgtcggccgtggtgagcgcgtccgcatatcgcagatcgatctcgttctggcctggccccgcctcgtggtgcgagtactccaccgagatgcccatctgctcgagcatgttgacggtggcgcggcggaagtccatgccggggctgcgcggcacatggtcgaagtagccgccctcatcgatcggcttcggagtctgcgcccagtcatcctgcttttcaaacagatagaattcaatctccggatgcacgtagaaggtgaaacccttctccttggccttggccagcgcttgcttgagcacgtggcgcgggtcacccaaggacggctcaccatcaggcgtgagcacgtcgcagaacatgcgcgcggtgccctgcgggcctccgcgccacggaagaatctggaacgtcgacggatcgggcttgacgatcatatcgtcttcggacacgcgggtgaggccttccacggcggaaccgtcgaatccgagcccttcctcgaatgcggcttccagttccgccggcgcgatggccacggacttcagtgttcccaacacatccgtgaaccatagacgaatgaagcgcacgtcgcgttcctcgaccgtgcgcaaagcaaactcttgctgtttatccatagtgtccaatcgttccatgcgcatgttacgaacgtcgttaacacatgccgtgtcgcgacatgtcagcgtgcgacttcgagggcttcctccagcgtgaaggcgcgcgcgtacagcgatttgccgagaatcgcggcgtccacgcccagttcggcgagctccttgatgttgcgcaggtcgtcgagcttggagatgccaccggatgcggtgaccttcgcgtcggtgcgggacgccacttcgcgcagcagctcgatgttcgggccgctcatcatgccgtcgcgtgccacgtcggtgaccacgtaacgggagcagccgacggagtcgaggaacttcatggtctcgaacaggtcaccaccttccttcacccagccgcgggccgcgagggtgtggccgcgcacgtcaaggccgacggccacgcggtcgccgtacttcttgatgacggaagcggtccagtcggggttctccagagccgcggtgccgatgttcacgcgggccgcgccggcttcgagcgccgcgtcgagcgaggcgtcgtcgcgcacgccgccggacatttcgatgttgaccttgtcgcccagttccttgacgatggcgcgcagctggtcacggttgttgccggtgccgaatgcggcgtcgagatcgacgaggtggatccattccgcacccgattccacccacgtgcgggcggcttccagcggggagccgtagtcggtttcggagccggattcgccttggcgcaggcgcacggccttgccatcacggacgtcgacggcgggaagcagcgtcaaagacatgtcatacctttcgttgcgttgaacggttttcggccgttcaacggatcttgcgattaccgatttgaattcacgattttgcgattgttgcgattgccttgcgcgaatccgcgttcagaacgtcgcgacccagttacgcagcagctgcgcgccggcttcggcggatttctccggatggaactgcgtggcgaacaacggtccacgttcgtaggcggccacgaatcggctgcgcccgtaggtgcaccacgtcacatgctcttccgcgtcgccgaagtccagctggtcggcggaggtgtcggcaggcgaagcgctcatcgcggcaaaggagtgcacgaaatagaatcgttcgttctccacgcccttgagcagcacggaaccttccggcgcttcgacggtgtcccaacccatgtgcggcaccacgtcggcgtcgagcagctcgacatcgcccttgatcagaccgagaccgggcgtgccgtctccatgttccatgccacgttcgaacatgatctgctcgcccacgcagacgccgagcaccgggcggccggcgcgcagacggtctttgatgaccctgtctccgccgacgcttttcagtccttccatgcatgcgccgaacgcgcccacacccggcaccaccagtccgtcggcttccagagcctgacgatggtcggacgtgagggtcacgtcgaggtcgagattggccagcgcgcgcaccatggaacgcacgttgccgaaaccgtaatcgaacaccaccacggaagtcatgggcgctctccttcttttgcttgccgaagaatccatccttcggggaaaaacttattcgatgcttgacgaaccacgaccgaatcgcgtgtgctcggcgaggatcttcatggcgtcatcacgggtcaggcttgcggaatcgacggtttccacgccggaatcacgcaccccctgaacgtcggtgatgcccagcagcaggtcttcgacgaacggcgcggtggaggtgaacagcaccggtggcgcgaacgtctggccgaccttgccttgcaggtacatcgtcgcctcgagcttgtccgcacggttgatcgcgaggacggcaggcatgccggagaccacggtggtcagatctttgatggccgcttccgggccatcgccgtcgagattgcgtaatacagcgaccgcgccttgcggtgaggcgaggcattgcgcggagatgtcggacagttggcagaacgcggcgaacaggcgtgcggaggcaagtcgggtgatgatcaccgcgactttcgcacggttgcccagcagtccctgcaactcgtcgtcgaatgacagcgagttctcggcttcggacagtaccgcgtcggcttccttcgattgcaggccgtcctgcgattcgtcggaagacgcatcggaattaaccgtctcatccggctgatcgaatggcacctgcgcgggagcatcgttctgttgggcagcttcctcgtcctggaattccttttcgaagccggccatggccgcttccagctcctcttcgctgaaatgcatgccgtcgtcgttggtcttccccaagccgtcgaaaccgttcaaatcgtccttgtcgtcggacatcacagcgcgcccttcgtgctgggaatgccgtcgacgcgcggatcgggttcgatggcgaaacgcaatgcgcgggccaaagccttgaattcggcttcggcgatgtggtgcgggtcgcggccggaaatcacgtgcaggtgcaggcagatgccggcatgcatggcgatggattccatgacgtggcgaacgagcgaaccggtaaaatgcccgccaatcatgcagtattcgaagccttccggctctccggtgcacacgcagtacgggcggccggaaatgtcgacgacggctttggcgagtgcctcgtcgagcggcacggtggcgtcggcgaaacggcggatgccacgcttgtctccgagggcctgcttcagagcctcgccgaatacgatggcgatgtcttcgacggtgtggtgcgcgtcgatgtcggtgtccccggtggctttgattttcaggtcgatcagcgaatgcttgccgagcgccgtcatcatgtgattgtagaacggcacggatgtgtcgatgtcggttttgccggttccgtcgaggttgagactcagctccaccttggattcgctggtttcacgaacgatggttgcagtacgtgccatgttgcgactccttttgcgatgttgcagttgcgatattacagctacgatattgcgattgcggtggttgcgtcttccgcagccaccgcgattctgttctgtttcaagcttattgccgaatactgtcacgaacttccgttccggacagtatcccagcttgcgttccggcttgttcagccctgttccacgatgcgcagcacttcgaccaacgcctcacggaaccgtgccatttcctcgtcggtgcccatgcacactcgcatccagccttccggaccgacgacgcggatgagcacgccgcgcttcaacagttcgtcgaagatgcggtcgcggtcgtcgaaatggccgccgaagagaatgaagttcgactgggtttcggccacttcgagcggctggcccttgtaggtctgctccttgagccatgcggaggtggcgttgcgggtttcgcgcaggtgcgccacgcggctcagctgttcgtcggtgtgttcgaacgcggcgagggcggcggcctgggtgacggcagacaggtggtacggcatgcgcacgatgcgcacgcagtcgatgatgcccttgttggcggccaggtagccgacgcgtgcgccggcgaaggcgaacgccttgctcatggtgcggctgacggcgaggttttcgtattcgccgatgagttccagcgcggtgggcgtgcccggatctcggaattcgatgtacgcctcgtccaccacgaccaccggatgcacgccttcggcggcgcctgccacttcggcggtacgggcggcttcgagcacgcgcttcagatcttccggcttgagcggggtgccggtcggattgttcgggctggtgagcacgatcatggccggcttgacctcttcgatcgccttgatggtggcgtccacgtcaagcgtgaagtcggcgttacgatgcgcaagcttccacgtggtgaacgtgtcgcgcgcgtattccggatacatggagtacgtcggatcgcagccgagcgcgatgcggccggggccgccgaacgcctggaacagctgcagcatgatctcgttggagccgttggcgccccacaactggtcgacgctgagcttcacgcccgattcgcgttccagatatgtggagaacgccttgcgcagttcgatgtgctcgcggtccggataacggttgagcgtcggggcgatctccttgacacgctgggcgatggtttccaccacggccggttcgggcgcgtacggattctcgttgacgttgaggcacaccggcacgtcgagctgcggcgcgccgtacggttcttcgccgatcaggtcgttgcgcagcggcagatatgccggaatcgcgttgctggaagtctcgctcatcggaggccggcctgctcttcctgttccttgatggtcgccttgttgtacgggtcgtcgatgaagcggctcagcacgcattcgccgtgtgccggcagatcttcggagacggcgaaggcgttcacacgggcggcgagggtcttcagtccctgctcgtcgtattcgatgacttcgaccggcttcatgaaggtgtgcacgccgaggccggcggcgaagcgcgcggtgccggaggtcggcagcacgtggttggaaccggacatgtagtcgcccagcggaaccggggagtacgggccacggaagatggcgccggcgttgcggatcttggcgatcacggcatccggatcagcggtctgcacttcaaggtgttcggccgcgtacgcgttggccgcgtcgatggactgttcgatgccgtctgtgaggatgatgccggactggcggccgcgcagcgacgtgttgacgcgctcggcgtgctcggtgcgaggcacgcggtacttgaggctctcctgcaccttgtcggcgatgtcttcgctgtcggtgataagcacggaaccggcgagctcgtcatgttcagcctggccgatcagatcggcggcgagccagcttgggttggcacccttgtcggcgatgatggcgatttcggtcggaccggcgacggcgtcgatgccgacgatgccggagaccatgcgcttggcggtggcgacgaagatgttgcccgggccggtgatcttgtccaccggatcgcacagaatctcgccgtcctgcggttcggagcccttggcgccgtaagcgaacatggcgatggcctgagcgccgccgaccgcgtacacctcgtccacgccgaggatggcgcaggtggcgaggatggtcttgtccggcaggccgtcggagttgctgcggctcggcggggtggcgatggccagcgattcgacgcctgcggcctgcgccggcaccacgttcatgatgacggagctcgggtagacggccttgcctcccggcacgtacaggccgacgcgctgcaccggaatccaacgttcggcgacgcgcgcgccttcggccaggtcggtgtggaacggggccggcacctgggatgcggatacggcgcggcagcggcgcacggattcctcgatggcggcgcgcacttccggatcgagctcgtcgacggcggccttcatggcctcgaccggcacacgcagatgctcgggacggatatggtcgaacttctccgcgaagtcgcgcagggccgcagcgccgcgggccttcacatcatcgagaatcggctgtacgagctcagtggcctcgttggtgcccatctcggcgcggggcatggcttccagcatttcagctcgagtcagcttcttgccgcgcaggtcaatgattcgcatatagttttcttcgctcataacgccccatggtaacaacgccaagtcacgagaacgtcccgtcgtctcacattcagccgcattgtgagacacgcagatccgccgttttccatgccatgccgatttccgcgaaaaatatatgccggtcgacgccattcagcatcggccggcaatcaaaaacctgttcaggtcaaaccgttcaagtcaaaccgctcaggccaacggaagcgagctcggtccgaagagaatcttgatttcggcgaacagcgacgtgtcgcgtttgacgcggaaccggtctccgaacgtcagcaccttggcgttgcctttgtcgtccatcaacgccagtttcacctcgcacgggccgggatggctggtcagaatctgcccgagccgccgcacatgcgactggtcgagcgcgatcggcggcagcacaatcgtcagcggacgttcatcctgcgcctccaacgtcggcacggtgaattcggtggcgcgcatgctcactgtctcatcgcgcttctccacctggccgcggatctgtaccacggtgtcgacggcaagctcgggcgcggcggcctcgtacaccttgccgaagaacatgcattggatggaactttccagatcctcgacggttacgatggcccacggattgccctttttcgacacgcggcggtccacgttcgtgatcaggcccgcgatcgtcacctgctggccgtccggcatgcttcccgcgcggtcgatcaggtgcgctatcgacatttcgcgcaacgacaccagaatcgactgcatgccgctcaacggatggtcggacacgtacaggccaagcatctcacgttcgaagttgagcttggttttcttgtcccactcctccacgtcgggcacctgcaccatggcgtctcccatggcggaatcgttctctttggaatcgtccaggtcggcgaacaggtcgaactggccttccgcctgcttgcgtttcaggccgacgaccgaattgatggccgtttcgtggatggtgaacagcgcacgacggttcgggtcgatcgagtcgaacgcgccggccttgatcagcgattccaccaatcgcctgttcagcgcctccaacggcacgcgtttgatgaaatcggtgaagttcacgtacttgccgtggccgttctcacgttccgcgatgatcgcatcgaccgcgttcttgccgacgttgcggatggcgccgaggccgaatcgcacgacgtcgccgactgccgaatactcgtacaccgactcgttcacgtccggagaaagcacctggatgcccatgcgtcgcgcctcgcccaggtacagcgcggtcttgtctttgttcgtgctggcgccttgcagcagggcggccatgaactccaccggataatgcgttttcagatacgcggtccagtaggagatcaaaccgtatgcggccgaatgcgccttgttgaacgcgtagccggagaacggcacgaggatgtcccacacggcctgcgcggcctcttcggaatatccatgctccttcatgccggcgaagaacggaatcttctccttggccagcacttccggcttcttcttgcccatcgctcgacgcagcacgtctgccttgcccagcgaatagccggcgaggattcgcgccgcggactgcacctgctcctggtagacgatcagaccgtaggtctcgtcgagcacttccttaagcggttcggccacttcggggtggattggcgtgatcttctgcagaccgttcttgcgcttcgcatagttggtgtgcgaatccatatccatcggacctggacggtacagcgcgatcagtgcggaaatatcgttgaagttgttcggcttcaacgttttcagcagcgagcgcatgccgtcggaatcgagctggaacacgccgagcgtgtcgccacgggacagcaggtcgtaggtggggcggtcgtccagcggaatcttcgtatggtcgatgcgttccttgccgttcgcctcgatgttgttcagggtgtctcggatcaccgtcaagttggaaagtccgaggaagtccatcttgaccagaccgagcgtttcgcacgtatggtattcgagcgtggtggtgacggtgccgtcggtacgttccagcagcggcgacgtgttggtgatcggctcgctgcccatgatggtggcgcaggcgtgcacaccggtctgacgaatcagaccttcgatgcccatcgcctcgtccgtgatgcgtttcgcgtccgggtcggaatcgtacagttcgcggaattcgcgtgcttccgcgtatcgtttcgcgcttgggtcgaagatgtcgtgcagcggaatgtccttgccgccggtctgtgcgggaggcagggctttggtgatcttgtctccgacggagaagtcgtatcccatgatgcgggcggagtccttcagcgcctgcttggttttgatggtgccgtagatcacgcactgcgccactttgtcacgtccgtatttctcacccacgtagtcgagcacgcgtccacgaccgtccgggtcgaagtcgacgtcgatatcaggcagtgagacacgttccggattgaggaatcgttcgaagatcagaccgtgttcaagcggatcaagttcggtgatgcccatcgcatacgcgaccatggcgcctgcggcggagccacggcccggccccaccatcacgccgtgggccttcgcccagttgatgtagtcggccacgacgaggaagtagccgcagaactgcatctggcagatcacgccgcattcgtagtcggcctgccgcagcacttcgagcgacggcttgccgttgtaccggcgttccaggccttcctcgaccttcttcaggaacagcgacgtctcgtcccagccttccggacagtcgaattgcggcatgaacgcgccgtcttcatgatcgtcgaacatgacgttgcagcgttcggcgatctccaacgtgttgtcgcacgcttcgggaaggtctttgaacagttcgcgcatttcctcggcggatttgatgtagtagccggtgccgtcgaatttgaatcggcccggctcgtccagcgtggagccggagttgatgcacagcatggcgtcctgcgcgccggcgtcttcggcacgcgtgtaatgggaatcgttggtggccagcagcggcgcgttgagcttttttgcgatgtcgagcagcccgtcggtcacttgcttttcgattttcaggccgtggtccatgaattcgatgtagaaattatcgcggccgaaaatgtcttggaattcgccggcggcacgcaacgcgtcatcgaactggcccaggcgcagacgagtctggatgatgcccgacgggcagccggacgaggcgatgatgcctttcgaatatttggcgaggatttccttatccatacgcggatagcgcatgactcggccttcaaggttcgcgtcggtggaggctttcatgaggttgacgaggccttcgtcgttttctgcccacatggtcaggtgggtgatgacaccgccgccggacacatcatccgggttacggcggcgatgcagcggatccagatccggattccagttggtgtcccagctcacacgggtggggtcctgacgtgcggtttccggcgtcacataggcttcgatgccgatgatcggcttgatgccggcgttgaccgcggcgctccacatctcatacgcgccatgcatgttgccgtggtcggtgatgccgacggccggcatgcccagttccttggcgcgcttgaccagatccggtattttcgatgcgccgtcgagcagcgaataatgcgtgtgattatgcagttgcacgaaatttgcggaagtagccatgcgttccaatttagctgggcttcatgacggcgtggagtcgtttctggccgtccggccacacttttatagggactggtcggcgtgccgtgcgcgcatcacgtcaagcgcatgctgcaggtcggcgggatagtgcgatttcaccgtggtccacacgtgcgtacgcggatggcggaattccaattgcatggcgtgcagccattgccgttcaaggccaagcgcctcgctcagctgcggattcgcgccgtacatggcgtcccccgccaacggatgcccgatggatgagaaatgcacgcggatctgatgggtgcggccggtttccaggttcacggatacgagcgtggcttcgccgaaacgttccatcacgtcccaatgcgtgatggcctctttgccggccggtgtcacgcagaagcggaagtcggagactttggcgcgtccgatcggcgcttcgatggtggctttgtcttctttgagattgccctgcacgagtgcgtgatatgttttgacgacctcatgttcggcgaactgccggcgcatctccacgtacgcaagatcggacttgcatacgagcatcagtcccgatgtgcccacgtcgagtcgtgacacgatgccttgacgacctgccgcgccatatgacgtgatgtgcactcccctgtcgatcaggctgccaagcaccgtcggaccggtccatccgacggatgcgtgcgcggcgacgccgaccggcttgtccaccacgaccacatcgtcgtcctcatagacgacggccatgtcatgggcgatcggttccggttcggaccgttcctcgacgatgtcgaattctacggtttcgcctgcctgcagggtcgacgatttggaaatgtccctgccgagcacgcgcgcctgtccgctttcgatgaggtcggccgccttggcccgggaaatgccaagcattttggcgaccgcgacgtcgaatcgtttgccgacgagcgcgtcgggagcgggtacgagacggctcatgctgctttcgccccgtcgtcggttgcgttcgcatcatcaccaagcgtcttgccgttggcctcgtcaaggtccttttggctgaacggttccccgaggaacagcagcagcaccgccgcaacgcccgcgagcatgaggaagatgtccgccacgttgccgatggaccatccgtagttcaggaaatccacgaccttgccgttgaggaacccttccgcgtagatgacgcggtcgatgaggttgccgaacgctcctgcgaaggcgaaggcgaacagcaccgtccatttcatggaaatggtgcggacggcaagtacgaccaacgccacgcaggccgccatcgccagcagggaaatcagccacgtcatgccggagcccatgccgagcgaggcgcctggattacgcaccaatgtcaacgaaagcaggccgggaatcacgcgtatggtacggccatcggccaatgcggacaaagcccacatcttggtgagctggtcaatcgcgatcgtcgcgatcgcaatacacgcaaagacggccacgcggtcgcgcagccgtctttgatcattcttcatgatgtcagacacaggctaatctcagtcgttgttgtcctgagggtcctggtcgtagttgttcgtatcggacacctggttgacgagctggccgaggaagtcggtgagtcgtgcacggtattcggtttcgaactgcttgaggcccttgatgttgccttcgatgaccttggtctgggtctcgaggttgtcgcggacctgctgggcgtagtcgtcggcagcggtacgggtcttcgaatcgtagtcgaaggcgcgcttctgcacttcggcttcgtagttgtcggcctcggtgtgcttgtcggagaagtacgtgtcggcgtcctgggtcttctgagccaggtagccgtcgccctcttcctgcttctgcgcgaagtaggcgtcgccttcctgctgcttctgctccagataagcgtcgccatcctgctgcttgccggccagataggcattgccttcctcggtcttctgcgcaaggtaggcgtcgccctcctcggtcttctggttcaggtacgcatcgccatcctgctgcttctgtgccagataggcatcgccatcctgggtcttgccggacaggtagttgtcggcgttggcgcgggtgtcggtggagtactggtcagcctcggaacgagtgcggttggagtagtcgttggcgctgccgatgatctcttcgtacttgcgctggctttcctcggtgatctccttggccttggccttgcccttgtcgacgtactggtcgtgcagctgcatggccagcgtcagcatggcggtggcgcgctccggctcggtattggcgcttgccgcggcacctgcgatcttctgcaggctgccggtttcggtgctcggctcggacttggcgacctgttcgcgcagctgtgcctcgcgaatctgggaatccttcagttgctgggcaagctgctggatctgcatggcctgctgcttcacctgggcatcctgctgctgggactgggcagcatgctcctgagtgagctgctgggcctgagcgacctggtcctgcgcttcctgaagctttgcggtgagctgatcgatctgctccttctgacgctgagccacgaccacctgctcctgggccgatgccagctgacgggacaggtcctcggtctgtgcgcggaacgtgtcacgctcgtgctgcacggcggtaagctgctcgccaaggtcggcctgaccggccgcttcggctgcctgggcggtgagctgatcgacctgcgcggacagacgatcgatctgccccttgagctgctcgttctgggaagacagcgcacgattgctttcctctgcctcggaaagcttggcggccgcggcctgagcggcctgagcggcctggtctcccgcaccagctgcctgctcggaggcggacttcagcgtcgcgttctcctgctgcagggactggatctgagcattcaactcggaaatcttggaattgagtcctgcgacatccgggccaagagactgcgtggcctgtccgccggcaactgcctgcttgccaagggcttccaccgtctcggttacctgatcgaggaagtcatcgacttcatcgacgtcatagccttccttgaaccttacggtctggaaagtatgctccctaatatctttcggcgtcaacagagccataaatccttacacctcgctttgggcttgatgccttactgttgttgctttcagtgttcgactctagcacgaaaccatagatattttgcggaaaaacggttttttagaggtgctaaataaggaaatcaatgaccacaagaacgaaataaagcacaagatacgcgacgtcaaaatagatcggtccgagcggaacgggacgaatatactgccgcaaccaccttaacggcggctccgtcagctggtagatggcgtcgaacaacgaggccacgattccgcttggccgccacgtcggcgacaatgccaacacccagtcgagaatcatgcggacgaacagcaccaggatataggcgttgaccagaaaatggacgacgctaccaattaccgagagaatcacgttgcaactgtatcaagcgcgcataacaagatgcccccgctttcggtgggggcataatcgtctgatttgtgcttgctctgtgctacacggctcagtcggcgaacaggtcgtgggccggacccttgtcttcaggctcctcgaccttgatgttcacttgggccgggctcagcaggaacacgcgcggagtgacacgttcgatggagccgcgcacgccgaacaccacaccggcggagaagtcgacgatgcggtatgccacggcttcggccacacctgtcaggttcagcaccaccggaatgccgtcacgaatggcgcgaccgaccatctgcgcatcgtcataggtcttcggatggatggtggtgatgcggctcactctacccccctggaacgggttggactgctcacgcggagcggacggcgtggaagcggaagccgaagaggaaggcatcggggtgacggaatgatccgaatcgaacgaggtctcgccggtgtcgacgtcatcctcgaaatcatcctcgccctcggcgacgtcggacattcccaagtacgacatcgcgttcttcatgaaacctgccatgtatgttcctttcgcgtctacgcgttgactttagcgcaggaaatccggaatatcgaggtcgcccggatcgttagccgaaaccacttcatgctcggtggtctggtcgaacgaggcgacgttctggtccggagtggacggaatgtagctggacagcggctgcacctgcggcaccgccggagtctgcaccggctgcggctgctgggcgggagcctgcacgccggcggacaacgcggacagcggtaccgtgttttccttggccgcggccggcttttcttcggccggctggtcgggcttcttagaattggcatcgaaacctgccgcgatgacggtgacacgcacctcgtcgccgtaggcgtcgtccagggacaggccccagatgatctgcgcttccggatggatggccttctgcaccagcgcgaccgcggctgcggcttcctgcagcttcaggtcggtcggaccggcgatgttgatcagtgcgccatgcgcaccctcgatgctttcctccagcagcggcgagctgatggcgatttccgcggcctgcgtggcgcggtcctctccccgagcggaaccgatgccgaacagcgcggtgccggcaccacgcagaatcgcgttgacatcgttgaaatcaacgtggatgtacgaattcgaggtaatcaggtcggtgatgccctgcacgccggccagcagtgcggtgtcggcggtcttgaacgcgtcgacgatgccaatggtgcggtcggacagttccagcagtcggtcgttcggaatgacaatcagcgcgtcgacttccttgcgcaggttctcgatgccaagcgccgcggaagcggaacgctgcgggccttcgaagctgaacggacgggtgaccacagcgatggtcaatgccccctgctgatgggcggcacgcgccacgatcgggctggcgccggttccggtgccaccgccctcaccacaggtgacgaacaccatgtcggatcccttaagcgcctcttcgatgtcggactgatgatcctgcgctgccttggcacccttctccgggtcggcgccagcgcccagaccacggctggaggcatcgttcagcgagattttgacatctgcgtcggaacgcagcagatcctttgcatcagtgttgatcgcaataaattcgacgctttgaagaccttcagtaatcatgcgattgacagcgttgccgccggctccaccgacaccgacgaccttgatgttggtcttgtcgttgaaattgtcagtctgggcaatctcgctcaccattgtctcctgttcactcacgtacatgcacaactctatcgcaatcgcgccgatgatacgcgcacttttccaggcgtgtaccaccgttttttcacttttttgctgtcagcatgttcattctgcctgcgttgaccccttcagtcatttgtacacggctcttcgaacatgcgtgacgggctttagtagctggcatccatcgggtcatccccgaacagcgcctcacgctcctcgtgcgtggtttcccgggattccaaccatccgtaaggcagatgcacctttttggcgaagcgcacgcgcccccttggcttgtcggcgatgcgttctgggaaccgaatgttcgggtcgagtctgcctatctcgcgccggacatcctcaagattttcacattccatgaacgcacggcgtgtggaaccgcccacggggaagcccttcagataccacgcgacgtgcttgcgcaggtcatgcacggccatccgctcgtcgccatcatagaattcggtcagcagttcggcatgccgttcgatcacgcggcacacgtcgcccagcgtggggtcgacgcgctcgtcactgccggcgaacgcgttcttgatgtcggcgaacaaccatggacggccttggcagccgcggccgatcgcaacacccgcgcaaccggtttcggcgaccatcgccaacgcgtcgttggcaccccaaatatccccgttgccgaagacgggaatatcaagctcggaaaccagctcgccgatgcgggaccaatcgaaatgcccaccgtaatattcggcggtggtgcgcgcgtgcagggtgacggccttgcagccttcctcctgcgcgatgtgcccggcttcgaggaacgtctcgtgttcatggtcgatgccgacgcggattttggccgtgaccggcacgttggccgcgtcgcacaccttgaccacgcgttggatgatctcacggaacaggtccgtcttccatggcagcgcggaaccgccgccacgacgcgtcaccttgggcaccgggcagccgaagttgaggtcgacatggtcggccatgttctcgtcgatgacgattttcgcggcctgctccacaatcgagggattgacgccgtacagctgcagcgagcgaatcttctcgctgggtgcgaaacggcataggcgcagggctttcggattgcgggccaccaatgcgcgcgcggtgatcatttccgccacgtacagaccgtcgggaccgtagctttcgcagatcacgcggaacggccagttggtgacgcccgccataggcgaaagcaccaccggcgtttcgacgtgcaccggacccaaatcaacgggctttataacgggaggaaccgacggccgttccgcgtcggtacgcgggtcgagcacgtcggattcctcgtaggcattcacaatgctatctggcataggtcagacttgttccgttcgatatgaccgattcggggcgatcagtacaggccaccggcttcggcgatcttgacggactcaggccaagcctcgccgcccatttcgaccggcatctgcggcacgctgacgcgcttctcgccgatacgctcggcgatgtagtcggccaccttgtcgaggctgacgcgctcctgctgcatggtatcgcgttcacggatggtgacggcctggtcgtcgagggtgtcgaagtcgacggtgacgcacagcggagtgccgatctcgtcttcacgacggtaacgacggccgatcgcgccggcctcgtcgtagtcgatcatccactcgttctggcgcaggtcggcggcgagcttctgcgccacgttctgcagatcgggcttcttgctcaacggcagcacggcggccttgaccggagccagacgcgggtcgaggtgcaggacggtgcgcttgtccacaccgcccttggtgttcggagcctcgtcaacgtcgtaggcgtcgacgaggaagcacatgagggaacgggtcaggccggcggccggctcaatgacgtacggcacgtacttttcgccggtggcctggttgaagtagctcaggtcctcgccggagtgctccgcgtgcgcggacaggtcgaagtcggtacggttggcgatgccttcgagctcgccccaatcggagccctggaagccgaacttgtattcgatgtcgacggtgcgcttcgaatagtgggccagcttctccttcggatgctcgtagtggcgcaggttctccggcttgacgccgaggtcgaggtaccactgggtacgggcgtcgatccagtactggtgccaggcttcgtcctcgccgggcttgacgaagaattccatttccatctgctcgaactcacgggtacggaagatgaagttgcccggggtgatctcgttacggaaggacttgcccatgttggcgatgccgaacggcggcttcttgcgggaagaggtcatcacgttcttgaagtccacgaagatgccctgcgcggtttccggacgcaggtagtgcagggagttctcgtcctcgaccgggccgaggtgggtgcgcagcatcatgttgaagtcgcgcggttcggtccacttgccgcgggtgccgcagtcggggcacacgatgtcggccatgccgttctccggcagcttgtctccatgcttctcggcgtaggattcctcaagcttgtcggaacgctggcgcttatggcagttgaggcactcgaccagcggatcgttgaagacggccacgtggccggaagccacccacacgggggtcggcaggatgatggaggtgtccacgcccaccacgtcgccacgggtgacgaccatggagcgccaccattcgcgcttgatattgtccttcagcgccacgccgagcggaccgtaatcccatgcggaacgggttccgccgtagatttcaccggcgggaaaaacaaagccacgacgcttggcaagggatacgacttcatcgagtttggatacagccacaatgcaccttctggattgaatggtttggggtctttacaagcgcaaagcctaccgtcacatgctgacagttttgcctgacagtttcacggcatggcaagttacgtgatttccgatggggatgaacggcaaattgatgcaagaaccgaatgaaaacacataagaatatgtgaagatacataaggggcttcccgcgaatgcggaaggccccatgtaatggataaggagagaatcgttctttatgtattgtttgtcactgcttggtaacgttctcgtcttcgacggtgtcattgttaagcagcagcgaccagattttacaattgatggtcacgttgttcttggtggcgtcgccgcccttatcaagggtgtacgtcacatcttcaggaacggcaatacggttgatgccctgcacggcctgaacgaagccacgcattgcatcatagctgccattcgcagtaatgctcaccggaacctgcacaagccggccggctttgatggttccctgcatttcggacggcacttcagcggtggtggcctcatcgaaggtcacagactggatggagacgcccgcaccatcagcagcggcattcaacgaatcgatgaattcgttttggttatagccgtcaggaatctggcgctgcagctgacgcaaacgatccttctgcaggccgatcgtctcgctcgccatacgcagcgtttcaatctggtcacgcgttttcttgttgctttcttcgatctgcgcagtctgcgcgtcggcttccttaatgtgtgtaagacgcggagatacgcctacaagccatgtcaacatcagcaccactacgatgccgacggccagtgcgatccatgcgattttatgcttgttcatgtttcctcctgcttatcagttggacgatccgctggcatcggatgaggtgtcagtcgactggttggcagaagcatcagactgtccggacgcagccttgtcgaggcttgcgcgcagcttggcgagcaaatcacggttggcctgggtcgcgcctgctgagttgtcgcttcgcgaagtggtgttgccgtccatcaccagtgaaatcgttccggtatacgtgtaggtggtgccaccttcactgtcattcttggtaatagagctcacataacccgtcttgtacgtggggatcgaggcgaaattgttgataaagtccttggccgagtagaaattcggcgattcgatggtgaagtccgcggaaatcacgccgttaccagaccacacagtggacgtattgtcggaggatgaggacgaattgttcgatgaagcgatctggaagcttttgagttccagattcgtatactggccgccttccggaagcgagctgttcagcgaatcggcgaccttcatccagtccatttcgtcatacagcatggcaatcttcgccttctgcgcatcgtccagcgaattcaacgtgtcttcgacatccttgaactgcgctttctccttttgcagggaaatggtcttctgttgagccacttccacacgatggtccgcccatgtggattgggcgaacatgaacacgctgaccaccaaagatacaatgagcacgccgatcagcacatacgttaacaggtatttgatggctcgatcgcgattcaatccgacgatggaacgcggaatcaggttagcgcgcatggtccagtcggctgggttttccggcgcggtgctacgcttgccgataccgcccgccttcaacgcattgctgatatcggagacgttcatggatagcagggtgcccttctgaccgtccgaagtgtccggataggcgatttccttgccacgtccacggtgggagttggccttgtttttcttggatttcatatcaagtttcataatcacactcacctcggcttctttccgatgaccagtcccagcaccccgcctaaatcgaccgcgtgcgccacaatgttctgacgttcgacttccttggacagcttgaagcggatgaacggatcgccaatgcgcaccatcttgttgatggagcttgccaacactgggggcagaccaatgagtcgcgcacccgtaccggtgaggatgatgccgctgatggtgctgtccgcatggtcgacgtcgtacatgttcaacgtattgcgaataccgacgatgagctgcgccgtggtttcacgaatgacttcctcggctttttcgagacgttcgtcaccggtcacattttgcagaccaatctggtttttgatgcgttccgcgtcttcgaaggagatgctcagcgcattggcgatggcgtcggacacgtcgtcggcaccggacggcacgacgcgcatataggcgggttttccgttattgagcacgatcacgtcggtgcagttgccgttgatgttgaccaccgcttcggtctgcgcctggttggtgtcgctgaacaggcgggccaacgcgaacggaccggcgtcgatggaggtgatcacgaaacccgcttcttctgcggtatacgcagttttttccagaccaccgcgcagagtggctacgagaatgccatgaagctgcttgccgttctgctcgtcatccactacagacaacggcacgaagtcaagttcggattcctcaatgggcaatggaatcatgcctttggcctggaatggcagggttgagcgtaaatcagctagggacatgtaggggaagtccgcctcacggaacaccatacgacggctcgaataaacgagtatggtgttctcacgcgggaacttgaagcgttgcaccaacgttttcagtagaccggtgaccacttcggcgtccaccacttcgccatccaccacagctccaacgggcagcggaagcgcctggaagtgtttgatggtcggcgaatccgtataggggtcggctatgaccgccgctcgtatggcgtcgctcgcaatcgacagcgccgttattgctctcatggtctctccttatatatatgggtcttgtatgcggatgcgttacgcaagtccggtgagttgcaggtatagtgtggcgattggtacgccggcgaaaatgccaagccatgcgccgagcagcatggatggcccaaaggggatgcctccatgaaggtcgacctttttgctggccagcaataccaagctgatggcaccgccgatgaagaacgcggcgaacgatccaatgatgaattgcggccagccaagccagccaagcagcaatccgagaatgaacgcgagtttgatgtcgccgtctcccatgccacctttccagatgagtgagagtacgaaatagaacacgaagagaatcagcgcgcagagcgctccgcgaccaagacgattccactcccctatgccaaacgatgccacaaccagcagcaacaccgttgcgataagcgtcggcagtagcactacgttgaggatgagatggtggtccaagtcgatgaacgctatgacgatggacacgcatgcgaacacgtacagcacgggtagtgcccataacgggtatgcgccgaacagtccacctgcggttacggcaaggaaggacagtccgccaagcgattcgaccagcggatatcgtgcggcaatcggttctttgcagtgtcggcatttcgcgccgagtgccaaccaggaaaagatgggaatattgtcataccaagcgattggcgattcgcatttcggacaaaagctacgtttcggattggtgatgcttatgtggttcggcacgcgccatatcactacattcaggaaagatccgaagatacagccgatgatcagcgaggccaccagcagtatcaccacggtaggaacatcattcactatatccatgccgttcaccactttctggatgtgacggtggagtccacaaccgctgagaaataggtactggtagggatagatacggtggtcgttgtcgttgtccaagtaatgctaccggccgatccggcatcaccataattcactgaagcgttccatgcctgcgatttcaccagtcgcccacgcacgtcacgatcggttccgcatgaaaccattttcagcatggaatgaccgtctgagcgattgtattgacggtctttcttcccattgctttccacatagtctcccggatagatttccgtcaggcacatgccttcgctggtttggaaagtgccagcccatggatactgcgtcttgccgccgtaactcaccgctttcgaggtgttgtgctcgttgtatcggcggaactttgtggcgtcacttggattgtcggtcaacgacaccttactgccggaaacatgcaggtacttcgcgttgccgttggtgtcgtgcagggctatggtggtgtcgatgccagtgccatcggcgctggcatcttcggtataggagacgcggtcggatgtgaagttgaagttctccttgtcggcggccgaacagtgagaggtcgagatgaaatcgctgccttgccctatgatcgtcttctggtagcatttcgcgtcgaagtccgcactatgcacgtcgcaggtgtcggcgtatacgtcgttgccgtccatcaccatgcagaatccggatgcggagttcaccatctgattggtgccgtatcccgcttcgcctgcttggctgaaggatgcggtggcatcctgcatgtcggcaccgttcgaaaagtaggaatcgctgaagttataggtccattgcgacaccatatacgcctgactgtagggggtggctttgatattgccgcccgcgaaatgtggatcgccactgtcttgtgggctaccgccgtaatgggtgacttccagacgctggaacttggtctttttgccgctctgcacgccggctacggcatatcccttgctttcaggcagagcggaatcatatgacgctgcttgcgcaccgacatcgcccgtcagctcgttccagtatccggcgttgatgaacccgttgtagaagttccatttctggtatttgttgagcagactgttcgggtcgttcttctccgtctgctgcgcaaccttattcggatccgtataataatcgccctggaagtggactccgtatgatgtgccgcatggctgcaaggtggtcggagtcttgccgtcggtgtcatcgatactcacaccggtgacgcacaatcccatattcgaggccagacggatggaattgtccttgtagtacacccacgtgttcaatgaggagtacgcaccgtcagcacggcattcctcagtatattggtaggtgtcacctcccgcgttgtatgcggcgggcagtaccaccagcccagaaccggcttgaggcgatttgcttaaatcgaggttctcggcaatgcttttcttctcgttggtaaccggaatggtggtggccagcatgcaggtgcggttcactggattcaacgtcgcagtgccatcggacagctggctggtattggtgcgtccggaatccaccgtgccggagaatttaacttcgccggttggatcggatccgatggacacgccatcataatccacgggtacccatacaaactgcgaatcgagcctgttgtagggcgccgcggcataaaaacccatgcccatgcggccgccaacacccaaggcacttgaatgattcgtggtagtggagtccgttttggcttcgatcctgcataccgcacgcttcatggcctgcgggcttttggtgttgcctgctgtacggccgtccttataccggttgatgaagcccgtggccaccacttcggcatactgtaggtttttcagatcggatggagagctgatcatctccgccgatgcgtcatccggattggtgtcatagaaattgatgcgcacacgataggacaggtcatccggcgtatatgaagccgtatccgatgtttttaccgtcttatttaaagcaacatgattcaacaacacggatgcgccatcatatttggcaaattcaccatccttggaactgtcgttcatatcagcatcaacggcaggcaacaccttctgcaaatcatcaagactcgtagaaccttgcaacttcgccagagtctcattgatatagctcaagccgacttcaaggccggattcggccgcatagttggcttgggaattttccttattgttcttgtaaggaatcgcctgggcaagcagggtagtcatgaccagagcggatgtggtgagcaccaccatcacgaacagaacggccagcatcatggcggcgccgcgctcccccatgcgttcgcgtaatgccgcacggtacctgcggttgagtctggaccacaatccgttctgcttcatgcttgctcctatatataaaggtatgtttcgctcgggtactcggatatcagatcaggcctgaccattgatggcgtcgaacatggagaacatcggcatatacaatgccaccaccatgaagccaaccaccacgccgaggaacagaatcatcagcggttccagcaacgaggtgagctgtttggccatggattgggcctcttcgtcatacgctcggcccgcgctggacagcattttgtcgatggcgccggagtcctcgccaatggccaccatctgcaccagcatgttcgggaagatcttttcggtgctcatgctgtcggccagacggtagccacgttccaccaaacggcccacacgcttcgaagacgaatcaatcacatagttgcccgacgtcgatccgacgatatcaagtgcctggagaatcggcacaccagaagcgagcatggaagagaaattattgcaaaagcgggccagggccacgttggtgtccagcttgccgaacaccggtgccttgagcgtgaacggatcccaccaggtgcggatgatgtctttgttacggttgcgcttccagaacatggccagcgccacgacggccacaatcagcaccggaagcacgtagggcatcactttgccgaggtccaccaggatctgggtcacgaatggcaactgggcattcatggaatcgtacatgctggcgaacatcggcacgatggtgagcagcatcaccatcaccaagatcagggcgatgcccaacaccacgataggataggccatggcacttttgatctgcccttggagtctcacatccgattcgaagctgtccgccacagtgagcagcgacttgtctagaaaaccgccggtctcgccggcacgaaccatattgaccatgatcggcgggaacagggaatcaggatccgcctccatggcttcggagaaggacgagccgccttccacttgcgccacgcaggcctgcaccgccttacggagtttcacgttctcgatttgttcggtgacgatgttcaaggctcgaatcagcgagacgcccgccgccaccatggtggcgagctgccgtgccgttactgcgaagtcttttttgcttggatatttctcgaacgccttgatgttgatttcagtattgagaccggtgccggcagccgtgtcagtcagatcggtcggatacagtccgagttttttaatgcgttcgatggcttggtcgcgcgtctgcgcttcgaccacacccttctctttacgctggccgtcgaacgagacgcccttataacgccactgcctggtgccgttatccattgaaacctgcgcgtcgttgccggccatgattccccttcggattgtcgaatactggtatttatttgatacgcgaaatgtcggggacgtttgtcgtccccgacattcaattcaggcgattagtaaatcattttttgacgccattatctgaaacaacgccgttgtcagatttatacgtatacgtgtgcgttccagcgttgtcgttagtacctgtaatttcataagtattatcggcattcagcttaatacttagcgtcacaccgtcagtgacggtaatcttattaccatcaatcgtgcacggggctttggcggtgcatgcggtcagtgttccggtagtcgtcagaccgctgacctttccgttatttgcagtagaagcagtttcaatgacaagactggcattcttgacatccgattgggtttgagagttccacgcggatttacgctgattcagataaatcgggacggaaatcgcggcgaggatgccgatgatgatgacgaccacgagcagttcgacgagggtgaagcccttttcgcccttggcacggcggttgagtgcgttacgtacgctcttcataatgaacccttctttccaattggaaggacataccgtgggaccgtccaacttcggatggtccacagcgattcttctttgcgttatttccccttgtgggggtggctggctcacataaccaacaactctcagcgtagtcgtattgacatcgtttgcagtaccagatgcagtgcaccaatcgcaccaatgatgtttcatccaccgttttcatcacaaccccgaatcaaactttttcaatacgattgcataacccctcttcacacaatcaccaccgtccgattccgtaacatgcgttgagtccgtcggtctaccggtgtatctcttcgtttgaaacgtttaccctggaatagttatattttcaatagtgtttcagaaaatattttcagcatgttttgacgaaaattcatcaaaaaaccatttccccccgggcgcgtcgggggtatttgaaagtatagaaaaagggctcccccacaagggagagcccttacagacacagtcattcaacgacattgactgaagtcgaccgaagcactcgaacccacattgcgagctgtaaacgatgtcaatgtgttcgaggtgaccggcttgccacccacatacgaacccgtcaccggcgaataccgcaccacgcgcgtaccgccatccatgctgaacagtttgtttttgaacagcgaatcatcggacgttgaagcggtactgttgttcatcaccgccgccaacaccgcatgctcgctccacgctccccccgcaccggttgcgtatggtctggtttttaccacgacggaaccataatcatcaactcgcccgccggaccacgtggcctctgtgtactcaatcacagcgcattgccgaatcccatcggcatcagtggtcaccaaagtcaacctgtcaccgctggcagcctcttccacaccttcggcattgcgaacatatcggtccagagcctgcaccgatgtagctatttccgtagccgatctggtgcggatagcatcggctgtggtggaatgcaaatattgtacgatcgacaccgtgaacatggtggaaacaatggcaaaaataaacaatgaaaccatcatctccaccagggtaacgccgccttcaccacgagcacgcctacggagcgcacgtaataatcggcgattcagactgaatccagagttcttctcttccataagccgtcccgctccttcaggccccgatcacattcagcagttcattggtggtatacacggccgttttgtctgcgccaatattgtccgaccaggtgacgcctaccaccacgcgtaccatcggcatatacgttttcgccataaaggtgaatcccttagtaggaatgttgtcctgactcaggatgctggatcgcagcgaggcgtcaggagtaccgtcaagaccgctaatggacgcatgcccgtcaatacccagttccgaagcggttctacaatccatggtgccgctttcccgatagcacttctcaatcacggtgttcaccgtatatgtagtatgtttggcgtctttgcccgtggtagtgcgcaccggctgaatgtacttgctcgtatcggcatccggagtggccgtagcctccaaatccgagaattgtgaggtgatggcccccactgccgtgagattcgcatgtgctttcttcacatcatccacacccatgccaggcagcaaatccgtgtaataggaggatggcgcagaagtatgatccgctatctgtgcgcgcatgcgttcgataccatcactacccaaagcaatggctgctgaacgctgctgctgggcataagaagtacgaatcgcagtaatcgcgaactgtgcggcggcaagacctgtgatgctcagcaccacaatcgccaccaatacctcaaccaatgtgaaacccgactcgccacgtttcggcaatcgtttgacgttatgtattgcaagccctgtcgcggcatcatttaccgccctacgccagctgtgctccatgagcagctccttcatgcagtatcaccccatcatcggaggcaacaggaaaaatcaccgcagaaaaggcggtgcatgaatatctgtactgtatcacgattccctgccaacgttttcacacccttccaaacaccacatgacaattggcgtttcagtcacaaagccgctaaactatgcgagtagtagtgcacaacactgcaatcgttagctcacatgaccatgaacaactgaacattctcaggcccgcaaacacctgtgttcgcaaagggccataagtcataccgtgcgttccggcgcatggtccaggaggtcattatgagcgacgccggttcgggaagccgtttccctttcctcaagcgcaatcgaaacgacgacacgccgagcgatttctcacagcgcatggatttgaattccccggtcacaggagaaatcaaccagattttcacgccgagccagccacgccatgccgctgcacccagcgacgccactagcgactttcccgccatgcccacatccaccgaaggcatggacgaaaacaccgaacgcgaatatgccatggcgctagctcaaggcatgagcctaccgttcgtagacctcaacgaataccaagtagacaaagaagtcatcagcatggtgccggacgacctgtgccgtcgcaaccagctgctgccattgtccattgtcaacggacgcatcaccgtggccatggccaacccgaaaaacttcgccgccatcgacgacgtgtccgccagcaccggcatgccggtcattcccatggtggcgatgccttctcaggtgaaggacgccatcaaccggtacctgcgcgccaacgcggagctgaccgagctgtcgcacgaaatcgcggcgaccgccaagaaggaagtggacctcgaatccgacagcggcgaggacgcctcccctgtggcacgcttcgtcagcctgctcatcaaccaggccatcgacgaccactgctccgatatccacatcgaaccgcaggaagacggtctgctcgtgcgctaccgtatcgacggtgtgctgcacgtgttccaaaaggcgccgaaagccatgacccaaggtgtgatcagccgcatcaaggtcatgtccgatatggatatcggcgagcgccgtaagccgcaggacggccgcatcaccgtcaagcacaatggtcagaaggtggatcttcgtgtggccgcactgccgacggtatggggcgagaagatcgtcatgcgaatcctgagcacgccttcgggcaatctcaaggtggaggatttgaatttcagccagcggaatttcgacgtgttctccaaggcgtacaaccgtccgtatggtctggtgttggtcaccggtcctaccggttcgggtaagtcgaccacgttgtatgccacgttgggcgatgtggcgaagccggaaatcaacatcattacggttgaggacccggtggaattccgtatgagaggcatcaatcaggttcaggtgaacaacaaggccggtatgacgttcgccgcggctctgcgttcgatccttcgtgcagaccctgatgtggtgctcatcggcgagattcgagatcaggagaccgccaacattgctattgaggcttcgttgaccggccatttggtgctttccaccctgcacaccaatgatgcgccaagcgcagtgacacgtttgacggaaatgggcgtggagccgttcctattgagctcgtcgcttgctgcggtgatggctcagcgactggctcgccgcctgtgcaagaagtgcaagcgtcaggatactgccaccgaagcggagcttcggacgttgggtgttccacacatgccagatacccctcttccgacgatatggcgtccggtaggatgccgagaatgcgccaacaccggctatagcggccgtgtggccatccagcaggtcatgggcgtggattcaacaatggaggatcttatagcccgtggcgccacgtcgattgatattgacaaggcggcgaaggagcaaggcatgaccacacttcgtaaggacggttggcagaaggcgcttcaaggcattacctccgtggaggaagtgcttcgcgtgacggtgtaggttccacctgacgttacatgcacctatgcacctctccgcacttataaaacacctataaaacgttcggttgcgtcggcgcgtcgaagcgccggcacgaccgacattttcagacagcaacccacctattaaaaggacaatgatgaccatcgagcaaacgtggaacaatggcggatatctttccggtctcaaaggcgtgaccattcccaacaacactccatcgttcaatgaggatccccgcaagggacgtcattggtcttccgacaatgcgattcaggcagatgatgaaagccttaagggcattttcgcttcgcttaattcaatgccgactgtaagccagcaggatgtgcaaattcccgacccgcagccagtttcacagtctcaaccatccgaacagtctgttgctcaacaacagactacgcaagccatacaacaatcgcaggaagcgcatgtttttccaacaacaagcgaccgtcaaccagtcggtaccggcagcctgcagtttgatgaggacactgacgcgacccagcaaaatcccgcatatgaggagcatggtccgatccagcagatcgatagcaatccaccgtccttcgtaccgggtgccacaccattcgctaagcgacagaccgacatcgccgaaaccgcagcgcagcagatgcctccgaccatcactcacattccgcaggacgcagctttccaaaggccgcagccacagcaacagcagatgtgtcagccccagccgcagaccaggccattcgcggatttcgtagtgcctgaaaccaacgacgccgacgaggatgccgttccggaagaacgtaagatcaaggccgagcaggtcgaacagacgctgcgcaccgaacatccggacgcggacgacgaattcgtgtcggccatccgccagctggttaagctcaatgcgtccgatttgcacttggtaatcaacgacccgccaatgctgcgcgtggatggcaagctgcgccccgccaagggattgagcgtgtggacgaaggatcacacgtacgaagcagtgaaagtcatgaccaacgaattagagatggaacgtttcaaagatgatctggaacttgatatctccttcgccattggcgatctgctgcgcttccgcgtgaacgtataccgcgaccgtatgggcgtatgcgccgcgttgcgtaccattcctacggaaatcaaaaccgcgcaggaactgggaattgacccgcgtatcgccgaccttgcgctgttgccacgtggtctggtgcttgtatgcggcccgaccggttccggtaagtcgaccacactggccgcaatcgtggacaaggcgaatgcggaacgtgccgaccatatcatcaccatcgaagacccgatcgaattcgtgcatcagcataagcgttgcgtgatgagccagcgtgaggtgggcaccgacacgaagagcttcgcggaagcactgaaacgcgcgctgcgtgaggatccggacatcatcgaagtcggcgagcttcgagacctggagaccatctccaccgcattgaccgcagtggagaccggccacttggtgttcgctaccttgcacacgcaggacgcaggttccaccgtggaccgtctgatcgacgtgtatccggaaaaccagcagcagcagattcgcgtgcaggtggcttccaccctgcgcgccgtaatcgtgcagacgctgattccgcgtgccagtggccatggtcgtgcgccggcaaccgaggtgatgatcaacaatcctgccgtcgccgcgctgattcgcagtggcaaggcgcatcagatccggaccgtgctgcagtctggcgagaaggaaggcatgcacacgctcgatcaggatctggcgcgactggtgaacaagggcgtgatcacattcgaggacgcgctggtgaaggtgcaggtacgcgaggagttcgagaagctctgcggcgcgcgcaagtcgttctaaggatggccggcacagctggcgcgatggtgtgcccatgcatccaatggcggttccgcaacatggaatatgacggaaccgccatggtccatgcgcggccacgcaataatcgcaaagtcacgcagcaatcgctcgtatttcgaacgcaacgggaaacaggaaacatgagttctgcaacagtagcagccacagacaacagaacacgatgcgacgcaatccggcattggctctcgccgcatcgtctgcactgcatcgtgctcgcggcgtacgtcatcgtggtggccacagtgatgtgcttccacgaaccatggttcgacgaggcacaagcctggctcatcgcgcgcgactgctcctggcgggagatgattctggagcgcccgcactatgaggggcatcctccactgtggtggatgatgcttgccatacccgccaagcttggcgtgccgtacgagatgggattgaagaccatcaacctcacatgcgccgcgcttatgatctggctgttggagttcaagaccaagctccctgaggttcttaagggcatcctccctttctcctattttctgtgctaccagtacggcgtcacgtcgcgtccctatgcgctgatggtcgcggccatgctgctggtggccatcaactggaaaaaccgtgacgagaaaccgtggcgcgaagtgctcagcatgatgctgttgtgtctgaccagctcatatggactggtcatcgcaggcatgttcgcggcgaattgggtggtgcggttcgtccggcaggaacactcgctgatacgtaaccggcaacggttcgccgcgctgctggcgctgctcgcggcggcggtggtcatactgatcgacgtgatgcccgcaaaagacgtgtattccggcaatttcgacatctccggcatgacgcagccggcaccactatggatgcaaatttgcaattcctggctgctgctgccggccgaagcattattcacctcgacggtgtcggatacgaatctggtattcatcggcctgtcgtcgacactgctgtacacgggaaccgtgtcatgcctcatgtgggccccgctcatccacatcagccgacgccggcacaacgcaatgctgctgctgagttcatacacagtgatgtgcttggtgttcgcgcagcatttctccatgcaccatctgggcatcctgctgggatttttcatcgcggtgctcgcgattgactgcgacgagcgacgtatcagcacggacgactggccggcctggtgcatcaccatggccgaccgattcatcggcaagcttggagcgaggaaagcgcgcaactatctcatcacgctgaaggccctcgctttaggtgccatgctcatcagcgtgtattggacgatcaacgccagcatatgcgacatacgatacgagtattcctcatcccggacggtggcctcgttcatcaagaccaatcatctggagcaataccgttggatggctggctggactcgcatcaattccacgaatgcgtccccggatgtcaaggaacgaatcaatcaaggcggctactgcgccgatggcaaggactgcatcgactacacatcgtgggtgagcggaacactggtcaccgccgacccgtacttcaagcgtacgctcatgtccaatgcctacaaagggcgcagctacatctcttgggaatggtgcatagacccctatgccggcaaacaagacatcgaaacctggagatcatggggcgaacccgaattctacgacaccatctatcagccgttcttcttcagcgccctcggctatgaccggaacgactacacgaaaatacgcatcgccgaaaccgtcacgccatggaaagaccagcgatcgcgcggttccgtggaaatctacgtacgcaacgacatctacaagaacgtcctgcactcccctgacaccggcatcgcatggccggatggagccaaacggcggtagatgggagcatcggtgcatcacacgagcaaggtagtctgagaatatgccgtaccacaacccgaattcacgcagccggcggaatgtcctacgcatcgtgggcgtgctcgtcgtgcttgccgtcatcgccggcgtcgccaatttcctgcacgccaccaccagtgaagcggccggcaatgtcaagccgcagatcgaaaccatgcaaggcatccggcagaccgcgcaggacagcatcacgttcgcgcagggcctggatgatccggaccgattcgccgcgcacatcgaaaccgtgcagcagtgcatggacgattacgaccggcttgccgacgccaagcagatcaagtatctgctgtcggacaatctgcaggaacgcatcatcggactgttgtaccgcaaccagcagcgcaccatcatcgacagcatgcgcgtggcggcacataatctcgacggacagaccaaagaactgctcagcgcggtcgacgcggccatggcggacgatttcagccagcatgcggcgcaatggctgctgcaggtggacgatccgacgcaggcgaacgagctcatcgaccgatacggcaaacagcgcgcgtatgcatcgatgagggagatgctcgccgacctacggtcgctgcacaaactacgctcggacgtgaaacagcaggtctcgactgcggtcagcaatctgcataacgcggaagccgcagcggctgcgatcgccgtgcccgaacgcaacggtgatctcgatccggccggatggtacacgctcgccacgaacgtggcatcgacgatgggcgtgcagatcgaacagaccatggaattcaactgcggcggccagtcaggtgagaatccgagtggattcgtggctgcgtattactgccagatgcccgaccgctcgcagaggaatgtcgtgcatatcctcaccacacacccggattggacgcagaccgcgcgaagcccctggctggtggacatggtcaagcacgaactttcgcaccgttcgatcatgatctcctgcggcaccacgcaaccgacaatcgcagccgaccgtacggaggcggtgacgaattcctattcggtgctgtttttcggggccgaccgcgaccgcatcacgaatcagcagcagggtgtcgccgaatacgcgatggatgcatccagcgatcagctggccaccgccatccacgatggcaattgcgggtgaggtaagccagttctcgcttggcgactattgcacatccttgaattcgatagtccagttcttcgcgtcgtcgccaagcacattgcgcacatactgctctagaatagtccgcgcgcgagcttcggcttgggcaagcaacgccgaatcggttttcgcctgcttcagcatgctttgctgggccttatcaaacatttccgttttctcttcggcggtaatcgaagtggcgaaaccagtgctcaccagcggtttgctgaacgacttctcatttacgtccggatcatccaacacgtgagctggaggcacggtaatgattactctatgaccgttggcatctggactaattgttactttatcggcatcaataccgtacttcacgatgccactgtattccatccacatacgtttgtagccattattgaagaaccacgatccctcatgactgagcttggccgtgttgtggtaataacattttaatgtggccatctgtgcgatatacgtggcattcgagaaagttgggatagcttctttcttttcctcgccgcaccctacagcagaacatgcaagcgtagcaacacataatgcggcaatcgcacgtttcatggaacgattattcgtcagcatgcgcggtctccttagtgagctttacggtctcggccttctgcaatttgtatccttttgcttccacgagatccttggtcaacgcatccacagtttgttcaagattactggcagcaatagaaataatgtctccgtttgtcttggtctcctgttgcgcatcctgcttgcaaagcttgatcacctcatcaatttcaacggacggattgttctcgaaaaagtcgaggctgccgctatcaaccacgacgtccccaatagtcggcttcggcagaatcggagtgacggtcttcgcggtatcgtccacttcgaacgtgatatcgctcatcttgacgccagcagtcaccgtcgcctcatatgcaacatgccacttgtccttaccagcattgtctttctttacagcaacaccgccataatggaatttcgcggtcgatagatcgtcgatattcacagccgcctgcaactggctttccacactgatggtagattcggtccttgcattgtcaaaaacaggtttaacgacaccgttccacacaaacaggacaactgcaacagtgacaattgccgcaacagcaccaaacaacaccttacgcaacttttttgcactgagatcgccgaacaacctatcgcaaagaccgccccgtctccttcgactcccgtcatttctcgccaacgcacattcctttcacggttctcttccgtcaacaattctatccccgcatgcaaatacataggggcgtcacaaacgtctcaggaaataatacggggaagcccatctcgtggaatgattatcggaaataatccgatatttgatgacgtttcatcataatgaaaatgcccgccatgtcttcctgcaaggcaggacagcacacataccacttactacttccacgcctgcttaaacattcggatgggatactcaaaagagcgtggaagaggcgacctgctattcagcacacgaaatgctgcagccgaacgtacaatggtcgccccatgtcttcgtattcggcgatgccgtttttggactaaatcagccaatcggtcacgtccttctcggaaacagattccgagaaacgatgcccggtaagccatgtaccactgcctgccattttctggagcgtggatgcactgttgccgatatcggagctggcggaagtgcagaacggaatgatcgtcttacctgcgaaatcgttggatttgacggaatcgttcaccagccaaacaggtgccatccaccaaatcgggaagcccagatacacagtgctgccggcaccgaccatgtcatgggccggaatcactcgcggccagcacgttccttgacataaccgacgaagcgatcgaccgcctcaggggtgtcgtggcgaaaaaacatgctggtcttggtgtcaaggcccgcgatggttgtcatctcgctgtcggagagccggaaatcgaagatgttcaggttttcttccatgcgctccttgtgcgtggacttgggcagagcgacgatgtcgcgctgagtgagccaacgcaggatcacctgcgcgacggacttgccatgtacctcgccaatcttggccagggtgggattggagaacatgttctgcatgccctccccgaacggagcccatgcttcctgagccacgccccgcttgaccatgttcttgcgagcttcgatctgctggttgagcggattagtctcgacctgatcggccatcggggcgatctcattgaaggcgaccatgtcggccagacggtccggatagaagttgctcacgccgatggcgcggatcacgccgtccttgtagagcttttcgagcgcacgccacgcgccgtaggtatcggaaaacggctggtgcagtaacaccagatcgagatagtcggtgccaagcttcttcaaggacacatcgacggacctcagcgtgttctcatagccgtaattgctgatccagatcttggtagtgaggaacagatccttacgatcgataccggaatccttgattccttggccgacttcggcctcgttgaagtacgactgtgcggtgtcgatatggcggtacccggtctcgatggcctcgcgcacgcagcgaggagcatcgtccttgctgatctggaagacgccgtatccgatcttcggaatctcaacaccgttggcaagtttcacgtattccactgtttttccttccataaattcgtcggtattcagtgccggcatgtatgccgttctgaccctcaagataaaatccggtagccgctaccggtcaaattacggcacgccggtactatctaccggtattaataaccggaaatgtgacatgataggtacaaacaaaaagaacaatgcgcctcaagcccgaccccatccggcggcacccgccgaacgtcctgccgcgcagcgtccgaaaggagccacgtatggcaatcacggcagtgccactccataagaacatgaaaacctatacgatgaagcaggcctgcaaactaaccggcatgaattacgaagcattgaagttctattgcaattcaggactcgtgcccggtctcaaacgagaccagaacaaccgacgcgtcttcgacgagcgatgcatcgcatggatcaacgacctgacatgtctcaaacgctgcggtctgggcatcaaggagatgcggcactacacgcaactctgtcttgaaggtgagtcatcgataccggaacgtcaggaaatccttgccgaaaaacgcgagcatctggagacgcaactggaggaactgcgtaaagccatcgcctacatcgatgaaaaacagcgcttctacgccgacgtgactgccggcaggacggcatactgcagcaacgtcatcgacacgacgcaaagcgactgactgcgttccgtaggtgatttttgcgttccgtaggcggtcagcttcgaatccggacacgagcaaacgcctaattccaggcatctcgccgatgcttatccggcagcaaccacctacggaagcccaaaatcacctacggaatcgcgcctgtcaagggacgcagatagattaagcactgttgtaaacatgcgggggtgcttgatgtccaagtccatcaagctgagataggcatgaacgcctgaccctttgaacctgttggttaggaccaacgtagggagcagatcatgagcgatgactcatccgccaatgacgcactcggcgcattgcgtgccgccatcaaacaagccgtcatggacgtacgcgagcagacgccgctggcgcagtcgttcaccaatttcgtgaccatcaatctcgttgccaacgcacagcttgcggcgggcggcaccgcggccatgagctatctgccggatgatgtgatcgccaccgccgaaatcgccggatcgaactacatcaacgtgggcacgttgctgccgttcttcaaggacgcgctgccggaaatcgcgcgcaaactgcacgaaaacggcaagacgtgggtgctagacccggttgctgcgggcattggcgaaacacgcacgttcattcttgaatcgttccgtgacgcgcctccgaccattgtgcgcggcaatgcgagcgaggtcatcgcgcttgatgcgatgtgggggctggccgacgccgacagcactgatccgaccacgcgtccggctggagtggaggccgttgacgaggtcgacgcggccatcgacgcggccaaacgtgtggcccgccatttggcgaagcactcccccgtcggcaagggcgcggttgcggtgtccggcgcggttgatctggtgaccgacggcgagcgcacgttccgcctgcccggaggcagcgcgatgatgacgaagatcaccggcgccggctgttcgctcggcggcgtgaccgcaacgtatcttgccgtggccgagccgctggtcgccgcccttgccgcgtcgctgctgtatgatcgtgcgtccgaaatcgccgaagtcaaatccgatggccccggttcgttccaggtggcgctgctcgacgcgctgcggaacgtcaccgccgaccaggtggccgcgtccgacatcatcgaaaccaactgaccgcaacgttccgtggatggtttcgcaccatcgcaatcgtatatacggaatatatacgttcagtgcggtgcgacggaaaataaacggaaaataacaagacttcttctggagcacttacccaaagaacaacaaaggggaaaccaatgaataattatccattcgcctcgatgcgcgactgctttgatatgagcgcgtatttcgtggtcggtccgcaggattgcaagggccggccggtgacggatgtggtggatgacgcgttgcgtgggggcgcgacgttcatccaattgcgcgccaagaacgcggatgcgaaggatatcaccgaaatggcccgcgatatcgcgcaggtcatcaagaacagcggcaagtccgattccgtggcgtttgtgatcgacgaccgcgtggatgtggtgtggcaggcgcgcgacaagggcatcaaggtggatggcgtgcatatcggccagaccgatatggaaccgcaggaggctcgcgcgctgctcggcgaggatgccatcgtgggcctgtccgccgagaccgaaagtctggtgaagcttatcaacgagctgccgagcggctgcatcgactacatcggcgccggcccgctacatgtgtccaccaccaagccggaggcttccgtgggcggcaacgacggttccgggcacacgcttgacgaggaacagatcaacgcgatttgcgcggcgagcgagttcccggtagtggtcggcggcggcgtacatgccgacgatatggagatgctggcccgttcgaaggcggccggctggttcgtggtgtccgcgatcgccggtgccgacgatccggaagcggccacccgcgaaatggtgacgcgctggaaggcggtgcgcggcgacgcgaagcacggctatgcgccgcgtgtgaagtagtccgtcgtacagggaatcgacaagcccgctgagatgagcgagaagttccgcaagggtggttctacactgtatcagtgagctcagtgaagataatcaatgaatcagtgagcctaataaggagagttaccatgactagcacattgccaccggtattgagcatcgcaggatcggattcgtccggcggtgccggcattcaggcggatttgaagaccatgctcgccaacggcgtgttcggcatgaccgcgatcgcggcgctgaccgcgcagaacaccaccggcgtgacgatggtcaccaacactcccccggaaatgcttgcggcgcagatcgacgcggtgttcgaagacattccgccggtggcggtgaagatcggcatggtgtccagcgccgagctcatcaccgtgatcgccgaccgtctgaccgcgcacaacgcgaagaacgtggtgctcgacccggtgatggtggccacgtccggcgcgaagctcatcgaggatgatgccatcgcggcgctgacgtccaaactgttcccgctggccactgtgatcacgccgaacatgccggagacccaggtactgtgcgacttggccgtagagcagggtgcgggcgcaatcgactatgagaacggcgaatccatctccaccgagaacgacatggtgaccgcaggtcatctgctcgccggccatttcggctgcgcggtgctcgtcaagggcggccacggcacgcatgacgcgagtgacgtgcttgtcgagccggatggcaagatcacctggttccgttcccgtcgcatcaacaacccgaacacgcacggcaccggctgcacgctgtcttccgccatcgccagccatttggctcttggcgaggcgctgccgacggccgtcgaccatgccaagctgtacctgaccggcgctttggaagcgcagctcgatcttggacatggttccggtccgatggaccacgcgtggaagtggcgttgaaccaagccacgcaaaccacgcgaaccacggcagccgttggaacagtacaacaagtaatcgcacgaaaacacacgagacaacgctgagaaaggtaatcatgacgctcgatcgcaacgcagaaaagcaggaagtgcccgtcaatccggaaaccggcaaaccgtatatcaacacgcttgccgcagtagccatctcccccgccggcgccagcccggagaagtccacgtacgtggcgcaggccgtggacgtaatccgtgaatccggcctgccgaacgagacgaacgccatgttcaccaacatcgaaggagacatcgacgatgtgctcaaggtgatccgcgacgctaccatgaagctcgccggccagggataccgcaccgacgtggtgatccgtctcgacatccgccccggtttcgaaggacagatccatgccaagcaggaactggtaaacgagattctgtcgaaataaccccctttacagtggtgaaacgaaaccattccatgtaaaaaagcgcgctttttcttggcaaaagcgcgcttttcgcgtttatttgggtatagtgttgcgattatgacgacaatgaaggaaatcgccgaacaaacgggggtatccatctccactgtatccctggtgctcaacggacgcgacgaaggcagggtaaatcccgcgctcgccaaactcgtacgcaacaaagcgaccgagctcgggtacaagatcaacccgttggcgcgaagcctacgcaccaacaaaacccgcattctcggcttcatcagcgaggaagtcgccaccacaccgtacgcgggcggcatcattctgggcgcgcaggacgcggccagcgcctacggctacatgctgttcaccgtcagcaccgacggcaaggcgagcgaggaaaacgagatcgccacactgaaaaggtacggcgtggacggattcttctattcgaagatgtcgaaccgcatcgcacatgttcccgaatcgttgaacgaataccccgtggtgatggtggacgccaccgaccacgagaacaaagtgcccagcatcgagccggacgagttcatgatcggctacgacgccacgaatcggctgatccaggccggatgcaaacgcatcgcatacgtgggttgcgcggaaaacatgatcgcgcaggacggtcgtcttgccggctaccgcaccgcgttgcaggaggccggacgtgcgttcaacccatcgctggtatgcaacgtaatgaacaacggtccagctttacgcgccgtgaacaagttgttcgacgacgagcatccggacggcttcttctgcttcaatgatgcgcgcgcctggtatgtgtacgaatgcgcggcaagaagagggcttacggtaggcaaagatatttccgtggtcggcgtggacaaccaccgcgtgttcgcagagacacttgaaccgcagctgaccaccgtcgaactgccacattacgaaatgggctattggtcagcctgcaagctgatttccatgattgaaggcaaggatgtggataccagttcatgtccatccgccagagcttccctgccgccgcttgatgcgccgattccggcgaagatccactgcgcattgttggaaaaagattccgtcatatcctgatttttctgtttttacaacgattcaaatgcttacgattgttcgcacagccattttctatacatgaaaattgtgcgtttgttcacgacacgccgaataaagcaatcgtgccaacagtccgccagcagttgattcaggcttaatttcaactatccgcaaatccttacaaacgtttgacgaagcagttgccatatgctatcttgaagccatgttcgcttttcggcacggcagctgaaatccgagcaggcgcaagccaaaacaacatcggaagcaatcgatgccgcgcggcagcggcaccgcgaagagaaaaagagaatcaaaatggcaagtaaaacacgttctgtatggaagaatccttcctatctgcagagctccttcggcattttcatgttcttctgttcctggggcatctggtggtccttcttctcccgctggctcactgacccgacccacggtctgggcatgagctccgcggaacagggccagatctactccatcaactccttggccaccctggtcatcatgttcgtttacggcaccattcaggaccagctgggcatcaagcgcaagctcgtgatcttcatctctgcggtcgctgcatgcgttggcccgttcgtgcagttcgtgtaccagccgatgctgaccgccggcggcaccacccgattcatcggcgtgcttctcggctccatcgtgctgtccgcaggcttcatggccggctgctccctgttcgaagccgtcaccgaacgttactcccgtaagttcggcttcgaatacggtcagtcccgcgcttggggctccttcggctacgctgtcgtggcactgtgcgcaggcttcctgttcaacatcaacccgctgctgaacttctgggttggttccatctgcggcctcggcatgctgtgcgtctacgccttctgggttccggccgagcaaaaggaagaactcaagaaggaggccgatccgaacgcggctccgaccaacccgtccttcaaggaaatggtctccgtcctgaagatgccgaccctgtgggtgctcatcgtcttcatgctgttcaccaacaccttctacaccgtgttcgatcagcagatgttcccgaactactacgcctcccttttcccgaccaccgaaatcggcaacgccacctacggcaccctgaactccttccaggtgttccttgagtccgccatgatgggcgtcgtcccgatcatcatgaagaagatcggcgtgcgtaactccctgctgctcggcgccaccgtgatgttcgcccgtatcggtctgtgcggcgtgttccatgacccggtctccgtctccatcgtcaagctgttccactccatcgaggtaccgctgttctgcctgccggcgttccgttacttcaccctgcacttcgacacgaagctgtctgccaccctgtacatggttggtttccagatcgcttcccaggtcggccaggtgattttctccaccccgatgggtgctctgcatgatgccatgggcgaccgtccgaccttcttcaccatctctgccatcgtgtttgcggctctggtctacggcttcttcgtcatcaagaaggatgatcaggaagtcggcggcgatccgttctacactgacaagcagctcaaggccatgaaggccgctggtgcggaagtgaaggcctgagtctcagcccgtactaagtcggcgtacggcgtcgatggtggtcgcaacctacatcccttctcccgcgatcatcatcggtaccgtacgcgtcataacaacaatcgtggtgtccgaagcgtttccctttttccgctttgggcaccatcttcaaaaagctttttatccaacaattcataacccagattcagaaaggcattcaacgatgactggctttactccggacgcacctgtccttcacgaaatcaagaaccacagcgaggaactcaccaaggcagaggccggtgtcgcggccttcgcagccaagcgtaacaaccgctggtatccgaagttccacatcgcatccaatggcggttggatcaacgatccgaacggcctgtgcttctacaagggccgttggcacgtcttctaccagctgcacccgtatggcacccagtggggtccgatgcattggggtcacgtctcctccaccgacatggtcaattggaagcgtgagccgattatgttcgccccgtctctggaagaggaaaaggacggcgtcttctctggctccgcagtgatcggcgacgatggcaagctcaggttctactacaccggccaccgttgggccaacggcaaggacaacaccggcggcgactggcaggtgcagatgctcgccgaaccagacaacgatgagctgaccagcgccactaagcgcggtatgatcatcgactgcccgaccgacaaggtcaaccaccactaccgcgatccgaaggtctggaagaccggcgacaagtggtacatgaccttcggtgtctcctccgcggagaagcgcggccagatgtggctgttctcctccgacgacatggtcaagtggacctatgagcaggtgctgttcgagcatccggatccggacgtgttcatgcttgagtgcccggacttcttcccgatcaaggacgtcgaaggcaacgagaagtgggttatcggcttctccgccatgggtgccaaggcttccggctttatgaaccgcaacgtttccaacgccggctacatgattggcacgtggactccgggagaggcattccagccggaaaccgagttccgtctgtgggattgcggccacaactattatgctccgcaatcgttcaatgacggcgagcgtcagattgtatacggctggatgagcccgttcgttgagccgattccgatgcaggatgacggctggtgcggcaatctcactctgccgcgtgagatcacgctgggcgccgacggcgatctgcacaccgctccggttgccgagatggatggcttgcgcgaaaacactaccgatttcggcgcaatctcacttggtgtcaatggcgagcagaccattgctgatgatgctgaagccgtggaaatcgaaatgaccatcgatctcaacgcctccactgcggaacgtgctggtctgaagattcatgcgactgaagatggcgcttacacgtacgtggcgttcgacgatcagatcggtcgtgtggtaatcgaccgtcaagccgcagcacagggtgatcgcggctaccgtaccgccccgctttccgccgaggaactggcttccggcgaactcaagctgcgcgtgtttgtggatcgcggctgcgtggaagtgtatgtgaacgacggacgccaggccatgagctctttcagctacgcttccgaaggcccgcgcgccatcaagcttgttgccgaatccggcacgctcaaggtcaagtccctggtgcttcaccacatgaagtccatcggtctggaataaataaaacgtctgtcatggttgacaggcaaacaaccataagacagtagcaaggggtatatgggaaggcctccgcatcggaagggtgcggaggcctttctatatctgtctctctatatctaaagtgatatctgggatggtatccaacgcacgttatctctcgttactgccgtacttgctgtgcgggtttgcctacgttccgccccaccgtctatactggcgagccggtaacaatcttttctggccgattggcgggcaggctcctcaccttactgatttcccgcagtcggtcacgtgcgcgtccactttgacgcagaaagcaaggtgaacgatggcggaatcgcacgttcaacgcaaactgcttgacatgatgaaacgtcgtattccgacagtgatcgccatcgtgttgctgctggcggtatgggaggcatgggtacgaatagggcatgtgccgtccacgatgatcgcctcccccagtgagattgctcaggcgaccgtcgaaacctggccgacactctggcccgcgacacaggtcacattgctggaaggtaccgtcggtttcctgcttgccgtagcatgcggcatcttgatcgggattctgctgtattgctcccgtgttgcgaacgcggcgctgttcccactgctgtccgccgcgcagacgatgccgctgatttcgatcgcgccgttgttcctgatctggttcggtttcgaaatttccggcaaaatcgtgatcgtggccgtcttcggcctgttcccaatcgcggtgcagacgattcgtggtcttgaggcggtcccccagttctattcggatgtcgcgctgacatgcggcgcgactcgcgcgtggacattatggcatgtgaagctgcgcgtggccgcacggcaaatctacggcggtatccgcgtatccgccgcctatatcttcgccaccgccgccaccgcggaatacctgggcgcacgcaagggcctcggcatctggctgcaggcggcttacaattcgttccgcacgccgctgatcttctcggccacgctggtgatcatcgccatcacctgcgtgctcatgtgcctagtgaacctgagcgagcgtatgctgctcggccctgccagcgatgacgaggatccagacgccggacagtgagcagaccgctctcctccctctacccatcgtgcgtgacgcgatccgcccgcgcagcttgccgttcgattccgacgattcgtcacttggctgccgattcggacgaaatcagggtcgatttcgtccgaatcggcagccatgtgcaccacaacagacaaacgaaccaccaagttcgccatgcgacgtttaccctgacttttctgacgtttacatgaactcgtccggcaataccgcgctttcttacaagaatggaatgcacaagagcaaacgctgctatacgccaggattccggagaaaaccaatatgttatttttgaggcttctgctgttttcgtgggttaggttctcggctgtggtaggcgtatgtcgagtccaccgcatcgggagcatctgagcatgcccctgcgcggacgcacgcggatctcgagcacgggttcgggacgcaatggggagtcggcgatgcgcacgccctcgaccaccgtgcctttgacgttgagaagctggttgaacatgctgttcatcaggcgctttttggctgtgtttttcttggtcgttaaacatcctactcaaaaagcgctctttcttactcccacaacggttcaacaacgaacccgcacccacgaaaacagcaatagcgccgcttttctactccagattcgcgtggtactcccacagggaatcgaggtcgatatcgcgtttgcgcaccatggacatggcgatggcgtcgccgaccagcagcagcgactgctcgaacaggctggtcatcggctgctggctgggcttggtgccactgccgggcttgcctgcggccggcacatggacgaacagatcggtgtactgcttcatcgggcagtcttcaacgatgccgatacgtgccactttggcaccgaaagatttggctttgccggcgatgaacagcgggaatccggttttgcctgaaccggagccgacgatgagcagatccttctcgcaaatggccggttcggtgatctggccgaccatcaccgtgtctacgccgagatgggcgagacgcttggcgatggcttccagcgcgagtttcacgcggccgacgccgacgaagaagaccttgcgggcgttggcgatgagatccacaagtgcgtcgatttgtgcctcatccacgtgatcgagtacgtcggcgagctcttgcacgatgatttgttcgcagtagcggaaagaggtgggggattggatagtgttttcggtaacggttgcggtggtcatgatggtttttccttgcaatatttatatgtgattaacgtcgttggagattagcgcggattggtcgtagtctctccggtggagtgctcgtaggcgtccatggtcagtcgccatgcttcacggatatcgggggagcgcttgaaaatgccagtgttgccgagcacaaaggtgttggcgccgacttcgcgcatggtcttgaaattcttttcgttgcaggagccgtcgatctgaatttcatagttcagaccgtgctcgtcgcggaagcgagccagctgctcgattttcttcagggtctccggaatcagcggctcgccactgtagccgatctcgacggtcatcacggtgataaggtcgatgcgctccaatagattctccacatccgcaaacggggtaagcgggttgatggccacgcccgcaccgcatccgttttcgcggatgatgcgcagtgtgcggaaggcgtgtgcgcccaacgattcgacatgcggggtgagcattgtagcgccggctgcgaccaactggtcaatccaatggtcggggtcagtaaccatcatgtgcacctcgttgcgtagcgtgctcagcggcagcatctgctcgatccaggacgtgcataggcccatgctgggggagaagtgtccgtccatgatgtccacatggtaggagtcggccacggtgttgaggtattcgacttgcggggcggggttgcggaagtcgctgcagtagagcgagatcgcgaaatgggggttagggaatggagccgtcattagtattccttatataaaaagacgatgaatgtgtttttggatgtgttcggccaagggtgcggcgcaattatctttcgctcaccctgttgctgaggaatggaatcgctactgtcggctagtgcgcacggccacgcccatggcggtgagtgcgtcgatgcaatccggcgtgccctcggtcacgatgacgtccagtgcgttgcagtcagcgattctgtaggtggagatgcgtccgaatttctctggtgtgatgaggctcatgaccttggtgcccgccttgatgattgcgcgtttggtttcggcggattccagatacggggtggtgatgccgtgctccgggtcaatagaggagatgccgagcagcactaagtcgcaatgcaattgctgcaaagcggtcagggctgttgaacccacggtctctttggacttgtggttcatggtgccgggcagcatattcacctcgacatggtcgtagtcggacatccacaacgccgcggccggactattggtgatcaccgtgccctcccaatcgtgtgggaaggattgggcggccagatagttggtcgaaccgccgtcaaggaagatcacgcggttttcgcagatctcgtccattgccagtgcggcaagtcgctttttggtgtccgccccgagatcgacgcggttttcgaaacggctgagttccgtatccggtttaatcgcgccgccatgtacgcgctgtacagcgcccctgtcgtccagttcctgaaggtccttgcgcagggtggcctcggtgactcccatttttttggcgaagtcagtgacgaccacacggccgttgtcggcgatgtgcttgaggatgagttcctgtcgttctgccttcatcatgtgggtctcctttggctgggcgtatatggggccgaatcatgctcggcgtgtcgtgttttatgtcccataataacagaggattttcgttatgtatcggttgtgattaaaaattcatttcgactcctttcgtttttgtgttgacaactatcgtaaccttgtgttataactttgtcaacaagcaaaacgaaagacttcgtaagataaaacgaaagctttcaaaatgcttggatgtttcgccgacacaccgcacgcgtagaaacgaaacatcgtatgacaacccataatgaaaacagccgaacgcagtagttcagacaaggaagtacatcatgaagcgctctgagatcaatgccaccatcaagcagttcgaagaactcctggacaagtacaagttccgcatcccgccctacctgtccttcactccggaagagtgggccgagaaggaccatgaatgggatgagattcgcgacaacatgctcggctgggacatcaccgattacggagagggtgacttcgagcacaagggcttggccctcatcaccctgcgcaacggcaatgtgaaggacccgaagtataccaaggtatacgccgagaagatcatgatgagcatgcccggtcaggtctcgcctatgcatttccactggaacaagatggaagacatcatcgtgcgcggtggtggcactgccgtattccacctgtacaatgccgatccggaaactgaagagcgtctcgataccccggtgcttgtgtgccgtgacggtcgccgttactacgtgcccgccggcgaagacatcgaactcaatgaaggcgaatccctgactttctatccgtacacctaccacgagtactacatcaaggaggactccgtgccgacccttgtcggcgaggtgtccatgtgcaacgacgacaacatcgacaaccgcttctacgagccggtcggccgcttccctgaaatcgaggaagacgagcccgcctaccgtctgctgtgcaacgaatacccggcggccaaggaagactgaatctcgataagcgcaactgattgcgcgataagtggcccaacccaatgtgctcctgcaggcgggagccggctcgcgcaacgaggctgagggtggtctggtaatgattgccaagactgccctcggcgcttcgcgtcacctcccgccggtgggaggatgcttccgtagtcgttcgaccgttgccttccgtcaggggaagcattacttttcctttctccatttttctttctggtcttagccccgctatgcccgaaaccatcttcaacctaggattcaccatgcccaacaccaccaaaccatccgtagtcgccgtcggagaactgctgtgggatatgctccctgacggcagaaaaccgggaggcgcacccgccaacttcatctatcacgtcgcgcaaaacggtgtccaaggaaccgccgttaccgccgtcggcaacgatgacctcggacgggaccttgtttccatcctcgccgacaacggcgtcaacgtcgccgctcaagtcaacgactatcccaccggggtcactgctgtcagacttgatgacaatgggattcccgagtacgacgtcgtcaaaggtgtcgcgtgggatcatatcgaatttactgacaatgtacgcgccctggtgcgtgccgccgacgcgatctgctatggcaccattgctgcccgtgaggcatggggcacacgcgacaccatctatcagatgattgacgctgcacgccccgatgccattcggttgtttgacatcaacatccgctccggattcgtcaacaaagaagtcatcacccgattcctcgaaggtgccaccgttctcaagatcaacgacgaggagctgcccatagtggctaacctgttcggtcttgactcgccgggcaaagatatcagatcgcagcagcgagcaatgaggacactctgcgaaatgttcaatttggatgtggcgattttaaccgctggagacgcctacagcattgtgatggggcatgacgaaatctcgattctgcccaccccgcaggttgaagtggcagatactgtcggtgcgggtgactcgttttccggggcgttccttgcctacttgctgcgcggattcgcaatccctgccgctcatcgtcgtgccgttgacgtctctgcgtttgtgtgcagccagtccggcgcttggcctcgctacccgcaggagctaagagagcagcagcctcacggcctgtcgtcgatcggatccggcaatccacttcagtaatcggcctctcgccatccgaggcatcctctcatccggcacatctttaatgaagaaggattcaccatgtcacaacacaacattgttccccgccttgccatcagcgctgcgctcggtgggctgctgtacggctacgacaccgcagttatcaacggcgcaaccacagtcatcaaagaacacttccataccggcgatgccgtgctcggccttgccgtaggatcggcgctcatcaccggatgcgtcggcgcactgctgtcagggcgcatcgcggacaagatcggccgcgtgccgatgatgaaaatcgccgctgtctgcttcctggtctgcggtgtcggctgcgcgttcgcgccgaacatcgaaatcctcgtcgcattccgtgtgttcggcggtttcgcggcgggcatcgcctccgtggtcgcgcccatgtacattactgaaatctccccggctcgggagcgcggcgtgcttggctctctgcaacagctcggtattgtgctcggcattttcgtctctctgttggtcaacgcattgctcgtgcatatcagtggtggtgccggcgcgatgatgggaccaatgatgacctggcagtggatgttcctgtgcatgtgcgtgcctgctttgatttacggggtgctggcattcacgattcccgaatcgccgcgctaccttgttgcgcagggtcgcatggaagaggcggccgtggtgttgaagaagattggggatgccgaaatcaacgtggacgagcaactcgcatccatccgcgcgtctctcagtgctgaccgcaagccttcattccgtgaccttatcggggcaaacggccggctgaaaccagtggtttgggcggctatcggcttcatgattctcaatcagttcactggcatcaacgtcattttctactattcgaactcgctgtggagcgccgtaggcttcagcgaaaagaactcgtttaccatcaccgccatcacttcgctggtcaacatcgctgcaacgcttattggcatgatgcttattgatcgcgttgggcgtaaaccgctgttgctcgcgggatccatcggcatggtcgtggctcaaggagggcttgcaatattgtttggtacggctccgatggctaacggctctcctgtaatgggttcggtgactggccctctggctctggtgtgcgccaatctgttcgtggtggcgttcggcgtgacttggggcaccgtctcgtgggtgatgctctctgagatgttcccgaattcgatgcgcggtgctggcatggccgttgggactgccacccaatggctgtccaactttgtggtcaccgtttccttccctgtattgcttggcgtcaatgtcgggcttgtgtatggtctgttcgctttcttcgcgatggtttcgttcttctttgcgctcaagtgcatgaaggagaccaaaggtgtagcactggaagatatgcaagcttgattgtgccgacggtatggaaagtacttaccctttggcgcaacagggtgtttggcaagggtgcggcgcaatcgcgtagccgacttacggagctcaggctgttgatgattggcgttgacagcctagtgccggattgaaatatcaataatcgttaaggagtaatgaaccgatgagtgtcaataaaaatcaagtaatcaactcaaccagcacacgagccgacatgttggcccacatgggcagccttcagcaggccgcctacgtgcgcccgatcgagtaccaggagggccgtgcccacggccttaaggccatcgaggtgaagaacggcccgctacgcttcgtatccatggccgaccgcgccctcgacatctgccagttcgaataccgcggcgagaacctcaccttcctgtccaagccgggcctgaacggccgcaaccagttcgacaccaacgggctggaggcgcagcgctccatcatgggcggcctgttcttcacctgcggcttcgagaacatctgcgcgccgtacgccacgcctgagggcggcaagtacccggccggcagcttcccgatgcacggccgcatccgcaccacgccggccgagcatgtgggctccgacgcccactggaccgccgaaggcgactacgtgctcgaagtctccggcgaaatgcgcgaggccgaactgttcggcgagaatctggtgatgcgccgcaagatcaccagcgtgtacggccagccgtcgatcacggtcgaggatgaggtgaccaacgaatccttccgcgacgagccgctgatgtggatgtaccactgcaacttcggctggccgttgctcgccgaaggcgccgaagtcgtgatccccagccgcaaggccaccccgcgtgacgagaccaccgcagccgacaccacgccgtggaacgaaatccaagcacccgaggcgaaccgccccgaaagcgtgtacctgcacgagctcgccgccgacgaccacggccgcagcttcgccgccgtggtcaaccgcaagctcggacttggagtcgtcatcgacttcgacgccagcctcttcccatacttcatggaatggaagtcgatgggtgcgggcgactacgtggtcggcctcgaaccctcgaactccagcgtccaaggccgcggctggcacgagcagcgcggcgacctgcatacgctggccccgcagggcaccgagcgcaaatcgctgaccttcaccgtcatcgaaggcgccgaggcgatcgacgcgctgatcgcgcgccgcgacaccctgctcggctgacgccagagccggcgccgatgccgtgacgttcgtttcttaggtattttccgaggcttctgctgttttcgtggattagatcgtgggttgtggtagtcggatgtcgagtccatcgcatctgagcatgaccagggcaatgaggttgttcacgtggcggaagccgtaggccatgcggatggtgaccttgatcctgttgtcgaacgcctcgagcctcgcgctcgaatagcccagctcgatggtcctgaggatgtccggtcggcgccgccggatcctcttcgccagttcgacgatctcgggcatgcgtgaatgcgaggccaggaacacccagtgtctcaactcgcccctggcctgttcgagcgggtgcttgagcagggtcctcaatagttccttgagttgccatgaacggtagagccggccctcgggtccgtgttcctgatgccgtcgagcgcatcggtcatccaagagacgatgtggaacccgtcgagcacgcgttcggcggccgggcaccaccggccggtgcacgggtcgatccagtgggtcccgtcgccggtgacgaccctgatggattcgcgctgtccgggcgtcaacgccttgaagaacaggtcgaacacgtccccgccgtacccgccgtgagcccagatgaccctatgccgctcgtggtcgacgaccacggtcaggtacgtgtggcccttgcggtggctggtctcgtccacgccgatcgcgtgcaggccgtcgaacggcgggggcatcgccgttccgagccgttcggcgaccctatgggcgatgtctcccgcgatcctccacgcgatatgcagaaatctggtgaataagcttttgctcaggcgttcttcgtgattcatttctttggtcggaaaacagaatacgcgggaacgccccttacgcttacggaaccaacggctcgacgacgaactgacatccacgaaaacagcaatagcgccaaaacttgccgttccgctcgtcgatcaagccgtcataactgttccgcacctgaatcatgcagacgcccggaaccttgccgatccgcaaatccgcatatcgttcgcctgcgcaacaccctgcggcctgaaccgcgttctccagcaggttgccaagaacaaccgtcagatcgaccgacttggcaaagtggtccactggagtctcgattcgtgacgtgaaccggaccccagcgcgttccgcctcatacgcgtaatactgcaacagtgcatccaattccggattactggcaagacggtaccgcgtacttggaggaacggttcgtaccatcttggcgatgtaatcacgcaattcgccaagctcgttcttctcagccagcaccgacagcaccgcaagctcatgacgaaaatcatgccgtagccgccgttcggcatcactatgctcccggtagatacggtaagcgcgttcatgcaattcatattggcgattgacgatactcagctcattccgttgacgttggacgagaatgattttggcaatgataagatacgttccaagtttcgttatgaacaacagcatcagcatcataaaattagccggcttcgcagtgctgatgtattcaggttcaggcgtgccgaatcgcatccacaatgcgatggcgctgaatccagccggaaccaaccacaagtaccgccagatataatccgcatcctcaacatcgaacaaatccagcaacgttcttccgaagaatacgaatagtacgcagatcagtgcaatcccaaccagcaagaccgtgagcaaatatcgccaatcatatacccccccaggaaacagatgacgatcgacggcgttgcccatgacagtaaccgtgcccgacaggttcatgaacaacatcagaacaaacacaatcttgcgccaagaatcacgaatcaaaccgatcacaggaaatccccataacaccggcaacagtatcgccatcaacgccatgtacgcgttgtcatcgacatggcgatagcgcaatgagccggctaccacctgaatcaccacaagcaatgcgcatacagcaacggtggcgcgtacgcctaagcggaggcgtttgcggaacagcgtcagcgtgaatgccatgccgggcagacaatcgagcaacgcgaatatcccggccccgcatacgcccacattcatttacctgatccccttacctcaatccatgtcgaatctcttccggcgctctcaaacctccatcactttacatgcacccttcgtctcctccgtccggcaaatatccgcaaaaccatcgtgcacaccatctttgaaaaacatgacccgcacgtcaggccgacccgtataataagatgcgctgtcaagccaatgtgtggcaaaccggcaatgttccacgtctcggcgtcgtatgggaagtcatacgaacgataggacaccacaaggaacgtcgggggcattggacgaacgggggctgggcccttcgtatcgttttctgcccgaactccgtccgcagcatcaatccctagaaaacggtaaagcaacaggattcaagggaaatcgcaaggaatgaagaagacagtcctccacaaagcaatcgcacttctcggcgcaatcaccatgcttgccggcgtcgccgcatgtgggcacagcaacaatgccgacgaatcgggaaatggtctaaaaaaagtgacgttcatgctgtcatgggcgccagacaccaaccacatcggcgtctacgtggcgaagaacaaggggtacttcaagcaggtcggccttgatgtggacatcgtggcggtggcacaggccggcgccgaacaggcggtgaacaacggccaggccgatttcgcgctgtcgaatctgaccaacgtgggcatgtacaccaccaagggtgccacgatcaaacaggttatgcaggtgcagcagaagccaagcgccatctggtgttcgctcgcctcgaacaaggcgatcgaatccccgaaggatttcgatggcaagaccttcgccacgttcggctcgaacgaatccgacgcggtgatccgccgcatgatccagacggacggcggcaaaggcacgttcgacaaagtgaccgtgggcacatccacattccagacgctgtccagcggcaaagccgattttggcgggttctacgccacatgggaaggggtgcaggccgatatgtacggcccgaagctcaactgcttcaccgagccggattatggcgtgccaggcaacgccgacaccatcggcattatcaccagcaacaagaccatatcctccaatccgactctcgtaaggaagttcgtgcaggccaccaagaaggggtatgaatacgcctactcgcatcccgatgatgcggccgcaatcctcgtcaaagaagcccccgacgcgaatctcaagctcgctttcgtcaagaagagcatgaagaccatcgtaaacggccagtactggggtgatccaacgaagatcaaggatggctcgttcgtgttcggcacgaacgacaccaagggcgcgcaacagtatttcgatttcctcgccaaagaggacgcctacaccgattcgcatggcaagacagtacacaccgtgccggtggccaagaacatctcgaccgacgaattcctgaagtgagtctgatgtccgtcaaacgcaagctgattctcgatgtcgataccggcatcgacgacgcgctggctctggcgtatgtctccacgttcgacgacgtcgagttgctgggagccatcggcacctatggcaacgtgacagccgatacagccgtgcggaacacgcgatatgtgctggattggctgggattgcggcatgtgccggttctcgcgggctccacgcatccatcatgggccgattccttcatcgcggacgcgggatgcgcgcaattccatggaacggacggcctgggtggattcgggccggcagcggacccgtctacatccgattcggcgggagcgttcacgctaacatcgcgtaggctgatttccgtaggcggctacaacgtgcacgaccgccatgcgaatccttccaccgattcgctcacgctttcattcaccgcatgcgaccgtacagaaagcacgcctgcctcgccggaaggcgtacgattcatcatcgacatggtccgccggtacggcaggtacgtcacagtggtggcgaccggaccgctgagcgacatcgacgcggcgctcaccgcagcgccggatatcgcggacggattacggctggtgatgatgggagggacgctcacccaagagggaaactgctgggatgcgaccgccgaaacgaacatcatccaggatccggaagcggcggatcgtgtgttccattccggcgcggacgtgaccatggtaggactggacgtcacacaccagtgtctgctgggaagcgacgcgaccgcacagtggcgccagcaggctgcgccgaccggcgtacggacgttccttgccgatatcgccgatttctcgatcgcagcgaatcttcatgcggatgcgcgtctcttctcggcaggcatgccattgcatgatccccttgccgcggccgtcgcattggatccaagtttggtggaatgcttcgatctgccgatgaaggtcgagacgcaaacgggcgatttccacggcacacgcggccgcaccgtcggcgatccggccggcctcatcgacccggccgtgccccgcgtacacgtcgcactgaccgtcgatcataaccgtttcgtggccgacttcacccgtagaatcgccggcatccggcgttgatgtgtgttgttttggacgaaatccggtttgatttcgtccaaaacaacacacatcaacgccgcggcacacgtgcctgctccaatcgatatgccaaaacctgggcgttgtccaaatccctgtagaacatgcgcaccatatctacaccgcgcctacttaggcactgctgtcgatcgcgttcatcatcgacgacctgccgaatggtccgccccgcagtcatcaacggatccacgtacttctgaaccccgtcgaactcccccgcgatcagggtgccgtcatctcgttcccagagaaaatccacccgatgcacacggcctggatggctcaggcaggggaactcgacctgaaccctatgcacaggaaaccccaattcgtccaaaacggcacggcactccgactcaccaccgttttcaacccttccatcaccttgggcaagtacggcacgaatgcgttccctgtcccgaagcatgggaatcgcatccacatattccaacatctgctccacggtggttttcccctgccgcaaagcggaatcaatcggcgccatcgcatagcgacgcggcatcatcgcagcgcaatcgacaagcgtacgaaggatagaggtcacgcgcgcaccatccacagccaccgtttccgcatcatccaacacatggaacctcacatacctctgattcctcggacggctgtttctgccaaccgcgacatgaatcggatgcaactgccggtacgagcaatccaaaccatgcatgaccgccgcgctcgcgccgcagaacgcccatcgctcatgccattgggatagcgaacggagaatgtgccgaagccgctcatgcgggtcgagccgatcccaatattccttgcctgcatacagaccacgatgcacccggacaatgctcccctgcttgactcgacgtacgaccaccttgatgtccgtatcccagaaaggacgcatgcaacaccgatcccgctgcgccttcgcaatcaggagattcagagaacaatgagtttccttttcgcccatccgtgcagtttagcggatgttggggaaaaaggaaaatgtgtgcttattcggacgaaaaccggtctgttttcgtccgaataagcacacattgacgggaacaaataccccctacttcttcacgccaccgaaacgacgatcgcggtggatgtagtggtcgatggagcgccacagcacatcacggccgcaatccgggaacagttccggcacgaagtcgagttccgcgtaggcggcttcccacggcaggaagttggacgtgcgctgctcgccggacgtgcggatcaccagatcgcagtcgggaatatccgggttgtacaggtgctcagcaatcatcttctccgtcacgcgatcgccagagatcttgccgtcacgaacctcgcgtgcaatcgctgcgcacgcgtccgcgatttcggcgcgaccaccatagttcaggcagaacaccacgtcgatggtcttgttgttcttggttttctcctgcgccacttccagctcgtcgatgacggatttccacagcttcggacggcggccggaccagcgcacgcgcacgccccactcgttcatctgatcgacacgacggtggatgatgtcacgcgagaagcccataaggaaacgcacttcctgcggcgaacgcttccaattctccgtggagaacgtgtacagagacaggtaacgcacgcccgcttcgatggcgccggcgatggtgtcgaacaccaccggttcggccgcctgatggccgtcggtgcggatgagtccgcgctgctgggcccaacggccgttgccgtccatgatcacgccgacgtggcgcggaaccttgttctttggaaaatcgggaatgatcgacggatcagaaaacggtgccgccggaatgtcaagggatttgtaatccacgttctcaaaagccatacccgctaatctagcaagcgcatggaacgaatcggccgttccaaatagtattcgccccattcttccactatttggtgggtttcccgttgaatcgacgcggccgccggaacaccgtccagctccccccaatcgccatcgacaagcgccgaaagccggcaaatcgcatcccacgacaccgcttccgattcgggggtgtggtcggcgacgcacatcaggccgccggcgggaatcgaaaaataccaggacagcgtggacgaaatcggctcgccgcacaccacgcagacgcgcagacggggtgtccaaccagcgatcgccagtgcgcgcagcacgtacgaatcgccaatcgtggacggctcgtgcgcatgtttggcaagcgcgttcaacgcgcccaataccagccggtattgtgcgaccgcaggctccttttccgtggcgaccagcttgtcggcggtttcgcagatcacgttcgccgccgtatacgcttgaaaatcggcgcaaatcggccctgcatacgcggcgatcgattcggcttgggacacgacgtcgagcgaacggccttccgcaatgagcagcgccacgcgcatgaacggttcgagtcggcctccgaaacgcgatttggtacggcgcacgcctttcgcgacggcgcgtactttgccatggtcacgtgtgagcaaggtgagtatgcggtcggcttcgccgagtttggcggtgcgcagcaccacgccttcgtcttgatacagcggcatcgcacctccttttcttgccgttcatcgcatcctgttatgcatacgctcgccgcacgtgcgcgttccgaaatacattcgccccgtcagtagatgaacagcccccagaacgcgaacaccagcaatacgcagaacatggcggccacggtcagccagaacatcacgcgtccgaaccgcgtggaagccagcaccggctgccgtccgctgacgatttcgccgatagcacccttacgtggcggccactgcgcgatgcctcgatgggttgcctcttcgatcagccgcatgaacacgcgggaccatgcccacaccacggcgacgcacacgatctggatcaccggccagctccaatacatcacgcccggattctccactggggcactgccccatgccagtttgaccacacccatgatcacatcgccaaggccggcgcagaacagcacgaacgtggccatagtggcgatagtcaacgtgaccagcgagtttttgaacccttgcgcaagccccagccgataccgtcgtccgtgggcacgcgcccagatcttacgcatcagcacggcgagccacagcacgcctgcggcaagcagcagcaccagcatgctggcatgcaacgcgaccaggtagatggtcaggccgcgattggctttgaggtccaatggcactgcgattgactggtacattctggtgccggccacgcgttcgctggtctgtttgagtccgtgcgtggtgccgacggcccagtcgaccacatcgtccacgtacgcgtcggcgaacggggttccggaattggcttcgtcgccgagcctcagcacatggttggcgatggggtacgtgcgtatggtgacgtcccagttgccggcctggtgagccagatcgacgattttctccgtgccttccacctgcgcggtcatgacgtctttcgtgccatatgccaccaatgtcggaatggcatacgctttcggcgtcaacgtgtcgatgtcgaggttggtgagtccgaacagggacgcgtcgatattgaatacgcggcggacgatcgactggtagccgtcatgcgcgccgacgagcgcgaagtcctgtgcggcgaggaagcccagcgaataccgcggctcgtagaccatcggactgagcagcacctgaaaagcgacgtccggatcgcgctgcagcagatacgatgagatccatgtgctttcggaagtggcgtagatgcccactttggaggcgtccaccgtatccattttccgcaggaggttgatgacctggtcgtagatggcggcggaacccgggtagtcgcgattggcgtcgttggtggaccagaccggcttgtcaagcaccgccgtcacgaatcccgccgaagacaggtcggaggccatgtcgccgaaggaattgtcgcaggtgccatagccggcgccgtgcatgaaaaccacgccgggacgtccgttcccagcccctttcggtttgcggatcagcactttgatgttctgtatctcaccggtggaaggccgtttcgctttgatggtgacgtaccgtttcgtcacctcgtaatcgccttttttcgccagtttttcgccggatggattggcgaaggtcacggcggtgttggcgtcaagcgtttcgatggtctgctcggtcggctcgtagttccatgtggatgccgtcagattggccacggacaccagaatgcccagcagcatgatgaaaataggcaggttgaccatgagccgccgcccgcgcgtccacggttgatgttgcggttgcggacgcgcgggcgatgaagccgattcttgccgtaatgattggctggcggctgatgattgacgttcctgctctgacacgccgctcattctaccggcctttgctgagaagcctgcgattgcatgctaccgacggcacgctggaacatggctttcagcagttgccgttttgcgtcaccggcacgaccaccggaccggtggcggtggcaggcacctggccgtcggcctccatctgcgcggcgatctcctgcgccttggcgagcagggtttccacgatctggtcttccggcacggtctggatgaccttgcccttgatgaaaatctgccccttgccgttgccggaggccacgcccaaatcggcttcgcgagcttcgcccggaccgttgacgatgcagcccatgacggccacgcgaatcggcgcggtcacgtccttcaacccttcggtcaccgcgttggccagctgaatcacgtccacctgggaacggccgcaggacgggcaggagatgatgtcgaacttacgcgggcgcaatcccatgtattccagcagcttgcagcccaccttcacttcctccacgggaggcgcggacagtgaaacgcggatcgtatcgccgatgccttcggccagcagcgcgccgaatgccaggcagcttttgattgtgccttgccaggtcgggccggcttcggtgacgcccaaatgcagcggccaatcgcccttggaagccaacagacggtacgtctgcaccatggtgaccacatcatggtgcttgacggaaatcttgaaatcgtggaagccgacgtcttcgaacatgcgcgcttccttcatcgcggacgccaccagcgcctccggtgtcgggccgccgtatttggcgtacagctccttatcgagcgaaccggcgttcacgccgatgcgtagggaaatgcccgcatccgtggcggccttgcagatcgaagggccgacctcgtcgaatttgcgaatgttgccggggttcacgcgcacggccgcgcagccggcgtcaatggcctggaacacgtacttgctttggaagtggatgtcggcaatcaccggaatcggcgattttttgacgatttccggcaatgcgtcggcatcatcctggcttggcacggccacgcgcacgatgtcgcagccggccgcggtcagttccgcgatctgctgcagggtggccggtacgtcagccgtcagcgtattggtcatggattgcactgaaatcggcgctcccccgccgaccggcaccgggccgaccatgatgcggtgggacttgcggcgcggatgcagcgggctttcgctgatggccgcgtcaccggttttgcggaacggtttttcgatttctggcatacgtgatccttgcatgtgcgaggcgcgttatgcgtcccgcgatggttcttacggcttgtgctctttacttgtttatcagcttgtcggcgcgggcgcgagcctcctgctcgagtcggctcatttcctccacggaagcgaacagcgggttgccgcgcagttcggcgtccatctcgtcaagcacttcgcgcacggtgtcgacgatgccgaggtatggcagacggtgttcgaggaacgcgtggacggcctgctcgttggccgcgttgagcacggccgtatgcttttcggacgattcgaggcagtgccgggccaggttcactgcggggaacgcctcgttgtcgagcggctcgaacgtccacgtagccgccttcgtccaatcgcatgcggcggcgacgtttccgagacgttccggcgcggacaggccgagggcgatcggcaggcgcatgtccggcggcgaagcctgcgcgatggtggcgccgtcgcggaattccaccatggaatgcacgatggattgcgggtgcacggtcacgtcgatgcggctcggtggcacgtcgaacagtcggcttgcttcgatgacttcaaggcctttgttcatcagcgtggacgagttgatggtcacgaccggccccatgttccatgtggggtggttcaaggcctgttccggcgtgatgtcggtcatttggtcgcgcttccagccgcggaacggaccgccggaagcggtgacgacgagcttggacacttcgccgtgcgtgccggaacgcaacgactgccagatggcggaatgttcggaatcgaccggattgatctgcttgtcgcgtacctgcgcgctaaacagcaggtgtccgccggccaccacggattccttgttggccaatgccagctgggagcctgcctgcagtgccgcgatggacggttcgaggccgatggagccggtgatgccgttaagcaccacgtcggcgccggagcctgccatggcgatcaccgcgtcagggccggctgtgatgttgacgttgcctgcgccggcctgttccaacgcctcacgtagcgcggggacggcttccttgtagaagatcgcgacggttggcacatggaatttcgccgcctgctgcgcaagcagttcgacatgtgctccgcccgcggcgagacccgtcacggtgaagcggtcgagatgacgtgagatgacgtcaaggccttgggtgccgatggatccggtggagcccagaattactacggttgatggttgcatgggttatgcgctgctctccgtatgatatgccgatgttccggcattggtttggactatgtaagttgggactgtgtagtcgaggctgtgtagtcgaggctgtgtagttgggattgtgtaaacgcgagaacaggctgacgattccgccagcctgtttattaccgttggttcactcgaaggacgggaacgacagatccggaatatcgagattgtcgtcgttgcccgacgccgggaaaatcgacctgaaagccgggcttggttccggctttttgtcctcctgctgcttgtccgcatcggattcggcggacggttcagttgccggggcaactgccggttctacggcaggttcagccggagcggccggctcggccggagcctgttcaacaaccggagccggagtgacaattgggttcgaatccggaaccggagcggccggttcaggcgtgaaggatggcggcaccgaggctgcgagggagctcaggctcgtcgaaccggtggtgacctgaggcaagtcggacgcggacaggctcggaacctgcggcgtgaacgtgttttccgtctggttcgtctcattgatggtgtgggccagatgcgccaacgcggccaaagacggatcctgctgcggctcgggttcaaccggagccggcgggaatgccggagcggctggagcctgcgaatcggtcgcggtcggagccggagcctttggcgcggcatcttccatcgcatcatcggcaagcggatcgaacgcctgggtctcttcaacggcgctcggcgcggaagaagcggaatcggtctgcggctggaacaccggaggaaccaccggaaccgcaggcggagtgttcgtcggcgtggcaggcacgctcaccggggaggtgaccgcggacgtgaagatctcatgctcggccttgttcagcgcatcgaaggaatcctcttcgctcggcgtgacggttggcacagtaggaggaaccggagcagccggaaccgtggcggaaggagctgcgaacagcggtgcgatcatctgggtttcgccagctgcggaatcactggaagccggggcaacggacggtgcggccgcggccatcgcctcttcggagggttcgccgacgaaatccgcgacgcgcgcatacgattcgagtcgggtcagcaactgcgcgcaggcggccagatagtaatccacctgacgttcgtcgtatcccctcttgcctttgcgctgagtgaagatcacgttgctcaaggtctgggaattcgtgtcggcgatcgccttggcgtccgcttcactgacttcctcgacacccagctcgccggcggctttcgtcaggcacttgtcgatcacgctgtcgacctgcttgcggtcgtagctcggattcttgccctcgcccggcttgaaccgttggccgtgctcgcgttcggcatgcgcgtcgagcttcttgaacaggtcctcggtctgcgccttccatgccacacggccatgctgggagatttcccacgtggtctgcttgtcgaccacggcacgttccagacgggcaagcgcggcatccacttgggcgatcacatagccgcccttgaccagttcgaaggagacgttctgaatatcatgctgggtgagttgcgcgccctcaccttcatacagcatgtgcgcacgttcaaggaaagcatccacctgttccgcatcgtagccccactttcgcttcgcggcatgagcgattcccgatgcgttcttctcggtttcaggttcctgtgccattggcgttcgacctcctgctacacgtattaacgccactactttacgtgattgattcgacgcagacgccgcaaaagatgaaaattcagtgaatcgacacgtgcggctcatcgcccacacggcggtttcgtaccgatcaagcggcatcatatccgccatgccgacacacgagtgcggctcatcgcgcggatacggtacagtagttcgttgcgggcgattagctcagttggttagagcgccacctttacacggtggatgtcgggggttcgaatccctcatcgcccacttttcgcaacgccgtgaaaaatcaaggaatcgcatatcatcccgcgtaatatcaacgcgcgcacccgtgttttgcccacattccgcccacgttttgtttgtgttttgccggaaagtccacgtaatagcgaaatcccccaaacccaatgggctcgggggattttcgtatacgcgagaaaaatcgcgaaaagtcttggtttacttgcccttgccgaacgcgcgcaggtgaataccgttccaatcggagctgacggtcagcggagtggcggcattcatgccggcggtcttggccgcggactgcacggtgctggagcttgcggcacccggacgtcccggcttcggggtgagcacccacagcgggccgtcatcgccgagaaccgcataggcgtcgacaatggtgtcggccagttcgtcctcatcatcgccatcacgccaccagatgatcacaccatcgactgcggagtcataatcctcgtcgaccagctcctcaccggtcagttcctcgatcttggcgcggatcgagtcatccacatcatcgtcccacagccattcctgtaccaggtcgccggcgtggaaaccgaattcttcagcgttatcagatgccgtttgattcacgttcgtcaatataccaacactgctcgaacatatacgttacgaacgccggaatcgcccacttttcgagatgaaacggcgatttccgcctgtatcacgcctatctccttccgccgcacgctcattgcttgacggtgcattgcggcagtgaaccgcctttaccatcgcggatggcgaccagcgcgtcgtacgcctcgtccaacgtgcccaccttcaccacgtggaggccctgtggcacgtgcccgaccacgtcggagcagttggattccggggcaaggaaccacgtggccccgtcacgcttcgcgccgatcatcttcaaccggatgccgccgatcgcgccaaccttgcctttggcgttcatcgtgccggtacccgcgatggtcttcccgccggaaagctgctctccggtcaccttgtcgatcagaccgagcgtgtacatcatgcccgcggacgggccgccgatgtcgtcgacgtgcatggacaccttcataccggacacgtcataaccgtgcgccttgaggaaccgcttcgcggccgtggccgcggcgctctgcgatgaggacatctccttgttgctttccttcgcatagtccttggcgctttgtccgacggggaacacggcctcctgcggaatcaccgtggccttcggattggcccatgccagcaacgcctgcgcgttggtcacaggatatccgggaacgcctgaggcgttgacggtgacgagcagtagtttgccggagtccttatgcgtcttcacgccggacacgtcgatgacctgcttgccttcgacttttccgagcacgtcctgggtcggtcccggctcctgcaccacgtacgcgctgggcgcaataagcaccagcacgcagagcacggccacaatcggtccggcgagatatcgccaagggcgaacatcgaaccaccgtccgacctgacgccaacgtcgtctgatacgtggcagaaggccttgagacgacccgttacgtgtgcttttggcgtgaactcgctgtgtttcctgcatatcggccatgcctcccatactatggaaggcaacgaacttaacaatcgcgtggaacaaaggcaggaaacggtatggatgagaatgcgatccgccagtggcttatcgattgcttcggaccgattcagggcgagatggcatggaaccagctttccaacatgccggaagccgtacgcgaccagctgatgagtcaggatccgagcacgctgcccaagcccgaagaggtcaagtccatgatgcaggcgttcaccgccggcggactcaacaccatgggagatatgcagcaggccgtggaacaggggccgatcaacatcaaactggcgaaatcgctcgcgttgcagcaggcgaatggtgccggatcggacagcagcgtgaacgccgaaaccggcgaaatcgcaagacgtgccatcagcgaggcgaacctgtggcttgataccgcttgcgagttcaacccggcgcaaggcgagacgcagctgctcacccgcgccggctgggtggaggacacaatcgacgcgtgggcgcagttcgcctcccccgtggccgaatcgatgaacgacgctctggcttcgattctgtcgcagcgtttcggcgacggcgaaatacagaccgagatttccggggttttcgcaggccccatcgaaattccgattccggacgagatgaagaatccggcgaagctgatgcgattcgtcggcaacacgtcgttcgccatgcagttggggcgtgccgccggcgacctgtcccatgaggtgcgcggcagcttcgatcagggcatcgcgctgctgaagaatcccgccggcggactgatcgtgcagaacgtgaccgaatacgcgaagtcgctggatatcgacgtgaacgaagtgatgggctatcttgcgctgcaggagcttgcgcatgccaggctgttcgcctccgtgccgtggctaatgccccgcttcgaggcgctgctgggcaaatacgcgcgtggcatcaccatcgacatggatgccatggaggagcagatccgtgaggcggagtccatcgatccggattccatggccagcgcggtgaacatcaccaaggtggcgttcccggacactccggagcagaagcaggccatgaaggcgttggagaatctgcttgccttggtggagggctgggtggatgccgtcgtgtggcgtgcgggcatggcgcatattccgcatatcgaacagcttcgtgagatgttgcgccgcgaacgcgccatcggaggccctgcggaacgcacgttcgaaagcctgatgggcatgcaattgcgccccaagcgcatgcgtgaggcggccgcgctgtgggaaagcatcggcgcgcaggaaggccccgaggcgcgcgacgcgaaatggtcgcatccggatctgctgccgcaactgccggacgagcagtccgaggatagctccaacgaagagaacggcgccgcatccgccactaccggtacggaacagaccacggcgcaacaggatattccggacagcatcgattgggatgccgaactgtccaagctgctcgacgaggaagagcacaagggcgatgacgccgacagcacgaacgacgccgacggcacagatgacgccggcgatacgaacgcttccggcgacccgcagtcaccggaagaagcgtgatttcctgcgcccgcgatcggacccatcgtcctcgcgggcgcgcgcataggacacgtcgagcgtgtcttcggcacgcgtgaccgccacgtacatcaatcgccgttcctcttccagaaggtcgccttcgggcggtgaaccgtatggaatcagcccttcggagcacccgatcaggaacacgtgtttgaattccaggcccttggaggcatggatggtggagatggtcacgcctttaacgtcgccgcctgcgccaagtgcttccaacatggccaagcgggtctgagcgtcatccgcgagcccggagttctgccatccgctgtctcgtttgacgcggtagcgcaggtgttgttcgtccagtgcccggcagaggattttctgctgcgcgttgactcgggtgaggatggcgcagtcgcccggagatgctccctcgtccacgagtctgcggatgcgtgcagccacgccccgggcttcttcgagatcgctgttgtagacggtttgcgcgactcggcggccttggtctcgcttggagttgagtttgagatagtcggcgcgttgcggtgagacttcgagcacgcggttggcgtagttgacgatctgcggggtggaacggtagtcgttgttgagtctgacgtcggcggtgaggggtccgaattcggaggcgaagttgagcaggttgtagctgctggctccggcgaacgagtagatggtctgtgccgggtcgccgaccacgcagatgttgcggttgtcaccgagccatcgggtgagcagccgatgctgcaggggcgagacgtcttggtattcgtcgacggtgagccatgtgatgccggagcggatgttggccgccacgtcttcgtcgctttcgatgaggtggcaggtgatgagcaggatgtcgtcgaagtcgatttcgttgcgattggttttttcggtttcgtatgctctgtagacgtccacgaattggcttggttccagtcctgccggcggctggtggtggatggccgcgcagacgcgttcatagtcttccggcgcgatgagcgagattttgcaccagttgatttcggcttgcaggttgcgcacggtgtcgtcgtccacctgctgggtggtgactcggcgtagggaatgttccacgatttcgcgcggattgcgtgagatgaacggcatgggcccttcgcatacgtctggccagatccgacggagttggtgtagtgccgcggagtggaaggtggcggctttgacgtcggatgcgacgtcgagttgggatagtctgttgcgcatttccgcggccgctttgacggagaaggtcacggcgagcgtggcgcgcggatcccatgccttggtggcgcatgcgtaggcgattcttcgggtgacggtccgcgttttgccggcacctgcgccggcgatgatacagacgggaccgcgcacggcggtcgccgccatgcgctgcgcatcgtccagtccgtcgagaatcgcttccgctgttgcatccatatgctccattgtggcagattgcgtgacgagacggacgccatcggcgcgattaaccgtgaattcgtggcaagtcgcgcccttattagccttcagtgtgtattaaggttggaattgtgaccgaacgaagcagatttatgatggccgccttggcgagcgcggcgatgccgaacgccaccatcgctggcacgcgtgacagcgagcaggtcaacgccaccgacaaggggtatggcattgatcatgccgtggtgcaggacgccgcgggcaagttgtatgacacgttcgcttcgaacacaccgaagggacgcaagcgtctcgttggtcgcgtgcgtgccgcgcagacgttgatgggcaaccgcgagttgggcggattggggttcgacgtcgatcgcgttctggcgttctccaacggcgaacaggagaggtccgtcacaggagacgtttccgtaatggtcgccacgcatcatgatggtcaggcgcgtccgctgacgctgctgacgttggacgactgtgccagcgtgggcaccgcgttgggcgcgatacaccgtcttcgtccggattttctgcaggaggccggctatccggtgttctccacggggcagattcgcgcgcagctgaccgcatggatcaagcgtttgcgtcaggctggccatgtgccgcaggagatcacgacgagctggtccgacgttcttgaaacggacggtctgtggtcgttcgccacttgtccggtgcatggtggcctgtccgacggcgatgtgctgttctcgggctcgtcgatcaccgccatcacgaactggcaggatatgcaggtcaatgatccggcgcgtgatttggcgtggattttctccaagcttgacgagaaccaccgtaatgcgctgctcagcgcgtatggacgcatgctgggcaatcgtctggatgatctgatcatgctgcgtgccaacctgtggctgcagatggaacaggtgggcgatttcatcagcgcgttgaatcaggccgatagcgtcaagatcatgcagttcaaggcgcaggtggagcgtttggctcaccagttgggtatgctcaccgcgaagaaccacaggccgagcgagacgcgtcaggacgagcagaaggccggcaaccgtccgccgagcaccatcaccgtgggcacgctgctggacgaatcggaacgccgcaggcaggcggcggcgcagcagaataacgatgccgacgcgaccggcgaacgtcatatcgacgcgaccgatatggatgatgacaggaccggcgatttcgatgtcaccggctcccagcccgtccgtaagacgaagcaggtcgtcgatgacgccacggaagcgttcgatgtgaccgccgccgaacatatcacctccgccggcatggtttccggcaatgccgattcggacgatacgagcgaacgtgaggaatcccccgtcagcacgttcgttccggagcagtccgcgagggagcgtcacgagtcgttgccgtccagttcaaccattgtgatcagcacgttgcagaccgccgatggcagcgatgacacgaacgaggaggaaattcctcaagcccatagcgaagcggcgaccatgctcattccgctgctcgaacgcgatgaggccactatgcagaaggccaaagcggaggtcgaccggctgcaggccgaggacgccaccgatgagaaaccgcgcgtagaataagcgcatacattgcaaacgaatttgcacacgaacacccttacaaggagcatcatggatatcgaactgggcattcagaacgtggcgcgcaccgtcaccttcagcaccgagcagagcgccgacgaagtgaacaacgtcatcgccgaggccgtggagaatggcaagaccatcaacctgaccgacgacaagggccgtcgcatcgtggtgccggccggttctctcggctatgccatcatcggttccgaaaccaagcacgccgtcggcttcggcaatctctgatcgccaccaacaaacgcgttggacacgttccatatgaaaaagacgtcggaccatatcaggttcggcgcctttttcatattcgattcatgtatccggttcacgcttggaaattccatatccggatttcatgcggcatgtgagctgccgacgcgaccgatcaaatccacaccccggcacaagatttcgcgtacggtgtcgtcgtcggtaaggttctcgcccagaccgttcggcttgcctttgccatgccagtccgagccgccggtcaccagcagatcgtgccgtgccgcaatcgtcagcaatcgttcccgctgttccggaggattgccgcgatgccatacttccaagccgtccaagccgtcggcgatcatcgcgtcaagctgctcgtcggacagcagccggcggttgcgttgcggatcgcccgcatgcgcggcgaccaccacaccgcccgcccccttgacggcggcgatgacctcgtgcgtcgacggcgacggcgtgggaatgtaatacttggatttggcgctcaccgcgtcggcgaacgcgtcggaacgcgtctcgtacacgcccgccgcgaccagcgcgtcggcaatgtgcggacggccgattgtggtgcgttccccttccttcacttgggcgagcacatcgtcccacgtaatcggaaaatcctgcgacagccgctcaaccatgcgtttcgtacgccgcaatcgcgccgcacgcgtgttggcgaacatgctggaaatatgctcgttggacggatcgtattggaaggcgagcatgtgcacggacacatcttcgtcgacggcagtgatttccgtgcccagcagtaacggcaaaccgatttcctccgaggcttccgtcgcctcgccccagccggcggtggtgtcatggtcggcaatcgccacaccatgcaagccaagcttccttgcctgctccaccagcgtgcgcggcgtctccgtaccgtcggaaaagacggtatggcaatgaatatcccaaccttgtgcgggtggttccgcgtaactcacgtgactcatatgactatcgtaagctcgaatccgcggtttttcgcgtagactgagacatgacaacgtttgtattttgattttccaaggattgacgatgagcgattttgaaagccaggccgctgtggacgcagccgatgacgaaacgagcgtcggcacagccgtcgccatggacgacgactacacgaagccgcgcggatggcgtcacggcgcaacgtggacgtatctgatcatgctgctcgcttcggcggtggcattgctcgtatcgttcattctgtcggcggacacgctgaaaatggcacgcaatcccgggcagaagctcaactgcgatgtgaacgccgtgctgtcctgttccacggtggccgaatcctggcaggcggaaatcgtgaagttcgccggattgagcttcccgaacgcgttcttcggcattgccgccgaatcggtgttcgtgacgatcgcggtgatcggactggccaagatggccgtgccacgttggttcgcgctgtgcacgtggcttggaggccttgccgcgttggcgtattcgtattggctgaccacgcagtcgctgttcgtcatcaacgcgatgtgcccgtggtgcctggtgctgatgttctccaccaccgtgcagttcatggcgttgtcgcatgccacggtggccgtgcaggatatgccgtccggccatgctggattgcgcaagtattaccggctgaatttcgatctgatggtcgatgtggtgtggattgtggcgttgatcgtggtcattctcgtcaaggacggcccgatgctgttcgcctgatacggtttgcatcgaaccttttacgatgaaggccgaccctgcgtggccggccttttgcctatccgcttttcgtttgctgccgcagcggttacagcagttcgattttgcccacgatggtggcgctgccggtaagcttcacgtcttcgtcggtcacgtcaacacgcaaggtgccgccacgtacggtgatggtccaatggtcgatgccggttttggcacgcaacgtgatggcggtggcgcataggcccgtgccgcacgacagggtttcgccgcaaccgcgttcgttgacgcgcatggtggcctcgcccgcatcgtcgccttcgctttgctcgtcgatgcgcacgaactccacgttctggtccgacggaatctcgggcgcgacgaccggcttggtgaccagatcaaggtcttcgacgttcggcaggctggcgaacgcgtcttcaagtacggccacgacgtgcggattgcccatgtccacgaacgtgccacgtgcggaaccggacgtgcccggaatggtcacttcgtaaccgtcgacgtcgccacgcttccatgcgcccatctccacctggaacacgtccttgccaagccctggcacatcgccgagcgacgtcaggaccttcacgccggcgcgggtgccgagacggaacggcttgccgcccggctggtcggcgatgccctgccgctgcgcgaacaaggtgatcgcacgtgtgccgttgccgcacatctcggccagcgagccgtccgcgttgcggtagtccatgaaccagtccgcatcgcccgccgcgcaatcggcgatctgcctttcgttcacatcggacaccgcctgcagatgcgccagacggatcaggccgtcgccgccgatgccgaaatggcggtcgcacaggaatcgcacttcatcggcggtcggctcgtgcgtaccgtcttcgtcgagatacaccacgaaatcgttgccggtggcgtgcgctttgtaaacaatgcttggaatgctcataccagttcactctacacgcggtaggctattgaaagcgtttggcgtatgcgcctgcgggcgtatgcgcgatggcaaaggaggacgtatggcttcaacggcacctatcggcgttttcgattccggtttggggggcatttccgtggcgcgtgagatccgccgcgacatgccgaacgagcatgtgctgtatttcggcgactccgcgaacgctccatacggcacgaaatcgcccgaacaggtgcgcgaactgtccgacgtcattgtgaaacgattcgtggaacaaggcgtgaaagcggtcgtgatcgcctgcaataccgccacttccgccgcagccaacgaactgcgcgacacatacgacattccgatcatcggcatggagccggcattgaaggtggcttgcgaccgtggtcacggcaagcgtcagcgcgtcatcgtggccgccactcccctgacgttgcgtgaacgcaagttcgccgtgctgatggaccgtttcaaggccgaccatacgatttttccggagccctgccccggtctggtggagatcgtggagcatgggcagcttgacgaccatgatgtggtgatgcgcacgctgcaccagtatttcgaccaatacgatctgtccacgatcgactccgttgtgctcggctgcacgcatttcgtgttctaccgcgattatttccgcgaactgctgcctgatacggcggcgatcatcgacggcaatgaaggcaccgtacgtcaccttggcgtggtgctcgaatcgttgggcaagctcgctccggaagacgcggaaggcagcatcgatctggccaattccgacacttccgcacgaatcgcgcagttggcgcagtcgctgcttgatcgctgagcgcgaatgtcccgacagaccgcgtaaagtcgaatgaaacccggcaaaagggacggacttgcgaaaggacgggcgcatatggccaacaggacagcgatgatcgacgtcggcggcggtttccgcgcgatttacggcgcgggtgtgatggaccgcatgctggaggacggcatacatgtcgaccattgctatggtgtttccgccggcagcgccaatatggtttcctacatttccggacagcacgggcgaaaccacacgttctacacgcagtacgcgttccgtaaggaatacgcgagcttcgacagctatgtgaagaaccacaattacgcgaacctcgattatgtgtacagcacgctgagcaaccacgatggcgagaatccggtggattacgaggcgtttgcggcgaatccgaccgaattcaccgtggtggcctgcaatgcggacgatggttccacgaagtatttcgacaagtcggacgtcggctacgacaattacgacatcatgaaggcgtcatcggcggtgccggtggcgtgcgaaccgtatgtgatcgacggcgtcccgtattacgacgggggcatcgctgatccgattccggtgcagaaggccatcgatgacggctatgaccgcatcgtggtgattctcacccgtccgaaagacaccgtacgcgaacagaagaaggacatcggcccggccacgatcctgaagcgcacgcacccggaggccgcggaaaagctgatgaaccgctatcagacgtacaacgacgaggtggcgttggccaaggaatacgagaaggatggccgtgtgctcatcctcgcgccggaaagcatgtacggcttgaacacgctgagcaagtcgttcgaaggtctggaacgcatgtaccgcgccggctatgcggcggcggccgcgattccagcgttcctgggaagctgaaatccgttcttccgcagcgctgtcatgcgtttccaacggccctaacggcaaccgtatgacagtgatcgcatgacagcaatcgcacatacgacgattacatggcagccgtcatatgtgcgttacggcatcgcaacacgcgtaaccggggcggcggctatgctggaacgcatggaaaagcagaatcgtattttttccggctttgatgccgatgccatcgatcgcaccaccgccgcagatctggccgaagtcggttccgacaagtggacccgctaccccggctgtatcggcgcgttcatcgcggaaatggactacggactggcgccgtgcatccagcaggccatcgacagcgcctgcgaccattgcaaactcggttacattcccgaaccgtggaagcgccgcgtggccgaggcgtgcgccggctggcagaaaagccactatggctgggacgtggatccggacatcatccgcgtggtgccggacgtgttggaagcgtacgagatcttcctgcgcgagctggtcggcgccggcaatgccgtggtcgtgccgacgcccgcgtacatgccgttcctgagcgtgccgaagctgtacggcgtcgacgtgatcgaaatcgaaatgcttcagggaaccgacgaaacgaccggcgagcgcgaatggctgttcgatttcgacgccatcgaacacgcgttcgcggctggctgccatgcgttcgtgctgtgcaatccgcacaatccgatcggcaaggtgcttacgttggccgaggagcagcggctgtgcgagctggcggaacggtacgacgtgcgtattttcaatgatgagattcacgcgccgttcgtgttcgaggggcgtcatattccgtatccgaccatcagcgaggcggccgctcagcagtctatgaccgctaccagcgcgtcgaagtcgttcaatattccgggtacgaagtgcgcgcaggtgctgctgacgaatccggcggaccgtgagatgtgggcggaacgtgcggagtggagcgagcatcagaccgccacgatcggtgcgatcgccaccaccaccgcctacaacgagggcgatccgtggttccaggacgcgctttcctacgtgcgacgcaatcttgggttgttcgatgagcagatgagcacgcggttctcgggcgttggctatattcgcccgcgcggcacgtatatcgcatggctggatttcggcccgcttggcattgacgatccggccgcgtatttccttgagaaggcgaaggtggcgctgaccgacggccgttcgtgcggccgcgcgggagccggctgcgtgcgcgtgaacatggcgatgccgtatccgctgctggtggattgcctcaaccgtatgcatgacgcgttgcaggcggacggtttgctttaaagttttccgtctttcgtgtgtgaccgacgctatgggcggccacacacgccatattgcgggaaaatccgccgaatcattgcgattgcaacggttgcgctatgggcgaatagcagcatgttacgatggccgcacaccaccgtcggtggacgcgcgacgcgaatccagcgtatgcgtttcattgagaagaaggctttacgaatatgcgattcccctacagcggcaacggcacatggacgcccgactaccactgcggtttcattgatgccgtcaaacgttttttcatcggctacatggagtttcgggggcgttccagcagacgcgagttctggctcgccatgctgttcttcattccggtcagcgtgctgatattccttattccggctgccggaacggtgtccggaatactgtggatgctggccaccatggtaccgatcatggccatctccttcagaaggctgcatgatgccaaccgcaccggctggtggtttctgcttgggcacgtcggcaccattctggcccttgcgatgctggtcgtcattgcgttcggcctggtcatcatcgaaatcggcatgatcatggtcatcccccacgagccaccgaaactcgactttcatgacccgaacagcttcccgggaatgctgctcacgctgttctatgtcagcctcggcatggccggcatctcgctgatcatccaagcattcctgtactcgctgcccagcaagcccgagggcgtccgcttcgactgatgttctcagcggcatcccgcccctcttccctccctgcattaccctcttagcccttttgtatggaaacgttccatctcacattgagacagagcagtgagctcggttaacaaaactcctataatcacgtctattgtctttccgccgtcataagcgacggaatgtcaacatcagaggagaaaacaatgaagagaaacatgctccaccgcctggtcgccatggccgcggcgggaaccatgctgatgtcggtcgccgcgtgcggctcgtcatccgatgacaacgccgccaccagcaattccagcgacacctcgctgatttccgtgaacaacagcgagccgcagaacggtctgattccgagcgacaccaacgaaatgggcggcggcaaggtcatccgctacctgttcgaaggtctggtgagcttcgacgcgaagggcaggcaacatctcgaagtcgccgagagtatcaccccgaacgaggatgccaccaagtacacgatcaaactgaagaagggttggaagttcaccaacggcgaggcagtaaccgcccattccttcgccgacacctggagtttcgccgccaatgtgaagaacgcgcagaagacctcgagccgcttctccaccatcaagggctatgacgagctgcaggatccgaacgtcgatccgaaggccacactttccggtctttccaccccggacgactacacgctggtcgtcgagctgaacaagcctgattccgtgttcccgaccaagctcgcgcaccaatccatgttcccgctgccgagcgtggcatttaaggacatcaagaagttcggtcaggctccgattggcaatggcccgtacaagttcaagtcctggtcgcatgacaagaacatcatcatcgtgccgaacaaggattataagggcagccgcaaggtatccaacaacggcatcgaataccgcgtctatacgaatgaggattccgcttactccgacgtgctgtccggcaacctcgacgtgatggatcagattccacagtccgcggtgaagaccttccgtcaggattccagcgtgatcgcctacagccaggcaggatcctcattccagtccttcgtcattccggaacgtcttgagcatttcggcaacgacgaggaaggccaattgcgtcgtcaggccatttccatggccatcaaccgcgaccagatcgtcaagaaggtttacaacaacacgaagaccccggccaccgatttcacttcaccgctcgtccccgaatatgtgaagaagctggagaagaacggcgacaacctgaagtacaacgcttccaaggccaaggaactgtggaagaaagccaatgccatcaagccatggtccggcaacttccgaatcgcctataatgccgatggcggccataaggaatgggtcgatgccgtgtgcaaccagatcaagaacacactcgacatcgacgccgctggcgagccgtacgccacgttcagcgacgtgcgtaaccaggtgaccaaccgcaccatcaaaaccgcgttccgtgccggctggatgctggattacccgtccgctgaagattatctcaatccgctatatgcctccagctccgctgacggtcatggttcgaacgatggtgattacaagagcgcggaattcgacaagctcctgaacgccgcgctcgcccagaccgacgtaaagaaacgaaccgaggacttcaccaaggcgcaggaagtgctggccaaggatcttccggtgattccgctgtggaacgacaacgtcgccgccgcgtccgcgacgaacgtgaagaacgtgtcgttcgactacaccaacctgcctacctacaacaccatcaccaagtgacggcttcgttgtgacgtttcgctgccaatcggcaacgaaaaacgagtgggggttcgaatccttaatggattcgaacccccactcggcgttttgcagccgtttcgtttatttgcttacggcgtcaaacctatggcgtcagctctgcacgtagctgcccttcggggacttccaaccgcagttcatcatctcgctgttgaacaccatcgcaccgtcgccatgggcggggacgacgatcatgccaccgtcgccgtggtgacgggccacaccgtccagcgcggccttcgcagcctcgaccggatcttccttggcatacagcacacggtcagaaacctggtgcgcggcgacttccttgacgaacgcctcaccgatgccggtgcaggagatcgcaacggaatcgttgttggcgtaagtgccgcaacccggcagtggcgaatcgccaacacggcccggcatctggttggtgatgccgccagtggaggtgccggctgcgatattgccggacgcgtcacgtgcgacggcgccgatggtgccatgcttctcccattcgtcgccattggactgcgcctcacgcagggattcctgacgggccggggtgatgaagtactcgctgtcgcacagttcgatgccccactccttgagcaggttatcgcccggcttggcgaacatgacgtgcttggtcttctccttgatggcgcgcgccacattgatcgggttcttggacgtggtcagaccgcatgcggagccgacttcgccgtcaacgccggtcatcaggcaggaatccatggacacgatgccttcgctcgtcaacgcggcgccacggccagcattgaattcgggagcatcctccatgacacgaatggccgcgcagacggcatcttcggccggagcgccctgttccagcagcgcatagccggcttcaagggccctgttcagatcctgctccacctgggcgcgacgttccggcgtgtccttcttgccgcgattgccagcgcctgcgtggatcaccagaaggattccatccggatcagcctgggcaacccggaccgtcgactgcggcaatgctgcttcgtttgttgacatcttctctccttcagatatctcgcttatgtttgacattcgcagatatcttacgccggttgcggcaacgaagcgcccgacatgcgcaaaagcgatgccgtcgcgccgttacgcaatcaaaaacatatcgaagcgcgactgcgtcctttcttacgtttcatacttttgcaaatcgcaatctcgtatttcatggtgctcctccgttggtagtgccagtatgtgtcaagcgcatcgttccccggacaaaatcacgttcttaagcaaagccacgcttgtaaatcggaaacacaagtcgtcgtggcccctacggattcatgtatatcgaaatggctgaaattattatccatcgcaaaaactctcgtaagcaacacttatcgagataaatgtagcttattttaacgttagctacacttatgcggataagtgtagctaacgcacatgcgatgcgactgatagattggcaataaatggatattcgtatacttattcgtatacttttttatgcgttttcaaatctcgcagaggagaaacatgtcagccgcatcgatccttgacagcatggtctccgtcaccagccttaaccacggcggagcaagcaaagcattaagtcaggtgggcgacaaccatccagtcgtcgtactcaaaaacaatcagcccagcgcggtcataatcacgcccgccgactatcgccggctcactcaggctgaagaaaatttcgcgctataccgcaaagccgtggaacgcctacgcaacgatgacagcacactgctaaccgatgcagacgtattcggcgaagattatgagccgattgatgacggttttgaaccagaattcgaataaggtccatcaacaaccggcaagtggacaattttgtatattttgatatggcgatgcaggttatatgaaatcaagaaatcgacgtcttgcacagccggattgaatatagtggatggcattgcgatacgtacaggtttcacttttggtcggagcagtatccatgtacaaaggcgatttatcaatcacacgaggagctgactgaaatggcagcgttcggcaggccggaatatgaccgttatgtacgtcttgcggaaatgatgatttcatttctaagagaccatggatacaactacgacgccaatctcgatcaagacatccttgaccatgatggaccgggagtgccagtcgaaaatggcgttgacgccatcatcgagttcaacctcactcctccgaaggatatgatcaccttgtttggacaagttcatgatgaaaatccttggtgcgacgaggaatacgaacaatttcgcgattacctgcgagaacgcgaagatgagcaccaatcgggtaaattgattccgccatccgcagattagaacgccgacccccacacacacaagtaataatcgtttgcactgttcatcgtagcgggcgcggaactcattctcacttcccgcagtgacaccgtatgccagataaaaaaaccgggaacggacgcgacgtttgaattacgacgaacccgactcccggcatcgcgactgcttctcaaaagatgtgtgcttgactcacatggatggtactgagaaccattcgcttgcgatctgcttccgcacacatgctggcgcgatgtaaatacaacgcaggcacacggcagatacaaatcaagtctgtgcaaaacttccagccagcaaagaagccgaccggaaagccacaggccactctagtcgtatggtcgaatattcacaaattaactgaccaaaccgacatatgtcatgtgaagtgagcgataaatcaaaaaacggcagttcaaaagcggaccatctcaatacacgtatcccatatgggatacgaccggtagtgaaggtccggtcgtacacgcttatcgtatttcaatccacgcatcccgtatgggatgcgacttgccacgattaaacatacatcctcctttcgtgttttgcttcaatttttcttaagcaatttctgcactgtttttccgcagcataggctgctggtttccagcggaaactgcaccatatgaccgcccagacgaaaacaggcaccagcccgccgtgcctgtatattcccgagacgtaacccaaaaacgaatccgccggctgcaaccggcggcgctcgggaaggaaaggacgatggcgataccgatgcccaaacagcaagatatcaggagactggaccgtcagggagtgtccaggtcggagatcgcgaggaggctgaacgtggaccgcgccactgtcgcgaaatacgccgacatggacgacatgacgccgaaaccgcccgcggacaggcgccgcggctccaagatcgacccgtacgcggcgttggtcgacggatggctcgaggccgaccgcatgctgccccgcaagcagcgccacaccgccaaacgcgtgcacgacaggctccgcgcggagaccgagtacgacggcgagtatacgacgacgctgaggtacgtgagacgctggcgcgaggcgaaccggagcggttccgacggatacggcgagctcgtctgggcgcccggcatcgcgcagatcgatttcggcgtggcgaaggcccgcatcgccggcgagctcgtggacgaccactgcctggtcgtcacgttcccccattcgaacatgcggtatgtgacgagcctgcccggggagaacgcggaatgcctgtgccacgggctgatcgaggtgttcgagcacatcggcggagtcccgccagtgatcgtcatggacaacgccaccggcgcggggcgcaggaacgcgaggggcgaggtgacgcccgccgcggtgctcgacgtgttcgacatcaaaaaatcgctgtcacacaagggcaacccctacgacaacgccgtggtcgaatcgacgaacaggccgctgaagaaggagctcgtgtaccggaaccactacaccacgatcgagcagctgaggcatgaccccgacgactacgtgtggtggtccgacaaccagcggctccactccaccctcggataccggagcccgaaggaattcaccgaacagggactcgtcctctaagaaaccgtccaacacgctgttgccaatccagcggtcagccagccatccacgatggccgcgtacccgtcgtcgaccagcgagctgcccgcgcgggcgccgtctgacgattcgggcgaataatcgctgcggtcggcgtacttgaccacggtcgtgcgcgatacgccaagccttcgtgatatctccttgtggctcaggccttggcggtcgagctgcctgatacgctgtcggacacacaccggtgtcgtcatttcctttcctcccgagaaccatcagtttggttgacaggcactcgggaatccatcaaggaaccagacggtgccggtgttcttattccaccggcaccgtcaccgccggcaatgtccaaattgaacgctcacggtgtacagaaacaagtgccgacgccgaacacctttattcgatcacatacaccgcgacaggtctctgatgcctagtcctttctgacccatttcggttttcatcgcctcatacagctccatcgttgtgacacagtccgcgatggctcgatgttcattgttcgtcagattcagatactcggacaaatctgaaagccggtgatgaggcaaatcaggatacagttttctggcaaactgcatcgtatccatgtactcgttattgatgttctcttggaatcccgcggcgaggaatcggacatcaaaggacgtgttatgaccgacgatgatgtcgtttcccaaaaacgcgaggacatctcccttcacatcttcgataggcggcttgtccgccaccatttcgtttgtgatgccagtcaggctggtgatgaatccgtctattccatacttcggtctgatcagctgttcatacctgtcgatcacatctccactgcgcaccttcagaattccaatctcaatcacctcgtcataataggcggaaagacctgtggtctccgtgtcaagcacgcagtaatctgacactatcctttttaacgtagttgctcattgcttttcctcctgattctctgatttcccgttcaagccttcgtagccgttcctcgcggtcagcctttctggaaagttcgcattcccatacgactatcacgttccatccgtcagctttcagctgattctgtacatccctgtctcttggatgtattccggtcgaatttcctctgccagaattcacggttgtggacggtgtagttgcatatctgcatccgggatgacggtgccagaagcagccgtgcacgaaaatcaccgtatggtatttcggaagaacgagatccggtttgccgggctagctgctgtcattcttgcgatacctgtatcctttcgagaacagatactttctgacgattccctccggtctggtgtcctttcctcgtatatgcgacatattgaaatgccgctgttccttcgtcaaaacgtctgacaccggcatcacctccgtatgtcacacttccctgaatatcttcttgaagataagctgtgtcatcacttcgtcaagctgcttcgccgtgttttccgattcaatcagtgccccgagttcgatgttgccctgctgcccgtggtatgacaggtttgccgatgttatcagcgtctgtttcatgtccacggatatgaccttggcgtgcagcgcagccatcttgtcttcgtcgttgctgtagtcgtatatctggagaaagcgtcccttgtaccggagaagcttgtctgcgtccggctgcttctcaatgttattgatgaagaacttgacgaacacgcctctctggctcttgtcgatgatggtgtccgtcagttctgcgaaatacgaggaaagcgagtagccggttatcaggatgttccttttcgatccctcgatcattgaccgcacaacggtcatcgtaggctttgcattgattctgaacgatggcggggctgtcacgaccaacgagactttatcatttcttttcatggtcatggcagaccggattgtcccggctaattccacgtaatccgtcggagacaatcccggatatcgtctgcgcaggatgtctgtggcattatcggtgccattggcagcatctgcccttacagtattcagaagtatttcttgttttaaatctccacctgacacagttcgttcaccagctctctgaaatacgatgtctcttcgcgtcccgaaagaggaaccacgagcccccggtcaagcattcgattcccgttctcgcatgcggtttctgaaatcatgcagcaggaatggcaggcagctccattcgagttcttgccggccgggagcgtgttcatgcattcaggatcgttcgtgcagaccagggcttcctgaaacgcatcccgcatgagattcgtcatctggtctgccgtaccgagttccacaagacctccgagagatccttccttgtcagagcttcccgtgtagagcagaatgccggccatcttgtctccgaagtagattctctccctgattgccgaagaggaatagcccgatgacatggacatctgcttgatgagaagatgggagaaggtatgcatgaggacatagacggcgttgcgatccgcctttatcgtccatccctttgattcacagtactccctgtaggaggcggcatatttctctgaaatttctctggtcttcggctcggtcagccactttgcaagcgtctgcctgttgaattcgatgaagattccttcgccgtttacctccactgcaggaaaccatcgttcatccctgccttttgtaaggtagacgttgttcggctggtcatccgcatcaggatctggcgaatcaactcttgtgaatcccagaagcacgcgcacttcacgcagcctcgttatgcggatgatccgcttgaagtaccggctgaagtatcccggcaacggatcctcttcagccttgaaatgcttcttgttggactgataggtcggatcatcgtgatgcgttatggcttcatactccatccgcttgatttccgtgaattcccggatgttgttcatgcgccgctcgtaggcttcatcgaattcctctcgggtataagtggagaagtattcttcataaatctgttgaagaccatcctcttcggtcttgccgaatcttaccgccatcttttttgcctgttcgatgtcccggaggtgctcatctatcaagttgtacagggggttgatccatggcggaatagaaatggcgcttctcgtcacggcaaaatacacatttgatgcaccgcgctgagacggaatgaccggtttctcgcagtgttcacgtctggtgtgtggtctgaacggatgcatgccgctgcacgacagtccctcgaagttccgggcctgcgtggctccgctcatgcttcttctcgcaccgcaggagcactccacccacatatctgacagcgtggatgtgtttcctgttgagtacatcctcatttcccctttgcagtctgtatctccgcgatgaacccaccatctccaggggaaatcagacatgtgtccgttttcgcaaattgtgatgaaacgggcaggataagcacgccagtggcagtcagggcagttaacgctaaacttcagatacttgtcgagatcatcgttgatgatccctcttgcatcaaaaagcctcccgcactttgagcagacatgccagtaaggaaaagtcacaaccggtatgtcatgagcaaaggatgtcctcggcatatagaaggcatccacattcagataggacgcaagccgtccgtctatgattttctttcccctgtccttccagtacgggatatccagaatggtcacagagtctttcactgcatccacgactgcccccggtccaaaagtcgtgatgatttgattcgggcgcagctcgccaagtttgttaatgtcgtatccggccatatcattcctccgtgtaatagtacatatttgcagcgctttccacgtcacgcattgaccgcagggtaggcttctcattctcgatatgaggctgctcatatccgttcataagcctgttgtacttttccgttcccacaacgtaatagcgaagaggcttgtcctgtgatgccagcaacttccattcgtcgatgaatttgtcaatctcttcgctcgcatcagctattgcggaaggcttaacgatttttacccgttcaagaatcatttccttcactgcatcgatttgattctgtgacagagaatttattgccacagcatccttattatcagccatttccgggtacagaagccttatcgcagaaatgacaagtgcatgcagaacacggtcgcgcgcccttgcagagaacggagtggccgttgttccttccacgaatctgtagagctgtgcgtggtatccggtgaaattctcgtaatgagacaagtcgcgcggccggtatgcgttgtacagcgtcacgacaagacccggatgagcacgcccgatacggcttgtcgcctggatgtattcggagttctgttttggctgacccgacacgaccataagaccaagacgatccacatccatgccgaccgcaatcatattcgttgcaactgccgtgtccatatggtcctttgcggtatagggcagctcaagctggttgagtttttccggtattttccaggacgacatacgcgatgttatctcatcgttcttattcagatatctgagcttttcgagatggtacctcttccgaatgcgctttattctggcgggaatatcatcctgcagaaggcgtaccgcaccaccgagttcacgtatgctgttgaaatatccgatcagggtgtagtacggatcgatgacatccttgtattcatcctgcagggaatatgtatagaccgcttgcagaataatggcataagttctcagcaaggctgttttcacagactgcccgggagcacagattccgacatactttctgaacgggtcttcctcaaccggaatctcgcgtatgaagaagctgtcgccgatctcaaagccgttcggcgggaactgcttcgttgtctttctggcatacaggcacttcgcctggttgtctgcattcttgattgtggccgtggagaccacgtacttcggtttgattccatcatgcgtgcacatgtcctcgatgatggtctcatatgcaccatagacggtcccaagaggccctgtgatcagatgaagctcatcctgaataataagctccggcgggagaaacggcttcacctgcgtaatctctgcagcaggaagaccggatgttctcctgtgtttcggatgttgttctgcaccaatcgcaacatatccgtcacggctgcacttgcgatcaattcttccgaacagagcgttcgtgctcacgtcccacggcagtctcgcgaacttgtcaactgttgacaggatgatggtcgggcatttagcgtagatttcctcgtccaccaagtataccggaatcgggatgcgttccccggtctttgcatatttatagaacatgcagtgttcgtccgagcagtagatttccacggacttcctgtccgagtcaatataaaactcttcctttgtaagcggttttccgcagaacggacaggtaagaagctgcttataaagcaggttcttctgatttcctgcccggtaaggtctttccggattttccttcagatcatcaaatctgttcggagtcacactgcctccgacccagaaaccgatgctgattggctctgttccgtaccgaggataatttctcggatctcgtctgacgttctccgcagcaacaaccatctttgtgatacggtcgcgctgctgcgttgtcagaagacgaagtgtgtaccggaggatgatggtcacgccgccgtcacggttatatttgtcagattcggaggaacgaaggcgtctgttggcgatggtgaatgccatgagtccgaggtaggcctctgtctttccgccaccggtcgggaagtagagcaggtcgacaatatctcgttccgggtcttccggatgcacaatccccttgagattcatcagtatgaatgcaatctggaacggtctccaggcgaattcattctttgggttcctcgggtcgacaaaatccctgaagttgcattcgattccctgaccatgcttctttgcgtagttcttgatgctgttctgcatgtagattacgctgttcatgaagctgaacgcctcgaaggagatgtcatccgtctcgatgatatggatgccttcgcggattctgcgaagagcatccctgcagcgaccgatgacggtgtttccgaccttctctgcgaactccggattgatcattctcgagcttccggcaagagtgtcgttgatccacttctcatatgaatcggcgagcgtgttgagcttctgtatggtttccgctttcttacccttcgctgccatctgccaggttgagaaatacgtgggcgagaagcctttgagagcggcactgacgcctggatactcatattcagggataaatgaggcttccacataatccgtgcgtccgttttcagtcttaccccatacggcggcacaacctctgccacgtcccatgatcggacgctgctcgaagtagaactcgtcggcagcaagaacattcctgcagatatgctccgcgatgaagaccgcagagccatcctcggcatgggccttgattccgacctgaaacatcaggccttcgatgtcacttgagagattgttccgcttgttcacgacataggcggtgacgagggagtatccattcgtcagcggaattctcgacacatgaacgtgtacgttcgaatccttgatgagcgggtagtcctttgtgcgtccgaagtcgctgaacttcacatggacggtttcgctctccgggattctcttgtagaccgcgcggctgcgttccttttcttccttgtcgatgtacttttcagttgatttcgtataatcgccccaggtcacgtcaagacagatgccgtcgagactgctttccacgtagaagctgatgccgatggatgacggcagctggaacttcgtggtggatatcggctcgttgtcgtcgtcctcgctggctgtgaagtcctcgttcttttcgtagtcgacgtcggcttcgatttcctgctcgttctcgtccgacgcattttcgtcacgctgcggttcgagcatgccgactatgtaggcgtagcgcggattctcgttcagcacttcctcagcttcgagaggaccgatcaggtcggttcggattgcgtctatgattttctgccgtacctcggcatacttgaatctgtctgccattagtcctcctcctttatcggatgcgctgttccgagcgtgtatttgcaggtgtttccgggatgaatgttgtcatcagagataagccggtactcccaggtcttgtggtctggatctgcggttgtggcaaagctgcaccagcggatgccctcgcgtgccttggagacgacctcttcattgttcacttcattgagggccttgacttcgaccatgtatttcccggtcgtcgtctccacgaggaagtccgggttgtattgctggccggctttccagaacaggccgagctggttaagtggtggcttgatccagcggataacgtccgggtcctcctcaaggatgatggagaactgccgctcggtgtcgctgtcgaaggcgtttgccggatagtatgatttcttgtatcccgtgaagagatacttcttgatgttgctcttgtccgtgaacggcttgtcgtaacgaacctgaccgtctttcttcacgttcttcacgaacttgcggaagacaatcagatccttctggacgatgtggacatcctgcgtctttctgtccatgtgtgcgtagatctgtttttttatatcattcacgatcagccccgcgtagcggcggacgattttcttctcctcctcgtcgccgggaatctgggcaagatactgttccacgacgtcgatgatgaagtcggcgtcgtcgtaggaaagctcactgatggagtcgagcagtatgcatgccagggtgttccgggcatcctccacctcgagtgcctgcgcatcgacgacagtgagaaggtgctggtttatggcgtcgaagcgctcgatcttcgctgtggcgatttcaaagtcctgtatggtgcgtttcacctcgaaccggttgaacttcacctcggaggtcgtctgtacgaggatcttcggcacggagatggctttcgccgaatactcggttaccgttttcgtgaactcttcctgcgtcatcggacgtttgcctaccgccttgtttcctagtgcgggtggtgttgctgaatccggagtcgttgtggcagccggtgcttctccaatctgcatggcttccggtgctacgtcaaaaagactcagctggttcggatcgtcggacttcctgttcttctgctgcgaagccatgaagttcttcacgtatgcctggtagatttcaagctgtgtctgcggattgcgcacctggtcgaaggacttgattccggctgatgtgatcgcctcgtcgatgaacgagagctgcccgtcctcgaaggtgctggacacgtccacggactccgagtcctcgactcctgtcttgtccaagtcacggtagcggaagacgtcgctgttcctgatctcgtccaccagctcgcggtagtggtcgtgcgccacgatgtcgagcgtatccagatcctcgtttccggtctgctctccgaacggcaaacgcagtccgcgtccgatagtctgcatggcaaggatgtcgcttttcgcggcattcagcgggatgattgtgaacaggttgttcacgtcccatccttctttcagcttgtagacatgaagaacgatttctatcgggttcgccgcactctcgatggagagaagcaggcggacattctcctcggattcctcgccggtctgcttcgaatgaatctcgatgaccttgcccttgtatttcccgtgcatgaaatcgtcgctgtctatcagggcgcgaatcttcttcgcgcgctctgtgtctttgcaggctataagtacgatcggtttcacatagtcgagctcattgttggcacagtattcccgcagaacggtcttccggtgctcgtgcagggtgagtccgtcacggatcttcatctcctcaatatcgtcctggctgtatccggcgatattggaccgtcccatgacgacgggaatcttcagatacccctcagccgctcctcgcgccacgtcatacgaatagatgacgtttgacggagacttcggagtggccgtgaattccagtccgagaatcggccgcagatagttgatggctttcatggacgcgggagcatagtagtggtgcgcctcgtccatgcagatcacaaggtcgtcgaactgcgccagcacgtccgcgaaggaagcaccgagggtttccttgaacttgtgaaaattgaactgtgtgtcggtcttgctgttgaaaatcttaccaatgttgaatatgaaaagctgtatctccgacgtgtggtcgacgaacagggagccctgctcgtacttgaccgggtactggtcgtagttctcgccgtcccagacgtgcggtctgcccatctcggcttcgagtcccttgaaaatgtacttcggatgcgcaggattggattccttgcgcagcttgtcgtagatggtgtttccaggcgcgaggatgaagaaatgcttgtatcccttcgtcttgtacagatagtagatgcaggctcccatcaggcgtgtcttgccgatgccggtggccatggcatagcagaaggacgggaagtcgaacttcgtcctgaccttccgattgttctcgctgtattctgacgcagccgcctcgacggtttccttgtcgtcacgcctgtagtcacagtgcgtgctgatggcatcgaagtaaaagagtgcttcctcctgcggcgttctcagactcatggcgtatttgatctttgatacagttcctgacatttaccgcacctcgctttcaaagtcgcacttgtccaggagatccttcgggatcttcttcacctcgatgttgtccggtagcatcatgtcggactggatcttcgtcgcgtagatcaggagagactgctcctcatccaagtgctgcgacagggaacggatgtactccgcgttgacgaactccgtggtcacatggatgaaccgcttctccgaggaatgtccgtggaagacatcctgcggcttgtacttaaatccctcgatcttgcaaatcgcctcgcacagcatctcgaacgtgtaggtcgggttgatctggtaaactggcagcttgtcgttcttcacgagcaggctcggtgcaagctcatagaagtggtatccgccgccaccccgccagttaaccttctgtgagataccggtcttatctccgtttatgacattatccatacgaaccttgcaaagggtgtatgcatgatcacccatctcaattcctatccatcgacgattcattttatgcgctgttgcagtagtagaaccgctccctaagaatgaatcaagcacccaatcatttctgttagagaagtaacgaatgatcatttcaattagcgcttctggcttttttccgcttctaaattcgacgcctccttcatgtctgcaatttccaaagctccctgccaagtcgtaaaaaccacctattggtttttttcgctcaatcttttcagcctctaatttatctatcggcacaccttgataatattttcccttcgttgccccttgccttttgggccctgtaaaataacgatagtcatatcggtcatcgccaattccatagactttataaagaaccccatagccatcttcttcataacgaccgttgagataatctctgaaaaacctaccagacgaattaccgtctaaaatcgtacctgtagcccatatttcttttaagccatattcatcgccatcgggtttttttattatcttgtactcgtttttctcgaaaaccgtaaccgtcttcccgcctaaggtgatttcttttcctgtaccaagttcttctattgcatagatgaacttgtcgtatccaacctcgtcataatcaaaattaggagttgcctcagaagacttccgatatacgagcacttgctcaatttctttatggaaatccatatcggactttaacgtcttatctggataacgaacacggatataaaggctcgtgagatagttcgaccttccaaaaatctcgtcgagcaccaccttcaaataatgactttcagagtcatcaatatggcagcagagaaatccatcatcttccaacagactatgcagcagcaggagtctttttctcattagtgaaagccatatactgtgctctacatcatcgtcataatattcaaatgcgcttcccgtgttgtacggcggatcgatgtaaatgcacttgatcttcccagcaaagtcctgctgcagtgcctggagcgcaatcaggttgtcgccgtggatcagcatgttctcactgtcagggtcgccgtaggatttctccgtatcctccaggagaatacgcggttcaaccggcttctcctcgtcgtacttgcctacccatgtcaactcgagttttccttttttctgcatatctgtatctcctaaaacttcagtacaacgctgatcagaaggatgggattgtcaatctcgaggcttctgttgaactcagcaatttccctctcgccgtccgctctgaagcgactgcctcgctcatggaaggaagcctggaataactcgagcttcttctgtttctggtccgcctttctcctgatgtctatcttttcatagaaattattcgaggccttctcctctttacggagttcctcgatttccgcgttcatttcctggtactgcacgacgagttgctcgttctggatgcgtatccagttctcaatctttcgcctgttatattccctgacgggttccgtctgtctgtcgagtttgtcaagcatttcgatgacaagattcccgtaggttttcctgaacattgtgttttcattgtcggtcggtttgaagtaccgcactgctgaatcgtcgattttttcgagttccggcacaaggttgtcctcctcgaaatcgacgtattttccttcctgatcgcagagaagcagcacggggaacaggatgtcggcattattgcacattgcgccgaggaacagatatccgtgtgcgccgatggtctgttcaccccagtcgtcgaccttccagtactgaacatcgccgaatacctccggctcggcaaccttgtcccagtagtcggcttcctgaaggtagtggtctatatccttccttgtgccttcgagtgcctgtttcttcgcgccgctgctttccgtaatcaggatggaacggagcttgcgcgcgtttctgtcgcgtttcgcgttcagcttcctgtccagcttgtcgaacgcctttctgaattcagtggacgtgttgcaggactggtagatgtcaagcaccattttctcaaagctcgtaccggattccagtgcgccaagtgcgatgtcggaagcgccgaacacgccctcgaacagttcgaacttcttcgacagtatctcgtagacgcgcttgtcggcctcgttctgcgtattcagcaggttgatggcgaccacgtcgttctgctgcccgtagcggtggcagcgaccgatccgctgctcgatcttcatcgggttccaaggcaggtcgtagttaatgaccgtgttgcagaactggagattcaggccttccgagccggcgtccgtgcagatcaatatcttcgcgtgctccttgaaatagtcgacgatggcgtgcttgtattcgacgctcctgccatagttcgcgttcccgaagttcttcacctgccatgcccggtagatttcccttgtcatcgtgtcatcgaaatctccattgaacagaaggatatcatcctcgctgtatccggattttctgagctccgcggcaatgtatttctgcgtccgctttgactcggtgaacacgacagccttctgagctatgccgttatccctctggtatgagaacccgatctcaagcgcctgtttcagcgcggtcaccttggaattcgtctttatacgctttgcaacatcaatgatggcattgaccttgtccagttccgcctgaatgtatgccttctgcgcggcggtgtcctcgtcctcggtttcctcaaagccggattcatcaatctcgtcctcgacaaagctccagaacaggtcaaatccctcctgcgcatcagccgacctcatgccctcatacagtttctcgagccgcttcttcagcacttcgaaggtctcgaccaaggcgaagctggatgaggccatgagcttgcggatgacgaggataatcagcccacggttggaagccggtatggagtaaagggcatcccccttgaggaacaggttgacccgttcatatagttcgatctcatcaggcgacagcttaaagtcaacagttctgcagatcctcttcacgaaatgcatgtagtccgccacgtcttttcgcagggtcctgtaaagcacaggcgtgagttcgcgcttgaggccgtcgtagtcttcatccttcatatatcgttgccggaacacctgctcagatccgaagatcctcggatcgatgaaggaaatcagcccgtacagatccatgagtgagttctgcagcggcgttgctgtcagaaggatcttcggtatcccacctgaaagagcgtacagccgcttcgcacgctttgtgctgttaaggttgcgcagattgtgggcctcatcgatgatgaggaagtcccatttcacatccgggaaccgcttcatcagtttcgatgagtagtcataggaggtaatcacaatcatgacaccttgtctgtctgcgagcttcctatgccagttcttcgcatcatgctcgaccgtgagcctgtccagaatcgcagaactcaggtcgaatttatcctcaagttccagctcccactgcttgcggagggatacaggaagcgctatcagtacctttttcgctccggattccagcatgtagcgcaggacgaggcccgcctcgattgtctttccaagtcctacttcgtcggcaatcaccatgccgcccgtcttcatcgcgtcgacggcggcgcagaatgcgttgatctggtgagggttcggatcgatgtgggactcggacgcaagaaggaaatgaaacggcgactttttcagttccattcgtttgaatcttccatactgctcgaggagcaggtttccgttttcactgctgtccatcggcatcctccccgtgaagctgtgcaaaaataccctcggcgatgccccttgccatcagaggaggcacagcgttcccgatctgtacgaactgtgacgtgcgtggtccctcgaagtaatagctgtcggggaatgactgtatgcgcgccgcttcccgcacagtgatggaacgatgctggctgatgtccggatggatgaagtagtggccgtccttggaaagatgagccagtatcgtgtggcagcattgttcatcgccctcgacgaccttgaagcggtcggtgaaggaatggcggttcttgtgcgtcttcagctcctcgggcaggtcgttgtagttaagacgcctgtgaccgtcgttccacagttctatggctctctcgtatatccttatgtcacgctcgatgttcggccggcagttctgcagggtcaggacatcgtccttcgtgcgtataccggtttcgatcacgtatctgctcggctttttcttcgagtaggtgttgttgctttcccccggatgaagttcagggagatctgtgaacaggtcgttcaccacggcattcgcttccttttcgatgaaatccggatatgctaggccgctgttcttgagccagccgacgataatcatcctccgtctgttctggagcacaccgaatgtatgcgcgttctgctcccgacactcaatcttgtatccgacccgcttgagatatttctgcaggttcttccagattgcgccgccctgtgcggattcgatgcctgtcacattctcgaacacgaacatacgcggctggtatttcttgaggaatcgcgcgtaaagcttgtacaggtagttgcgcgggtcgtcctccatcggagtctccatgtggctgctctgggctctgccgacgagggagtatgcctggcacggcgggccgccaacaatcacgtctatcttcctgattccgcgtatcttcattatgccgtcgatggtcttgaaaacagcggggagcgtttcgtccgacagcgtctcgttgatgactgtctttgtcacggatgcaggaatcatcttcatgagctcatcacggctgatatctccagagaggtatttcccgtatagtgccaggttgcccgagttcttcaggtagtagtatgcgctgcgggtttcgagcgtcttcgcagcgtactcgttcatctcgacatgcgcaaccggacggaagcccgcctgaatgaacccctcggacaggcctcccgcccctgcaaaaaggtctatgaaattgtagctgctctgcttatccgcctttgccatgcttcttcctcacaatcttcgtttcccgtacccatacggcatgggcaggacggcagtcctgacaggaccgacggtctggcttcactggcgcaaccgtgtcctgctccgtcccgcatcgcttctcacttcggcagaaacctcctcgcacggcacggtttccgctatttcattcagttctacatccagagagtcacatatccggaggagcacgtcggtcgtaacgttctcgtccttgccgagcttggcgagggaagacgagctgatgcctgcgttcttccggagatccgtgcgtttcatatccctgtctatcaacagtttccacagtttcttgtagctcatttttcttttcattcgctttcctctttgttccatgactccccgtacagctcggaattttcatcggagagtttcagcaccgaattgtccgccagtatctttcttgtgctctcacggtaggaatcctgcttgtcgaaggcgatgaacacctgtttttccgtccccgtgtagatcttcatgattccgtcgatggctccgtcgcttatgttcttctgaatcagagaatcgtgcgcgatggccggtagcgccgtcaggtagaggacagccaggtcgtacagcactatgcccttgtagttcgtcccggttcctgtgtcgtccggtgtttcaaacgtgtagctgttgtagttgttgaaatgcagcctcggagccttgcgggcgtccgcgtaaaaagaatcattgaactccttcatcttcgcgttgacgtcatgctctatatccgcaaggatgcttgttatcgccgatttaagcatgttatccgccttcttccttgcgtcctgcagatcaaggagcgtcagataggcctcgttctgcagcttgagtgcgtcgattcttcccttgagttcggaatgacggtcaaggaactccttcgacacgctcccgacaaagccgagttccctgatctggccgcgaaccgcctgcagctgctcctgcagggcggcaatctctccctgcacctgttccttttcaacagaaaactggccgtccagtatcttcgccagcttgcgatggtagcgttccacctcatacagtttcctgacatactaccccatccacacactgtcaaattcctactgaaatagacaagtaacctttacctccgctcccacacaaacaacaggtggggggtgtggtttcctcgttgaagttcaacgaggaaaccacaccccctgctacaagcggccagccacccagccaaccacctcaggccttggcgacttccacggccagctcggagccttcggcgccggcttccacgctcacgctgtcggcggaggtgtcgtttgccaccagatccttgaactgttcgatcttcgccacgtcgccggccggaacggtcagcttcagcgtgatgcggtcggagatctccaggccggcggccttacgggattcctgcacggcgcggatcacgtcgcgggcgtagccttcggccagcaggtcgtcgttcagttcggtgtcgaggatcacgaagccaccggtcggcagtgcggcggatacggagttcgcggcttcctgcgcgtccttctcctctacacggttgatcagttcgtattcgccttcctcaagcgcgatatcgccgttcggggtctcgcacaccggcacgccggcggcgtccacatgccaggcaccgctcttggaggccttgatggcgaactgcacgtccttacgcaggcgcttacccgccacgcgtgcgttcacgcgcagctcgttcacgatcttcagaccctgggagccggcgtcctccagcgtgcagaactcgatgtccttcacgttgagctcgcccttcagcacgtcgctgtatgcagcgaccgcatccgggttctcgaccaccacggtcagcttggcgagcggctggcgcacgcggatctgcttggccttacgcatcgacagcgtgccggacacgacctcgcgcaccttctccatcgcgtccaccagcttggcgtcgtcctgcagcacggcacccagctcagtggtctcgccggtcttctcgtcggcaaggaacggccagtcggccagatgcacggattcaccgccggtcaggccgcgccacacggcttcggcctccatcggagccagcggagccaacacgcgcatgaaggtttccagcacggtgtacagcgtgttgaacgcgttctcatcaccggcaccgaaacgctcacggttgttgcggatgtaccagttggtcagcacgtcgatgaagtcgttcgccgcatcgcacgcgtcggagatgtagaagttgtccagcgcatgctggatcttctccaccaagcggcgcaggcgggccagcagatagcggtccatttccggcagccccgccacttcgtcggcgcgaagcttgcgcgcgtcgtacccggccgcgttcgcgtacagggtgaagaagtagtaggagctccacaccggcagcatcacctggcgcacggtgtcgcggatgccatcggcggtgacgatgaggttgccgccgcgcaggatcggcgagctcatgaggaaccagcgcatggcgtcggagccgaagtcgttgaacacgccgttcacgtccggatagttgcgcagatgcttcgacatcttctgtccgtcggagccgagcacgatgccatggcagatcacgttcttgaacgccggcctgtcgaacagggcggtggccatgacgtgctgcacgtagaaccagccacgggtctggccgatgtattccacgatgtagtcgcacgggaagtgctgttcgaaggtttccttgttctcaaacgggtaatggtactgggcgaagctcatggagccggattcgaaccagcagtccatcacgtcgctgatgcggtgcatgtggctcttgccggtcggatcgtccgggttgacgcgggtcagctcgtcgatgtacgggcggtgcatgttgatgttgccctcatgatcgcgcgggtagtcaccgaagtcggccttcagctcgtcgagcgagccgtacacgtccacgcgcggatacttcggatcgtccgaaacccataccggaatcggagaaccccagaaacggttgcgggagatggaccaatcgcgtgcgttcgccagccacttgccgaactggccgtccttcacgttgtccggaatccagttgatctgctggttgagttcaagcagacgatccttgatcttggtcacggacacgaaccaggagctcaccggcttgtagatcagcggggtggcgcaacgccagcagtgcgggtaggagtgcacgtagctcttctcctggaagaggatggcgcgctgctcctcaggaatgcgggccagcgggccgtcaccggcgcgcaggttgcgcagaatcggcttgttggcgtcgaacacgtacaggccttcgtaatccgggcacagcgacgtgaacttgcagcccgcgtcgagtacgtccacgctcttgatgcccttggcgttgagcgtgttcatatcgtcctcaccgtacggtgcctgatgcaccaagccggtaccctcaacggtgtcgacataatcggcggtgaagatctgataaccttccggccccggcaccttgccttccacggcgttctcatcgcccgcgaagtacgggaacaccgggtagtagcgccagccttccatctcggagcccttgagttcgcgcacgatctcatagttctcgccgagttccttctcgtaggagccgagcagcggcttgccgaggtagaacttcttgccggcgaacttgccttcggtcgggcgcacctcgacatagtcgatgtcggcaccgaccacgatggcgaagttggtcggcacggtccacggagtggtggtccagaagacggcgtaggcatcctcctcgtcgcgcagcttcacggccacggacacagtggtgtcctgacgatcctggtacacgtccgcatccatgcgcagctcgtgcgcgctcagcggagtctggtccttcgggcagtacggcagcacgcggtagccctggtatgccagtcccttgtcgtacagctgcttgaaggcccacatcacggattccatgtaggaaatgttcagggtcttgtagccgtgctcgaaatcgacccaacgggcctgacggtggacgtacgccttccactcgttggtgtacttgagcacggacgcgcggcaggcgtcgttgaacttgtcgatgcccatctccttgacctgatccaccgagtcgatgcccagttccttctgcgcctcgagttcggcaggcagaccgtgggtgtcccagccgaacacgcggttgaccttatggcccttcatggtctggtagcgcgggatgacgtccttggcatagccggtcagcaggtggccatagtgcggcaggccgttcgcaaacggcgggccgtcgaagaacacgaattcgttctggctgtggtcgccggacggacggcggtcgatggacttctggaaagtgtcgtccttatcccagtagtcgagcacggactcctccagcttggggaagctggggttcggcgcgacgttggcgctctgctcgccggcagcagccttcggatacacatgattggtggattcgctcaccgtatgctcctcgtttggcggtttcattacttaccttacgaggacgatggcttccgtgcgatcgcgcacgtccggcaccgcggtaccacctcgcttgccgcacttccctgttgttctcacgcaggttgtccgcctgcgcaggtttcgtacgaccgcttgacattcggctgttcgggccgaccccgccggttctactaagcctcgccagaaagcgtcggccgttcttccggaagctccccgctgatgacggatcatcgcttttcgtttcaaatcgtcagcctagcacgccgtacgaacgtagaaacgcgaaaagccgcacggtgtccaccatgcggctttcgtaatcgcaaaacaatcgaaatacaatcggcaggccgaccacgaatcgaccgaagacgatcgcgctcggcggcgaatcagccttcgttcagctgagcctcgagctgcctgacgatatcgtcgtgcatcttctcggtgatcttcaccttgagcaggaacacgaccgcgctcaggatgatgaccgcgagcggcacatagaaggcgcagatctcgaaggtccggatgttcgcggcggtcatgtcggctgcggtggcgttgccgatcatgccggcggcgatggccacggctccgacgatgccgttcgagcacgcgcccgcgatcttgtcgagcatcggacggacggacagggtgacggcctcgttgcgcttgccgttcttcagctggccgtactcgatggaatcggtcagggaaaggatggccgtcatctggatgaaggtctgcggcagatagaagaagacaagaccgacggtgacgaccggcaggctggtggggttgatgatgaacagcagatagccgatgaccataagcaccatgccgccgaggtacaggtggcggcgcggaatgcgcttgttcagaatcgggtacagcggagccataacgatgcccgcgacgacggagacgacgccgacgatggaataggctgcagagttgttcagaatgaacttgaacagatacatgagcacgccggtggtggccacgttggcgatggcgtacagcaggtaggacagggcgacccacagcagctggtcgttctgggcgagagccttgaacgcggcgagcgggccgccgttgtcctcggccttggtgcgcagggtgctggagctttccttggtgccgaacgcgacggagcacacggtgaggacgccgagaatagccacgatgatggcgaagcaggtccagccgctctggctctcctgatgcttgccggtgaagatgtagctgaagtaagtgacgatcggaatgaccacgatggtcaggccgttgtagccgatggagccgccgaaggaaccgagggcggtgtaggtggagcgctcatgggagtcggaggacagcgccgggatcatgccccagtaggaaatgtcacgcagggaatagaacacgtcaagcacgatgaacgtgatgacgaacaacacgatgaacagtgtggtgttgacgtttaccagaccgaacagaccggtatagacgagcacaagtagaacggcggaaacggtgccgccgatgagctgccatggcttgaaacgaccccacttggtcttggtgttatcgatgatgttgcccagcagcggatcgatgaagatctccgcgatacggatgacaaccacaaggccggtgataacgccgatgagcttggtagcgagcgccttgtcaacgccggagaacagcgagctggtgacgtagacgatgaagtaggtgctcagcgcgttgtagaaggcggattggccgacgttgccgaatgaataggccacgcgggacagcagactgcctttcctggttggcttcgcagactgctgcgtctccttcggtgcggctgcgacattggattctgccatcgtacttctccttagaagttgtgattgaagctgtaatcggaaatcatcatttgatttcgcatgagttaagtatatccctttacccctgtttagtaaaatttaacatctgcgttgtgcactattgggcgtgtcgcattttgtgcgattctgcacatatacatgtcatattgtgtgcgattcgcggtatttcgccgacagtagacaaacaaaaggcgattgatgacgcagcatcatcaatcgcctttcatatttttccgcacatacgtacgctaggcagcccgtttcgaccgggcagatcgcttcgatcgggtctgcaattttggccgcgattcacgtttcggctgcgccggcacgaaactatctcgcacttccagcgtcgtcgacaggtacgcatgctgccgtactgtgcgcttgctggcaatcgcatcggccaaggtgagaatcgcaacgcgcgcaagctcgttctggtcgattgagaacgtgctcaacggtggcgacgtaagctgtgcgatcgcctggttgttgatgctgatgacgctgatgtcgcggggcacgatcacaccaaccgcgttgaacgcctgcagcacgccgaccgcgatgatgtccgccgaaacaataactgcgtcaggcagtgcgccgttgtggtcacggataaactgctcccccagcttgcgaccattctccacggtgaacaagccgtcagaatacaccagtccacgcaggtcgagaccataacggcccatttcacgccgaaaatatgtggcacgcccctcttcgtccacctcataaaaattcgtcagcctccccttgccgccgatgaatccgacacgcttcatgccagccttcgcacatgcttcgaccgcgtcatgcatggtctgctgtaggtcgggctgcacggaatcgaacaggttcggtgcgggattcacatcgatgaacacaccgtatggcatgacctcatgcaacttctcaaggtcgctttcggctatgacattggcgccgatagccatgaaaccatcgaatttccccttctgattcaacatctcgtcaagactgtggaaaacagtgagctccatacgctgctgtttggcgttatgttccagcgccgaacgcaaatcggcaaaatacgaatcacgcagcgtttcgtcggactcctcgttgtccaacaaggctacttcgtgcggaatgacgatacgcttggcttgggcgctgtaccccagatcctcgctggcacggataatcgcacggcgagtctcctcacgcaccgacagcgtcggatcgccattcaacagacgcgacaccgtggcctgcgaatatcccgtgcgtttcgcaatctccttgatggtcgccatcgctccctcgccctcccatggatgcctcatcagattttagtaaaagcattactaaatccatcatattacattaccaaacgtattcttatagccatgacacagccagagcaatcacggaaaccgcgaatcgcgcatcagtccacggaacggatgaacgaactgcgtgcacaacaaaaatcctttgccctgcagaacatgcggagcaaaggactcggcaacgccggtctgcctttcaaagcgaccggtcataaaggtggcatcagtcggcagggttccaaacgcggctgacaccgcggagaaacgcggtcaccgtcagccccacgggcctgcggctggaagcgcccgcccttctgcgtggccgacttgccatgtgagccgcccctcgatgacgccacgctccgcatcggttctaccggacgcgtatacatcaggcctctccccggtgatgctgcggatggaaccatacacatatccacatttttcacggagacggttgcggggctgccggctttccatataccgtcagcgcatggaaagctttggacacaatacatttttcacattggagcaggcacgggaggaggcggcgagacggcatcttgaatgcaggcaggtgttgtcgcggataaggtcacgctcctcgcttccactctatgtaagccacggcacagcgctggagctgcatggcatgattgccaccatgaattatttacccggatatggttcggagctcgttcacgtttcagtgtgccggcaacgtgacctgcggaaaatccaggggatgaaattccattacgcaaggcatggcgtagacgtggtgcacgccgacgaattggtgtcaagcgtctccgcgatgcaggcggtctgccagattgcgccctatgtcgacgaacggagtctggtgatcgccatggattggcttacttgcgccaatcccgatttacgcgtctgcactcacgatgagctctccgactacatccggagtgcgccgcgattcattgggagcgccaaatgcagaaaggccttgcgcctgtccaaaccaggtaccgattccccgcaggaaacggtgcttcgtttggagagcgatgcctacgggctgcctgaggcacatgtcaattatgagatcattgaccacatacgcggctcgggcacgatgaaggtggatatcgcctacccggatgaccgcgtctgcatagaatacgacggaaattaccactacacccacggccgctggatgtatgacctcgataagcgcaaccggctgagggatcttggattcacgccttttgtcgccacccgcgagcatttggcatccaaacagaagctgaacgaactgttcggcatggtcgcccgagcgatagccagtcaccgttacggcttggactagttccgtaggtggtttttcgcttccgtaggtggttgggtctgaatacccagcatgaaaacggccagaataaagcctttctccaaccccgatactctgaccaaccacctacggaacacccaaaccgcctacggaaccgcatgagtagtccccgcaatggatttttcgccattgattcggggaatccatgaaaagccacagcgggcgcaccctgcgtaaaaggtcatgcccgccgattcatgggagccatatgcgcaagggccgtgcggaagccacatatgtggcttccgcacggcccttgcattcgttgaacactaccgttcagcctgtccaattcaccaagaacgggacaggaacgaagcagaaggagccttactccagttccacggcgcccgtgtacagctggtagtactcgcccttctgcgcgatgagctcgtcgtgcgagccgcgctcgatgatgcggccatggtcgagcaccatgatcacgtcggagttgcgcacggtggacaggcggtgcgcgatcacgaacacggtgcgtcccttcatgaggttgtccatgccggcctgcaccacttcctcggtgcgggtgtcgatggatgaggtggcctcatcaaggatcatggccggcgggtctgccactgcggcgcgtgcgatggagatcagctggcgctggccttgggacagaccggagccgtcgccttcgagcacggtctggtagccgttgggcagcatgcggatgaagctgtccgcgttggtgagcttagcggcggcgatgcactcctcgtcggtggcgtcgagcttgccatagcggatgttgtccatcacggtgccggtgaacaggttcacgtcctgcagcacgatgccgagcgacttgcgcaggtcgggcttgcggatgcccttgacggagatgccgtcatacaggatcatgccttcctggatgtcgtagaaacggttgatcaggttggtcaccgtggtcttgccggcaccggtggcgccgacgagcgcgaccttctggccgggcttggcgaaccaggtgatgtcgtgcagcacgggcttgtccgggttgtagccgaaggtcacgtcggtgaagcgcacgtcgccctgcagcagggtcaggcgcccgtccggcgaggtgatcgcgttctcgcgcgccttcctcgccacttccgcggccttcgggctcagcgactgcgcggccttcagggaacgggtgccgtcgtcgccttcctcacgcttccaggcccaatggccggtttcgtggtccacttcggtcatggtgcggccgtcttcgccgagctcgacgttgacgagtgtgacggagccgccgtcgtcctcgggcttctcatccatcagctggaagatgcgggacgcgccggcgagcgccatcatcaccatgttgaactgcatggagacctggccgagcgggttgacgaaggagcgcgacagggtgagcagggagatgagggcgccgagggtaagcttgcctgcgccggcgagaccgaagttgcccatgccggagagcgccatgaatccaccgacgatggcaagcagaatgtagaggatgtagcccatgttgcccacgactggcatggtcacgttgccccaggtgttcgcttcggcggaagcgtggaacagttcctcgttcttctcgtcgaaggtcttctgggtggcgtcctcatggttgaagaccttgatgaccttctgaccgttgacggattcctcgacgaaggcgttcacatcgccgatccacatctgctgcttgacgaagtagcggccggagcgggagacgatggcgcgtacgaccacgaacaggatcgcggcgaacacgagcacgaagatcgtgaccggcaccgacagccacagcatggagaccagtgcggccagtgcggaaatcgcggacgagaacatctgcgggaaggactggctgatggcctggcgcagggtgtcggtgtcgttggtgtagcggctcatgatgtcgccgtgctcgttggtgtcgaagtagcggatcggcagcgtctgctggtgtgcgaacatgtcgtcgcggatcttcttcagggtgccttgctcgacggtgacgatgagccactgccatagccagctgcagaaggtgccggcggcgtagaggcagcccatcagcgtcagcgcacgcagcagcgggctccagtcggggttcttcacgccgaccaacggcagaatgtagctgtcgatcagcgactgtaggaacagcgcggaaccggcttgtgcggccgcaccgatcaggatgcacagtacgattgccacgacatgccatttgtattggaaaatgtagccgaagatgcgcttagtggttcccggcgcggctttctgcggtaccttcggtccaccgtgcggcacggcatcggggcgcttggctttgtttccctcctgcgggtgcatgccctgcgcggttttcttattggttgttgcactcatgtctgttcctcctttcacttcagttcctcaggctgggcctggttcttggtctgcgattcgtagatggaacggtattcgtcgcaggtccgcagcagttcctcatgggtaccggatgcggtgatgcggccttcctccataacgagaatcatgtcggattcctgcacggatgcgatgcgctgggcgatgatgatcttggtggtgtcgggaatctcgttgtggaacgcctcgcggatcagcttgtcggttttggtgtcaacggccgaggtggaatcgtcgagaatcaggatcttcggcttcttcagcagtgcgcgtgcgatgcacaggcgctggcgctggccgccggagacgttggtgccgccctgttcgatgtacgtgtcgtacttgtccgggaactcctggatgaagccgtcggcctgcgcgagctggcaggcgtggcggatctcctcgtcggtggcgttcgggttgccccagcgcaggttctcggcgatggttccggagaacagcacgttcttctgcagcaccatggcgacttggtcgcgcagcacttccatgtcgtagtcgcgcacgtcgacgccgccgaccttgagcgagccggaggtcacgtcgtacaggcgcggcacgagctgcaccagactggacttcgccgaaccggtgccgccgacgatgccgacggtcatgccggaacggatcttcaggttgatattgtcgagcaccggcttttcggagttatcagagtagcggaagtcgacgttgtcgaattcgatggacccgtcggccacttccttgatggggttggccgggttggtcaccgtgctttcctcgttgagcacctggcagatacgttccgcggacgcctgggaaatgatgcacatgacgaagaccatggacagcatcatcatggccatgaggatctgcatggcgtaggtgaccagtgcggtcaggtcgccggtggtgagccccagcgcggcattattgcccgaggccacgatctgcttggagcccatccatgcaatgaggatcatcgagacgtatacgcagaccatcatgagcgggttgttgaagctcatcacacggtcggccttgctgaagtccttgtagatgcgctgggagatgcggccgaatttggcgatttcatgcgattcgcgggtgtaggacttgaccacgcggatgccttgaaggttctcgtcgaccacgttgttgagcttgtcgtaggtgtggaacacgcgctcgaacaccgggtgcacgtacaccgccagaccgcacagaccgaaggcgagaacagggatgcacgccaggaacaccaaggaaatggacgggctgatgcggaacgagaagatccacgccacgatcatcatgatcggggctcgcacacccagacgaatgatcatggaataggcgttctgcaggttggtcacatcggtggtgagcctggtgatgatcgagccggtggagaacttgtcaatattggtgaagctgaagccctgcaccttctcgaattcgtcatgacgcaggttcttggcgaatccagcgccggcgatcgcggcgaacttaccggcaaggaagccagccgcgagcgaacatagcgagcacgccagaagaatcagaccgaatttgacgatggcgggcatgcttttgccggtgatgccttcatcaatcaacgacgccatcaccgtggggatgaggatttccagaacaccttcgaccaccacaaatatcggggtgagaatgctgggcttcctatattcacgcagcgatttgccaagcgtgcgtacgagatgccgcttttgttttggctgcgattgcaccgcagccgttgtcacgtttgttccgctcacttactcttcctttcctgtttcgtcttcctgtgatgttttccgtacagttggttgcgattcgcattcccgcgattgccgttcccgcgattccgcctcgcacaatgccaggctggagtagcgactttcgtcgccgatcagcccggtggagaccagattggtttgcatcacgtcgagcacgtgcatgaattcgcggatctcgtcgtcgctcaggccctgcagcagaatgccttccatggcgattgcgctggtgcgcagcgcttcggcgatgtcgcgcgatttgtcggtaagcacgattttcttcaaccgcgcgtccctcggcacggattcgcgcacgataagccctttgcgttccatcaatgcgagcactctgctcgacgtcgaccgggtgatgccgaagcggcgttccacatcctgcgggaagatctctcgttccgaatggcgtgcgaggaaggtgatgatgtcgatgttgccaccgctcagactctccacttccatggggcgcgtcaccgcaagataccggttgatgacgttgtgcagcgatcggatggcgacgctcggcggcttgcatgcgcctcggtcccacgcttcggtgaacgcggggttcaccgaagccgttccatcgttctgtatatcgttcacggaacatacgataacacgttgtacatacaacagttgcatatgcaacattcagcgtgtcgtgtgtgacggaaccggatcgcagcacaccgagcgcaatattgtaatcgcaaaatcgcttaaaaatagccaaaaataagctcggaacaagccgaaaccaagtatgaaaaagccgaggatgtggtccgtaccggttcattcgcgggccacatcctcggcctaaatccttgaaactccttttgcttacgtcttgtttacgtcaatccgtcttattcggcggtttcggcgattttggcgtattcgtcgagcatgaaggcggtgatggccttgccgccgtcgctcatcagcatcggcatggagttgatcggcatggacttgaggaacatgcgcatcatgtcgttgtcgggcagctgcggcagattgccggcctcgccttccgcatacacggatgcgacgattttggagccgaccggatcgtcggcccattcgccgaacgtggaccattcgtcgagcggcagggccttgccgtcgccgtcgagcgtgacgacggccacggcggcgatgtcgcggctggacgtgccgacttcgacggtgtattcgccggcttcgacatgccagtcgttgaacttctcggaccagtaggcgaaggcgcgctcgtccagatcgaaggagatctcagccgattcgccggccttgaggaacacctttcggaagcccttgagctcatgcttcgggcgggccacggaggccttgcctggagccacgtagacctgcacggtttcggcggcgtccacgtcggacgtgttggtgacggtcgcggtgacgtgtgcggtgttggcgccggtcttggcgacgttcacgccgtcgatcgcaaaggtcgcgtagctcaggccgaagccgaacgggtagtcgacggccttgtcgtacgtgtcgtagtagcggtagccgacgaacacgccctcaccatagtcgacgtgcccctcctcacccggccagttgatcatgctcggatcgtcgttgatatccatcggaatggtctgtgccagcttgccggatgggctgaccttgccgaagatcacgtcggcaagcgccggaccgccggactggccgagcagccaggattcgaggatgcccttggcgttgcccgcccatggtgccacggagacgacggagccgttggacagcaccacgacgatgttcttgttttcggcggcgacggcgttgagcagttcgacctgcttggctggaatgtcgagggtttcacggtcgaagccttcggattcggcggcttccggaaggccgaggaacatgaggacgacgtcggcgtttttggcggtttcgacggcttcggcttcgagcttggcgtcggccggttcgaggtcgagggtgaagccgggggcgaatgcggcgtcgacgccccgcgcggctagggtgtcgaggaagctggtcatcttggtcggggtgatgtgggacgatccgccgccctggtagcgcggggtgcgcgcgaattcgccgatgacggcgattttcgcgtttgcagcgaccggcaggatgttgccgtcgtttttgagcagcaccatggattcgatggcggcctgatgggccacctcgtcgtgggcgtccacgtcgaaatggtaatcgtcgatgctcatggcggcgcgcgtcttgttgacgaggtcgatcatgccttgggccatgcggtcgagctgttcgggctggatgcggccgtcacgtgcggcgtagacgatctggtcgtccgtgtagctcggcggcatttcaaggttgaggccggcgttgagggaggcgacgcggtcgtggtcggcgccccaatcgctcatgacgatgccttcatacccccattcgtcgcgcagcacgtcggtgagcagccagcggttttgtgcggaatgcacgccgttgatgcggttgtaggagcacatgatggtccatggctgggcggttttgacgatgtgttcgaaggccgggaagtagatttcacgcagcgcgcgctgggagatgttggcggatacgcgcagacggtcggtctcctggttgttggccgcgaagtgcttgagcgaggtgcccacgcccttggactgcacgccggcgacgatgccgactgcctcatggccggccagatacgggtcttcggaccaatattcgaagcagcggccgccgagcggattgcgcttgatgttgactccggggccgaggatgacggccaccttctcctggatgcattcctccgccatggcctcgccgaccttgtggatgagttccgggttccaggagctggacaggccggctgccggcgggaagcaggtggcgggcacggagtcgttcaggtcggtttcgccggtgctggatgccagggatttgcgcagtccgtgggggccgtcggtgatcatgtagccgggaatgcctttggtttccacaccctgcaggtgccaggcgtcgccgccggaggtgagggacgccttctcttcgagggtcaggtcgttgacggaaggataagcggtgtcgctcatgagctgcctctttcgtatgtcttctgtgtttctggtgcctttcggctattttctcggccgtctcgcgattgtttcgcggtgggacttcaaccccgaattccctacctaccgattggtaggtactttatcaaaaaacaatacgcaacacgccaatcatctttgaaaaagaaaccgaccgaccgtaatgtgaattacatattccaataacctccagcaacgacgggagcacattatggccaacgacgaagtcgaccgcagaagcgcgattctcaacgcggcggtcgaatgtttcggcacgctcggctactacggcacgtcgctgcagcgcatcgccactatggtgaacctcaccaaaccgggcgtgctgcattacgtcggcagcaaggaagggctgctgcatgcggtgctcgacgaaatgtacgaccgtgagaccgaggacgtcaccgccggcatggtgcgagacgaacgtccgcttatcgccgaaatgtggcgcaggacggtggcggtcaacgccaaacgacccgaattggtgcacatgttctccacgttgagcgccgaggcacttaatcccgaccatccggcgcatgattatttcgccgaacgcgaggaacgtatcgtggaagtggccgcgaacatccgctggcatgtgccggaaggcgttgacgccgagcaggtgctgcgttccggattcgcgatgatggatggcgtgcagctgcgctggctgcgggttccggggcgcgacctgaacgaaatgtgggcgcgctgcgaggacgtcctcttccccctgccacagtgggagggctatcgctgaccatgaggtatctgctggcaccggattcgttcaaggaagccgcttccgcgcaggccgtggctgagtcgatacgccggggcgtggcggccggcgatcccggcgccgaatgccgcatgatgccgttgtccgatggcggcgagggattgaccgacgcgctggtccaggcaaccggcggcgaattgcgatcggagcacgcgcatgacgcgctgggccggccgatcatcacacgatatggattccttggcgagggcggtttcggaacatctcacgatggagagaatcctcgcaccgcggtggtcgagttggctgcggcgagcggcatcgagcgcatctcccccgccgaccgcgatccgttggcggcgtccactttcggcaccggcgagctgattcgcgccgcgatcgacgccggagcggaacgcatcgtacttggattgggcggcagcgccaccaccgacggcggtattggcctggcccgagcgctcggccatcgtttcctcgatgcggacgattgcgagctgccgctcggcggcggcgcactcccccggctcgcccgcatcgacgacaccgaggttcccgacgacgtgcgaaacatcccgatcgtattggcatgcgacgtcaccaatcctctgaccgggacggacggcgccgccgccgtgttcgcgccgcagaaaggcgcggatgcgcagcaagtggcgacgcttgacgccggtctcgcccggctcgccgacgccatcgaggcgctgaacggccgcatgatcgagaatcggcctggggcgggcgcggcaggtggtaccggcggtggcatgctcggcctgttcaacgcgtccatgcgtcccggcatcgagctggcactcgatgtgctgcatgcgcgcgaagcctgtgcatgggccgatgtcgtgatcaccggcgaaggatcgatcgacgaacagacgccctacggcaaagtgccgagcggcatcgcacggctggcgaaatcgcaaggaaaaccggttatcgccatcggaggcaaggtgacgcgggatccgcagaccatggccgcattgcgtgaagccggcatcgtcgcgacgttcggcatcgcgccgggcccggccgccctgccgcaactgctcgccgacacggaacgcaacgtggaagccacctgcgccgcgatcgccgggctgctgagcgtagcgcgcgaatgctcatcgagacctcatcaatgaggaacaggaaccccgcctgttgcaccggtattgaggactactttggggtcatcatcaacaggccactcgcctgaactagattttcacatctgcttacggtaagtattcacgcaagagcggaaccgcgaaatcaacttcgccgcaaccagtctgacgaatgacatatgcatccagcaaccgcttgcgaatatgtttggcattgtcgatatcaaaattatcaaagctatcgaaaaacgacagaagtgaagccttccaccgcgcatgaccagctatgcggcgcgcttcgagaagcggaacatgagcagggccaggatctcacccgtcacggccatgccgaagaacacccacatgctggtggaaaacccggcgacgtaggcggccgcggacttcatgcccgcgacacggttcgctgcggagaattcagcgatcagcgtggacgcaaccgcggtgccgatagcgccggcgagctgctgcacggtgttcatcaccgcggagccgtcggcgttcatcacagccgacaactggttcagcgcatgcgtctggtcaggcacgagcacgaatccggatgcggccatgaacagcgcgtaggcgatcgcgacggcccattcatgcgcgccgccgagcagcatcgagacatccatgattgccacgccgacgaaaccgcaggcgatgaatttcggcgggaaatgcgctttcagcgcgccaccgatcagcggtgcggaaatcgcgccgattaccgcacccggcaacagaatcagcgccgcaatcatactggtatgacccatgccgcgctgcaacagaatcggcagcaggaaattgacacccagcacaccgccggatgacatgagcagaatcagcatgcccagcgtgaaaccggggaatgcgaacgtgcgcacctcgatcagcggatgctccatcctcagctgcacggcggcgaacacacccagcaccacgatcgcgccgacaagcaccgtccagaagcgccagtcgccgttccactgcgcgaagaagctcgccgccacgatgatgccggccagaccggccgccaccaataccagcgacggcaccgacagatgccccttcccgccgtggcggatgtcggggacggtagcgcatcccagcacgagcgagatgagcaggaacgggatcatcgtgtagaagatccaatgccagttgaggaattccatgacgagcccgccgaacaccgggccgatggccggggccgcgcaggtcaccagactgaccaggccaagcatcatgccgcgtcggttgaacggcgctttctcgaggatgatgttggtcagcaatggcagcgagacgccggtgcccaacgccatgatgagccgcgccgcgagcaacatcggaaagttcacggcgagcgcgccgaccaccgtgccggctgagaacaacgccaccgcggtgacgaacagacctttggtggggaatgtgcgcaccatgaacggcgaggtcggaatggcgatggacagcagtagcagatagccggtggtgagccattgcaccacgtcggcggagatggcgaactcccccatcagcgtggagtacgcgatgttgagcgacgtttcggacaggatgccgaggaaggtgaggatggagagcgccaccaccacgatggtgagtctgccttcgctcatggtgccggcggagctggctgccggtgttgtccgatggttgtgtcgttcgtcgtggatgctcacggttctccttgtcgtgttggcgtcgtcggcgttgacggccgccggcgatatccgcatatcgtattgcctcgcctatatctagggaggaaaagttacgcgaaattgcatgcgcgtattcggacacgcccccgattgcgccaatgctgcctatgatgagatgaaagcgtgccgattacgaagggggcgcatcagtataaggagagactgatgagaaggacaccgttgcttgtgttgcgcggcggcggccacggccgtcatggcgctgggcgtcaccgtgcaggcgcaatgcgccgaaccgtatccgtccaatacgcagcagccggattacacggcattgctcaccgatttcaccaattattaccagccggatctcaccgcgccttccacggagctgcgtggacgcgtggtcaatgcagaggtgctcaaggaaaacagcgacgccacggtgtcggtgaatcataaggccaatgaggggcggaccagtgatgacgatccgctcaatcctcagcagcagcgcgcattgaaggacagtgattcgctgatcgaaaacacgtactccgatgcgcttggcccggttttggggaggtttctgagcgagggcatcaagcagggtgatctgccactttccacaacgttgttggtcaaacggcccggagaaagcgacatcggcacggaacggcacgcgttgctgtcacggtatgtgaacgattccgccgtgaagaagcagtatgtccatccgcgtccgttcacggatcgcacgaatggcggctatgtggctgccggtctgccgaagaccgagaatatcatccatctgccggtgtggacggacgattccggcacgcagcacaaccccggctatgacacgctcgcccccactggttcgttcccttccggtcacaccaccgtcgcctattccggcggtatcggcctggccacgctgctgccccagctcgcgccggagatcatgacgcgcgcatcggaggcggccaacaatcgtctgatcgtgggcgtgcactatccgctcgatctgatgggcgggcgcatcatcggagaggccgggcttgcgacgcggtggtccgatgaacagttccgcaacgacaagttgatgccggcatatcaggaaatgcaggcgtatatggcgaagcgttgcgtgggcgccaatatcgttgcccgcgcggcggatgatccgacgaccgtgcagaattgcgtgaccgcgttgaacgcgaattccgccgattcctccaagccgagcggcggatacaccaacgatttcaccgacgatttcagtacacagccggtgaccaaccgcacgtcggcattggccgcctatcaggcacgcatgagctatggattcaagccgacctccgccaccggcaaggccgccgtcgtaccggaaggcgcggagaatctgttgaccaccgcgttcccgacgttgaacgccgaacaacggagggccgtgctggccgccacggagattgattccggcgaaccgttggacgcaagctcgaacggctatcagcggctgaatctcgccgccgcctacagcgccaaagtgacgctgtccgcagacggttccgtggtcaaggtggagccggggcaggccgtcgcctccgtggtgcgcgagggcgccccagctaagcccggctcatccagcggaaggagcgatgccactgccagcaccaccaaaaccattgcgaacaccggctcggacatgctggctccggcaggcatgatggtcgcctgcttcatgcttggcatcggattgatgctgacccgccgacgcgcgtaaggcaataggtcgggtcaccctatgggaggcccgaccttcactcacctattgaaacggcaacgacgccgatgctcattgcaacctgtactccagatacacctgctcctcttccatgagcccttggagcaatgcggcccccaccctgcgatgcggaatccgcaccgttggcacaggcgtttcgccggctcgttatgcgcataggtgtcgaggcggacgaccgcgcagccgtgcccggccgcatattccttcgcgtattgcaccatccggcttccatacctgtggcccgcgaaccgcggcggcacgcacagcgtatgcacgacaagcacatcctcgccttcgccgggatactgccatgccacgtcgtcgtattccgcgggctgggcatttcaatatcatgctggcacggatctcaccatcctcttccagcacgatcatctccccctgcgggcacggcgcgcttcggtacagcgatcgtcgggtatacgcccaattcccaatgggaatcgcctccatgctcctgctcgtaagtcagcaggtcctcgtaggtcgcggcgatcgccgcgatatccgcagatgttgcctgtcgtatcatgctatttcttccttttcgaaccccggtgaaccgtaaccgatgtgtcatggcgagattccgtagagggtttcactgttccgtaggtggtcgccggtggtatcggggatgaggaacggctttattcaggccattccttcggcaggcattcagccccaaccacctacggaacccgaaaaccgcctacggaaagaccggaccttgccgtgactcccggcccgtatgcatgcatggagccgataccgcaaccaagaagtcattgtagaaccgcccacacgagcaatgtccgccaaatacgacatgcgctgcggcgacttgtgaaattacctgaatcatcgtaaaataccaagtggtaattaaaggacaccgcttcaacgaggaaagtgagcaatccatgaccaacaccaccgacctgccatacaagaatcccaacctgcctgccgaagagcgcatcgccgatttgctcggacgcatgaccctcgaagagaaggtcggccagatgatgcagcttgatgctcgcagcggcgatctggatgacctgatcgtcaacaagcacgtcggctcgattctgcacacctcccccgcggacctgccccgcgcggtcgagaccgtgaacacgaagacccgcctcggcattccgctgatcatcggcgacgactgcatccacggctattccttctggccaggctccaccatcttcccatcccagctcggcatggcaacaagcttcgacacggccaaggttcaggccgcgggccgtgccaccgccgaagaggtctccaccaccggcgtgcattggacgttctcccccgtgctgtgcatcgcccgcgacacccgttggggccgtgtggacgagacgttcggcgaggatccgtatcttatcggcgagatggcctccgccatcgtcaagggctatcagggcggcgccaaagctggcgagccgctcgccaaggatgcgattctggcctgcgccaagcatttcgccggctattccgaaacgcagggcggccgcgacgcttccgaagcggacctgtcccaccgcaagctggaatcgtggttcctgccgccgttcgaacgcgtggcgaaggagggttgcggcacgttcatgctcggatacgaatccatcgacggcgtgccggtcaccttcaacaagtggctgctgtccgacaagctgcgcggcgactggcactaccagggcacgctgatcaccgactgggacaacgtcggccgttccgtgtgggagcagaaggtcaaggccgattacgtgcacgccgccgcggacgcggtcaaggccggcaacgacctgatcatgaccacgccgaagttctacgaaggtgccatcgaggccgtgaagaccggcctgctggatgagtcgctgatcgacgaagccgtgtcccgcatcctcgcactcaagttccgcctgggcctgttcgaagatccgcgtctgccggaccaagagcgcatcaagacggttatcggctccaaagcccatcaagagctcaacctgcaaatcgcacgcgaatccgtggcgttgctgaagaatgacggcgcattgccgttctcggctgcggcgggcaaacgcatcgccgtggtgggcccgcttgccgatgacgcgcaggagcagttgggcgattgggccggcaattccggtcaggtcaattggatgccggatggccagccgcgtgagatgatcaccaccgtgcttgacgggttcaagcagcttgcgcccgaaggatgcgaggttgcgtattcgcgtggcgcgaacatcatcgatttggtggacgatccggaaggcgagttctatccggatggccagcctcgtccgaagctcgccgtctccgccaagttcgaccagcaactgctggatgaggcggtggacaacgctcgccgttccgaccttgttgtcgccgtcgtgggcgatgtggtgcagttggtcggcgagacctgctccaccgccacactggaactgctcggcgggcagaacgccatgctcaaagcgcttgccgacgtggcccgcgagaccggcaagccgctggtcgtggtgctgatgagctccaagccgcaggtgatgccggcatgcgtgatcggcacgaatggcgtgatcgtggacgaatccacggccgacggtgtcagcgcgttcatgtgggcgccgaatccgggtatgaagggtggccaggccatcgccgaaatcattcttggcgaaaccgagccgagcggacgtctgccgatcaccttcccgcgtcatgcgggccagctgccggtctattacaaccagatccgtggccagcacggcaatcgttatgccgatctcacgcaggatccggcgttcgcgttcggcgagggcctcggctacacgaccttcgcatatggcgaaccgacaatcacgaacgttccggcttccggcacgttcgccaccaccgataccatgcatgtcgaggttgcgctcaccaacaccggcgagcgcaaaggcaccgaagtagcgcagttgtatatcggcgatatcgtgacgtcctacagttggacggaccgcgagctcaaagcgttccagcgcgtggagcttgagccgggtgagaccaagaccgttgcgttcgatattccggtttcggagtgcactatcgtcgattcggatgccaaccgtatcgtcgagccgggcgagttcgaagtgttgattggccattcgagccgtcgtcgcgatttgaagcgcaccacgttcactgtggcgtagttgtatgcgatagtgcgattgcgttgcgtaaccacattgcgtaatcgcactattcaataccccctttcgctcacgcaaagtaaatcaagccgtcaatatacgtatgtgagcgaaaaggggtaatcgtatgccattatgcaaaatcacaaatggcggaattccaacgtttcctatttctaaaatcagataattcagcgcacgtatgcgcaaaaacgcacttttccgcaatccgtgagcaaaagggtggcttgcgattggactcgtgcaagccacaaaccaccaatcaaatcgcaaatcgcaatccgtgagcaaaagggtgcctcacgcaaaccaaaccgcaaaccgcaagtccaaaaaccgcaggtcgaaaaacgaaagcagatagacaatcatcagaatcacgcaatcgcaaccaaccggcggaacggacacgaccaaatcaataaatccgaatcagcggtaggcgtcccacaggggctcggggaacagcaggttttccatttcagcccattctgcgcataggtcgacttccggttcgcgcagccaccacagctggatgccatccatgatttccatggccttgcgcaccaccggccgcatgctttcctcccatgagccgagttgcggcggaaccaaccatggataacgggaataatgtgcccagatgttgtccattcgttccatgaattcatcatgcagcggatggtccgggttcagggattcggccgacagcacggtgaacagctgcaccatcatgcgccggcgcgagttgtgtttcaccaggtagcgcaggtatgcggggaaatgcggcgcggatgggtcgctgcccggcatgcccgatgagaagaagtcctccggagtgccggtttgcccgtagtattcgtcatataccagcgccagcatcttgtctttgttttcgacgtatcgcagcacgccttgtttggagatgccgacccgatcggccacgtcctggatcgaaatgccgttgaatccgcgttcgctgatgagctgcaccgccgcatccagcacttccgcacgacgctcctgcggcgatttgcgggtacgtttcgaagtctcttcctctgccatgactccgagtctaatgccctttgcgtcgattgccgttgattgacggcgccgatgccacgtcatcgtggggcgtatccgcttgaatccatccatgacgccatacgcgggttagatcccatgcttcgagattgccgccgttgcgcgggtcgcgtggcggttttccttcgccgctgcctggtttcgcggaacgcgcaagctggtagctccaatagacctgccccgccgacgcatcccatgccgcgcgttgcaatcgcgatacttgacggtatgcgtccgctcggtttcggccgtgcagggcccaccggttctccacgcaccactcgcccacaagtacagggatatggcgggccgccgaacggatggcgatttcgcgcgcacccaccagcattcggtacagccatggcaggtgccgcgattgcaggtacagtcggcgtgccggtcccgcgaacaacggttcctccatggcgatgagatattggtgggtgtcgagcatgacgttgcgcatgccggaacgacggaaccaatcactccagcggagcagtcgaaagccgtcgtggaatacgatcagggtttccggacgtagtatggcgcgcagccgggtgtaggcgtcacggtagaagcgcttcagaaaccgtagtgggacatgcgtgctgccggaggcctcgcggacgtccttcgccgtattcgacgtgccatggaacaccgaccagctcaccggttcgttgagcacttcgatgctgtgtagggtcggctcgtcacgatatcggcgggccaatcgttccagcacattcagcgcgtattccaccaagtccggattctgcgcccatttgcacacgcccgtcagaccgccgttgtcgaaaccattctgtgagccgggcacggtatgcaagtcgatcatgatcttcagtcccgtctcccgcgcccaacggaacgcgcggtcgaggtatgcgatgcagcccggatgtccgggccaatcgccgaagatgaaatatggtatgggaatgcgcacgagattgagcccatggtcggcgatgatgcggaaatcctccagggtgatgtaggcgtcgcggtgccggcgcagttcctcggcgagattccgttcggaccagagggcgccgtgcgtgcggtgcatccagatttcgtcatcttcggcagtgcgaacgaatggttccggatccatccatttctccagcaccagccagttgccgaggttcacgccgttgattcgctcgtcgatgcccagcaccatgcatcccaccgcctttctgtgcggggtttcgcccggcttgccgtttccgcctattcaaaaaccaaacagctcaaaccaaacccctatttcagcccaatgggccaaggaacgcaccgttcgcaacgctccttggcccattgtatgcgtcccgcaatcagccacgcggccggttggaatcggaccacggccggattggggtttcggaatgatcgtggccggatgggcgggatcagtcgaccggcttcgtctcgtccgcctcgtagtcgaagaagtcgaagtcggcagtcttctcgtgcagagcggcgtcggtaacggcgatgccgaccatggtgccagtgaattcgccgtacttgcagtattcgtcagagaaggtggtagtgtcgaaatccgggccaatcttggtccagttctcgccatcataaccccactcgaaccaagtacgacgaccttcgatattcaaacggaaatagatcggcttgtcttccacagcaacgcgagtgtcaagcatttccatcttttcaccgttttcgagacgcacaatcgaaatcgcgctgccgccaagcgtctgtgaataatacttgcgcaggaaaatattattcatgttgtcgtagtagatggtcaagccagcgctgtgctggtagacttccggctcgaactccatcttggtggttaccgtggcatacacgctcgtcagcttgcgagcaagcaggctcgtacgattcagcgaggcaagcgattcctcaccacgaacacgcaaccagcccgggcgttccgtagcatttgcaaacgtgctcggcatctgacgcggcgagtaataccagttacccagttcctcaccatcgaaatcgtcaaggcttggaatttccggcatcggcacatctggcagattcggctcctcgacttcgatctttgccagattagaaccatcagccatacgcaaccaaccatcaggcgtccactgcatcttctgaatggcggtctcacggccaagcgtacaacgcaattccggcacaaacggacggctggtcaggtgcacaagatatgtctcgccgttcggcagatccacgtaggagccgtggccggacttctgcaatacggaatccgggttgaaatagcgcggcttcaaatgatcgtcatcagcacgctcgtttgactccttcggctgcgaagtgacgagcggaccattcggatccggctcatacgggccccacacattgcgggaacggcccatggtcacagaatggttgtagccggtgccgccctcggcgcacataatgtaataccagccgtcacgcttggtcagatgcggagcctcaatgcagccacgatcagtagcgccacgccatatacgcttcggatagccaaccacatgcttggtttccggatcatattccacacagcagatcacacccggcttctcatagccttcacgggtctcccattccaagctgacgatgtacttcttgccattgtcatcatgcaaaatggacgcgtcgaaaccggaagatgtcagatataccggctcactccacggaccttcaatgctcttcgacttaatcagataattattcacgtcgaaatagcgtgcattcatggaattcataacgccgtaaatcacgtagaacatgtcctcttcctcacaatacgtgaggcatggagcccaaatgcccttagcgcttggcagcttggtgaggttcggattcgtatcatcagtaagcacgtgggtgagcagctcccaatgcttcatatccttcgaatggtaaatcggaatgcccggaaaccattcgaaggtggagacggccacgtagtagtcgtcgcctttgcggcagatggccggatcgggattgaagcctttgaagatcggattatgcagcattgtcgttccttaatgttcttgatatcacgcgttgctttgtacgattcttgcgtccgacggaatcacttttggacggggaaccaatcttgggcgatgcagcgtccaaggtcccatgcgtcccagccgatccagccgggagtgttgacagtgtcagtgagcagcttgtagttccagtagtagaagccgctgcccttgctccatgcggcgagctgggattcggctacgccctggtacagcgagcgcttctgttcggcggtcagggtttcgacctgagccccttcctcgccgttgagcacgctttgtccgccgtgggtgtccacaccgcagccgacggagttgaacaggcaccactcccccacaatcaccgggaagtattcgctcatctcggcgatcatcggcgcataggtattcctcacgaagtcgtcgtagccctccgctgtctgcgggcaacccatcgtttcggcggtcatgaggtattggtgggtatcaaggaccacgttcttaaactcgggcgcgagcttgccgtcggggccgcgcatgaagtccttccactgttcgatgtcgaaaccgtcgtggaacaccaccgccttgtctgccggcaatgcgcccttgtcggcatcgcgcagacggtggtaggcggtgatgtagaagttcttgagccagtcgaatgcgatcgggccggtgccttcggcgagttccggatcgaccgccttgtagcgttcggtcacgttcgccatcggccagcaggtggtggtgttcggctcgttgatgatttcgatgcccatcagcgcccgacgatggccgtaccgcctggcgaggcgttcgagcacggacagcacgaattcgacctcgtcgggcagctgcgcccacttgcacacgccggagatgccgccgttgtcgaagccgttctggctcatcggcgcggtgtgcaggtcgatgaggatggtcagaccgtatttctcggcccagttgaaggccttgtcgagttcgtcgatgcagccgatgaacggcgcgcggtcgccgaagatgaagtacggcacggggatgcgcacggagttcagtccccacgatttgatggtggcaaagtcgcgctcgttgatgtattcggcgcggtgggtcctgatgcgggcctcgtagacggccggatcgagttgcgtcggcagatagtattcgtcatcggcagtggttccatcgaataatgccgggttcatccacttttccagaaccagccagttacccaggttcacgcccttgatgtaatcaagatccatatgcactccttcgtacgtcatgcagtttctattacttagtaactacttagttatatcgtaatacatttccgttccacacgcaacccaatctcgtcggcatcccacggcgaaggactgctcggatgagaaaaaccaccaatacaaacaaaggtgcccgccgcgcatggaggggatccatcgcggcgggcacctcatgggcagggcgccggcgatcggcatatcgccgggaaaaagggaaaaaccggcattacgcgcgagtcgacgccgtatcactccggctcagtccagcacgaaagtgttgaacgatcgcggagcaagcgttaccttgaaaccacgttcggtggcatcgggatcggcgaattcgaacgggcgctcctcgtcgagggcgttctgcgccacgaccaccaccgtgccgtccggattgcggaaggcgatggccatcgagttgaaatggccagtggtgccgagcaccttcgcgccgggcctgacgaaatgcgagaagtgacgcatcacgtagtattccggattgcggcgcacctcatgcgtgtcggcggtgatggtgaacagggagttctgccaccagccccatgtggaatcctggtcgtcaagaatcatgttccagtaggtgtatgcggtggcgccgttgcggaagtagtggttgatcagatggaagatgtactccgcgtactcccagctgttgtcgccggtgccgcattcggactccgactggatcagctcgatctccggccatgattcgtgcgtgcgggcgatgcagttctggccggcccactgataggcgatgcccttgatgtacttgcgcgcgccgtcgtcgaagaggatgttgtcgacgaagcggttgtagttgttgagcgtcatgccatagccgccgccggtccaagccatgtcctccgggccgttgagggtgcccagccagatgtcggtgtcgagtccggcctcgtcgaacgccggtccgaggtagtcgcggatgaacaccttgagcgcttcggaatcccacagggcgctcgggaacttctggtcggcgaacacctcgttctgcacgtgcagctggttcacagtgatgccgtgctcggcgtaggcctggatgtacttgacgaagtacttggcgtaggccttgaggttctccggggtctgcacgagacggccgtagttgtaggccttcgggcgcttcatccacgtcggcgggctccacgggctggagaacagctgcatgttcggctgccattcctgcgcgcggtggatgtacgggatcagggtctgctcgtcgtgttcgacggagaaatgctccatcccgtagtcgccgtcgacctcgtcgtagctgtaccagtggtcggcgaaatcattggcgccgacgggggcgcggttgaaggtgaagttcatttcgtcggggctgaacagctccttgatgatctggtcgcgttcggcttcgctgacgttctgcagcggcagccagccgagttcgttgaagcagccgccgaagccgcgcagggcctggtattcgttgccgtcgagctgcaggtcggccgcggtggtggcgttggtggattcgatgtcggaggttcggtcggcaagcttgtcgtcttgcgtcgttgcaatccaggtggtcatgatgttccttggtatcgtcgttgataattcggatattcgttgatggttggcatggatgggaggcggggcgattcggtcccgcggaggggagacggcctatggcacgaccgtctcccccggtttacagcagctgccttacttgaccttcttgatggccatgatgaagaagcagccgatgatggccaatgcgatggacgtcgggaacgcgaagttgtagccgaggttgaccacgatggcggacatgacgaccgggccgcacatctggccgagggtggtggccatgttcaggatgcccagatccttgccggcctcttccttgttcggcagcacgtccaccagcagcgcctggtcgacggcggagtagacggcgtagccgaggcctgcgatgccggcgaacaggtacatgcccatggtggacttgaagatccacggcatggcgatgccaacggcgaacagcacggaggcgacgacgaccgggaccttgcggcggccgatgagatcggagaccgggccggagatgaaggagccgaccagggacatgaccatcatgatcatggacacgacggacacggtgacggcggattccttgacggactgaccgatgtagttctggatgatgtacagctggtagacgttgatcatctggtaggccatgagcatgcagaagcggccggcgaacgccttgtagaagtcatgcgcggtggagaacttcggcgggcggaaggaggagaggatgtccttggcggagccttcgtccttcggcaggaagtctgcggactgctccttcgggatgatgatcacggcgaccacgccaccgaggaacatgagcacgccggcgacggcgaagcccggaatcaggttttcgatgaacagtgcgccgagcatggtgccaatcggagcgccgatggtggagccggcgccgtagaaggcggacatggtgccacggatcttggaaggcacacggtcggacaggatggcgaccatcggcgcgatcatgcagttcagaccgaacatgcaggcgcagtagaagatggtcagcagcacggcgttatgcgtggtgccggtcaggaacagggtgacgccaccgagcacggctccgaagaggatccacggggtacggcggccgaagcgggaacgggagcggtcggagaagttgccgaacatcaggttggcgaccagggatgcgaccgcggtgaacgcgttgacgatgccgaccaacgcatcggcgttgacgcccgggatggtcttgtagtgcatgggcagcagcactgcggaaacgatgcccagaccggacatccacagcactccgaataccaggaagcctgcgccgaaacgtgcggcgttcatcttggacagcggcttgccggtttccggggacagcgacggatccttttccgccgcggcgatgttggcgttgtaagcggcaaggcgctccgccttgctggcgattgcttcactcatgaaactctctccttcgaatcatgcttcagtagtgaacttatgttgtgtgcgattccgcaccttagcggtgtatgtggtggtgggacggcctcgccccatctgttaactaccatgtggtaactaacgtgttttcagcgtaaaccatctttcgcaaagacacaagtcgacgtcatgtcatcgccgtctcaaagcgtttgcaaaaccggtcggacactgtttcattcagcttcacagtcaccggtttttattacctagtaactgcttagttaaatcatattataaatcgtttgtctgcgataatccggcgtgttccaagggttcccatcgtcttcttctcccccttcttgtaccttagtaagcaccagatgaaggagagcatatgcgtcgccgcaccgaaaacaaacccagaaagcgaatgagcgccgaggatcgcaggaaggcgattctcgaaaccacggtctcattcatctcccagttcggtttctggggcttcaccatacgcgatgtggcccaggctcagaacatcaccgaagccggcctcctttactacttcaaatccaaagaacaactgcttgaggaaaccctcaaatacgccgatcggaccaatcagatcgccatcgccgagcatcttggcgtgcagggcgtgaccggcgaagtccttgacgacggcatcgcgtaccactgcgatctggggctgaaggccatttccacgggaaccgtggagaccaacgccgaccgtccggagatggtccggctctacaccttgctggaaagcgaggcgctgagcaaggaccatcccgtgcacgagtatttcgaacagcgcgaaatcaatctgctgaaggaatacgcgttcgcggccaagcgcgacggcgtcgccgatccggagcgcaccgcgctgcaggtcctgtccgcgatggaaggcctgcagctgcgctggctcaacggatcgcatgacgtcgacttcatcggggaatggaaggccatcatcgacctgctcatcccctgacccagcgggccgacgcgccaccaccgctttgcggctcagccggcgatgacgaccacattccagcggccgatcgtcagcctgtcgcccacctcgaccttcgagccctccttcagagcgatcgccgcggtggcggattcatcgacggtgccgtcggtgcccaccaccaccggagcgaccaccacatcgcccgacaccgggctgtcgatggtgacctcgtcggcggagtagttgagcagatacgtcacctgctcgccgcgggcgttcgttccgcggcgcaccgtcacctgtccggcgagcgcggtgccggcatcggcgatgcccgcgtgttccacggcttcacgcaggacggcgcggatggtgtcggcgtcgagcagggtggcaatccattcggcgtcgcccttgccgaagccatgtcgggtcaccgcggcgtaattcttccacgcgtagtggccgtagctggcgagcacgtcggtgccgtcgaatggggtgaccagttcgatgagcgcctgcgcgtcgcttgccggggttttggcgagcgttccggcgaattccacggatacgtggccgttcgggcgggtgaattggttgtaggtcatgccgaacacgtcggtgaggttgtgcggcgcgcggtcgtgccatacggtcacctcgtcgtcggttacgaaggagcgcatggtggagacaaggtggccgccgctggagacgaattcgcgcagacggtcggttgtttcctgcggagtgcagtacagtgccggggtcacgatcatctcgtatttggccaggcgttcggccggcgcgtcggacgggatgaaatcgcattccacgttgagttcgaacagcgcgtcgtagatgttgcgcaccacgtcgttgtacttgagggtgccgccgaacgggaagccggcttcgatgaggaaccagtcgagcgcggtcagcgattcgttgctgaccatgatggccaccttgttgtgcttcttcaggtggacgagccgctctcccacttccggtttggcgatctcgcggccgaacacgcccgcctcgcggtaggtgggattcggttcgaggtcgtggctcagcaggcccttccaatatgtttcaaaggaattgtggatggagtgccagtgccaatattccaccatgtcggcgccggaggcgaggtgggagtaggcctgcaggcgcagctggcccgggaacggcacccaaccgtgctggccctgggcctccgtttcgagcaccaggtagttcctgccgtccttggtggagcgggtcatgtcgccgccgaaggcgatctccctgccggtcaggtcgtcctcggtggggtggtagatgtccacgccggtgatgtccacggcggtcgaggccttgaagtggtcgacggccggctgcacgccgtaggagtatccgcgccattcgaaatcgaagttgtgggtgatgaactggtcgtcatgcgcgtattcgcgcacgatgtcggcctgccactgcaggaaggcgcgcacctggtcgcggcggaacttgtcgaattcgccgcccagggactcgttgatggtggcggtcacgtccgggaagtcctcccaggagtcgatgcggttggaccagtagtcgaggccgaagtggtggttgagctcgtccagatcgccgtggaacttctcgcgcagatacttgacgaacaggcgctgcatgtcttcggagacggaatcgtagtatttcgtctcgttgtccacctggtagccgatgacggccggatggtcggcgacgtgggagatgagcttgcggatcacacgttcgccgtagaagcggtaggtggcgttgacgatgtccatgatctggcgcgcgccatacttgccctgtccgttcggcgtgaccgcgagcacgctcgggtcgagcttgacgagccagctgggcaccgcgtaggtcggcgtgccgacgatgacatcgatgccggcacgctgcgcggcgttaagcgcgcggtccacataagtgaagtcgaacacgcccggctgcggttcgcaggtgctccatgtggattcggcgatgcggatgacgttcagtcccgcagccttcatcatcgccatgtcctcatcgatgtggtcaatgcccttcatcatgagatattcgtcgtaatatgcggcgccgaacagaatgtggtctgcttcgtaacggcccatgaatcctccatcgtcctcgttgacttttatatctaacggttattagatataagaactatatatcttccgaaacaaatcgtcaactgtcgcagattttcaggcgtttcttaactaacaaccattagatatatgtcttcggaaggcttaccgatatccgtcccacaccggcgaggggaagatcatccgctcgaagacgagccactcgtcgtacaggtcgatcggcggcttgcgcgtccaccgcagctggatgccatccatcgcctcgatgcattgccgtacgatcggccgcatattatcccatccgccgacttccggaggcaatttccatgcgaaccgcgaataatgctcccacgtcagatccggtcggttttcgaaatactcgtgcagtggatggtccgcgttgaacgattcggtttccaaaaccatgtacagctgcagcagactgcggcgttgcgcattgtaccggaccaggaaccgcagataggcagggaacagcatgccgtccgaatcgctgccgggcaatcccgacttggcgaagtctgcaggcgtgccctgctggtcgtagttatcggtgaccagcagcgacaacaaccgttccttgttgccgatgtagtgcagcagtccgggctggctcatgccgatggcgtcggcgatgtccttgagcgacgtgccgtagtaccccttctcgccgatcagcttgcccgccgccgcgatgatttcgcgtttgcgctcttcgggcgatttacgaacccgctttttcccctcggtaaccatatggaacagcgtaccatcggacggaccctcggccggtcacgcctggaagacgtccggatgcttcgggtcgcccggttcgtcggcgagcacaccctcaaggccgaggaactcctgccagaattccaacgaattgccgtatgggatggcctggcttccgcgcgcctgcaggttcgccttggcctcgaacacgtcctcctcgcggatgccgtcgaagtagctttccagacgttcgagattcgtcggatcgtagaacagcgagccgatgatttcagtaagccgctcggcgcgggccaccggcagcgaatcccagtggcggaattcgatgaagttcttcaaacgcacgtcgttgaagtgcgtggagatcacatggttgatctcgtacgcgttgagcccgcggtccgggtacacgtcgttcgcgttctcgtagaacgccggatggtgcagatcggttccgggcaccgccagcgcttcgggcgtgtgcgtcaggtcggcgaacatcatcggcgtggacagcacgtccaccgcgtaatcctcccaaccgaaacgcgggtcgaacaggccggggatgacgttcgtgcgttggaaatcgagataatcccacatgcgttggcgcagcagcggatacgggttctccctgccttcgaaatacggggtgttgcggaagaaccatgccagaatcgggccgatcaccgtgcccaaccgcagtttggcgatcgcgtcctgttccgaaacgtagtcgatgctgacctgtgtcgaagcggagcaacgcatcatgcacggaccgaactgtccgacacgtcccaggtaggcggtcatcgccttgtatcggtccttcggattgacgggaatgtcggcgtaactggatttcggttggtaaccatagttgacgagtcggaaaccaagttcttcgaggatggggtcgacttcgcggcggaacgcgccgtacaatgtggcgagctcctccggcttgtgcaggatgccgatggacgtttccaactgtccgcccggttccaaagatacggagatgccgtcacgggcgagtccgaccagtcgcccgttttcccagtattccttgttttcgtcgtaatacgggcggatgcggttgagcaacgcttcaatgccgttgctttcgtagtaggtcaccgcggtatcgtcgctgttatgtaccggcaggtgttcgatttccacgccaaaaccgccggtgccgcgctgttggcagccggattcgaagaatttgataaggctttccacatgcttcggattcggctcggtcagcaggtgcgcgtacgtgatctttggcgttgtcatagtggccatcctaacgaaaagcgccattcgcaacgcaggctacgctatacggaaaatcgataaccgaccatcattccccatcgatttggctggcgatttgaatgccgattcgacgaccatcgattttacgatcgccgaatcagccatcgatttggcggctcagataccgtcgaaccgacgtcggaaagtttcccaacgtcggttcgacggaaataagaatggcgattcaagcggccttctcgctgttgcgcgcctcttcggctgcgcggtgcgccttcttggcagcggagatcatcagcttgatgcggttgagctggttggcttccgaagcgcccggatcgtaatcgatggacacgatgttggcttccggatgcagtcggcggatcttgccgaacatgcctcggcctgtcacgtggttcggcaggcaggcgaacggctgcgcgcacaccacgttcgggcatcccgattcgatgagttccaggatttccgcggtcagcagccagccttcgccggcctgcacgcccacggacgtgacctcgtcggccttcttgaccagttcaggcatcggcagatcctgcgagaacttgccgtgagccagatcgatcgcctcgcgtaccggagcgttgtacaggtcgaggcccttgcgcatcagcgcatagccgatcttgctgccgcccatgccgaggtaatgctcgttccagtcggaaatgtacggtcgggtggtcatgaattccatgatgcccggcaccacggcctcgcaatcctgcgattcgatgacgtccaccacatggttgttggcgtccggctggtacttgacgagaatctcgccgaccacgccgacgcgcaccttgcgcggctcgtccttcaacggcaacgcgtcgaacgacttgacgatctccttgacgagcgtcggatacggcaggtaacccttgctgatgaatttgcgcgccgtcttggaacgaccgtggtgttcgagcgcctcgcgcacgatggtgtcccacgtcttgtacagctggttcgcgctgccgggtgtcacttcgtacggacgcacgcggtacaggcacttcatcagcagatcgccaacgataagcgccttgatggcacgatgcagcaaagccggcgtggcggtgaagcccgggttgtcctcgatgccctgcgtggagatggcgatcaccggaatctgcggataaccggcgtccaccagcgccttgcgaatcaggccgaagtagttggtggcacggcacatgccgccggtctgcgtgatcgcaagcgcggtgtggtccggatcgtatttgccttccagaatcgcgtccacgagctggccgatgaccatgatggccggatagcaggcgtcgttgttgacgtatttcaggccggtttcgacgtcctctcggctggcatgcttgaggatgtcgaacttgtagccgccggagcggatgacggattccaccagagagaagtggatcgggctcatctgcggggcgacgatggtgtagtccttcatgttcttgccgaacgggatgcggttcgcatacttggacagggtcgccgagttgtgtgcggacgcgcccttgccatttgtctgcgttttggcggtttcttgcgattcgcccttgccgttttccgccgcgcgcttggatgcggccgtgacggcttcggtgagtttcggattggctttcatgacggtgtcgagcatgacctggcgaccgggggtcggcgcttcggtgccggtcttgcggaatccgtcgttcttcttgttgcgttcacgctcttcgacggccgccttgagcgagcgcagacggattttcgccgcgcccaggttggagacctcgtcgattttgagcatggtgtacacgtcggccttgtccgccaggatctcggacacctggtcggtggtgatggcgtcgaggccgcagccgaaggagttgagctgcacgagctcgagtcccggataggatgcgacgaagttggccgcctcgtacagacgcgcatggtaggcccactggttggtgacgcgcaatggcatcttggtgaccttgcggtcgtcgacgtggcggaagccgttcgcgttcttcttgcgcggatcctcttcgccttcggcgaggaattcgctcaggttgagcttctcccccggctgcagttcgcagatggagtcttcggaaagcaccaccatgccgagcgcgcagatggtctccgggatgccgtggttgatttccgggtcgacgtggtatgggcggccggcgagcacgatgcccttgcagtcgtgttccttcatgtaggcgagggccttgaggccttccatctgcacgtcgtgcttgaacacctcgttttcggcgtaggcggccttgaccgcggtctcggcttcctcgcgggtcacgttggcccaggcgaattcctcgacgatgcggtccaccatgagctcatggttggccatgttgaagtacgggcgcatgtagcgcacgccttcctcgcgcagttcgggcatgttcgcgccgatgaccaccggatagttggccacgaccgggcagttgtagtggttgtcggtgttgggaacgaagttctcctcatagctcacgcacgggtagaagatcgtcttgatgcccttgttgagcagccacttgatgtggccgtgcacgagtttggccggatagcagatgttctcggaggcgatcgattcgatgccggtttcgaacagttcgtgcgagctgcggccggagatcatcaccttgaagccgagcgaggtgagcagcgtgaaccagaacgggtagttctcgtacatgttgagcacgcgtggaatgccgatttcgccgcgggtggccttcttgtcggtcagacgacggtaggcgaagcaacgcttgtatttgtagtcgtacaggttgggcctgtcggaacgctgcttcttggaatcgccgccgcgttcgcaacggttgccggtcacgtagcgggagccatcctggaatgtggtgatggtgagcttgcagtggttctggcacagcttgcacacgtcacgttcggacgtcatggacaggttgtcgaggtcgctgccggacacgatgctggatgcggtgtgcgtgacgcctgcgatatcgaccgtcttcgcaccttccgtagcggcggaatcgccgtcgtcgagaccgtcggccacgtcggaatagtgcatgcgtgcggtcaacgcggcgccgtacgcgcccatcaggccggcgatgttcggtcgggtcacctcacgttcggtgagcagttcgaaggcgcgcagcacggcgtcgttgaggaacgtgccgccctgcaccaccacggtgtcgcccagctcgccggaatcgcgcagcttgatcaccttatacagcgcgttgcgcaccacggaatagcacaggccggccgcgatgtcctccatcgaggcgccttccttctgcgcctgcttgacggaggagttcatgaacacggtgcagcgcgagcccaggtcgacgggatgtgtggagttgagcgcggcctgcgtgaactcctggatcgtcaatcccatggactgtgcaaaggtctgcaggaacgaaccgcagccggacgaacaggcctcgttgacggcgatcgagtcgatcacaccgttggagatcgccaagtatttcatgtcctggccgccgatgtcgatgacggcggtaacgcccggcgagaccatttccgcaccgcgataatgggccatggtctccaccacgccctcgtccagatgcaggccggtggtgatcagtccctcgccgtatccggtggcgcaggagcgtgctatccacgcgccttccggcagctggctttgaatctgcttgacgatgttgacagcggccgtcagcgggctgccttcgttggtggcgtacgacgaccatacgatttcgcggtcgtcgttgacgagcgtcgctttgatggtggtcgacccggcgtcgatgccgaggaagtgcgggccttgcgcgccttccagcgtgccgatgtgcacatgctcgcggtggtggcgcttgttgaacgcctcacggtccgcttcggtcgggaacagcggaggcatggtgggggtgttggccggcagattcttcaggtcttcaaggcttttcagaatatcggcgcaggtgcgtgcttcgaaatgctggccctcctcaagctggtccggttcgccggcgagcagcgcggagccgaacgccacgtacaggtgcgcgtcggtcggcacgatgaattcgtcgactttgtcttcgagcgcgcggtggaacgcctcgcgcagttcggacatgaagaacagcggaccgcccaggaagatgacggtgccgtggattggtcggccggacgccagacctgcgatggtctgcgtggcgaccgccgtgaagatggatgcggccagatcgggcttggccgcgccgtcgttgatgagcggctgaagatcggttttggcgaacacgccgcaacgggaggcgatcggatagagcgtctcgtaatgcttggccatgtcgttgaggccagccgcgtcggtgtcgagcagggtggccatctggtcgatgaacgcgccggtgccgcctgcgcaggaaccgttcatgcgctgttcgggagtcggcttcagatatgtgatcttggcgtcctcaccgccaagttcgataatgacgtcggcttgcggatattcctcgtcgatggcgcgggtctcggcgatgacctcctgcacgaacggcacatggagattatcggccaaggcaaggccgccggaaccggtgatggccagacgaatcggctcgtcgccgcggccacgggcctcaagttctttgtggatgtcctccagcaggcccgccacggtggcacgcacgttggcgtggtggcgacggtaatcggagaagagcaccgcgtcgagcgaatcggtctgatcgagcaccacggccttcaccgtggtggaaccgatgtcaagacctacgcgcaacggcttcgtatcgcaggtgttgtctgcggtaactgctgcttcgaccatgtactgtacctctatcgttctcatccgccgggttgcgtccgtgccaacacgaacgccctgccccggttatccaagtatgtaatggtagtctgtgcccctgcctaattccaaccgtccgtacacgaaccgttcgaaaccattcaggaagccgtcccctcccctgcgacgcggtccttgccgtagatttcgggaatgaaccgcgtctgatcgtgtagtttcgaccacagcaccacctgcccgctttccaacgacttgggtacatcgatgatgcgctggttggagctgccccggaactgcagcagcgaatcgtgcagatccttgatataccggccatccacgaggatatcgatctgttcgagcagttcacgcttgtcggggctttcgccttcgcgcatgagctcctcccacgtgtagcccgtccagcaccagatgtccttggtgcggccgaaccgctcacggatcttgcgtgaaagcggcagcagcacgccggtgttgagcagcggctcgcccccgaggaaggtgatgccctgcacgtacggcaggctcagatcggccatgatctgagcttcgagccggtcgttgtattcgtggccggcgcggaaatcccagatcgacgagttgtagcagccttcgcagtggaatgggcagccggagacgtacagcgagcagcggattccctcgccgtcggtcatgaggaaccgcttgtagtcggcgatcatgttgtggctcatcgcgttcgtccattgtccggcgcgcgggttgctggcgcggtttgtcggaatgaacggcccgcggccggtttcgccggccgcgaaatcacggcgagacacagcgggatcggcgctgcttaccatacgttgctcctgaattgcctgttgttttgcgattattgcgattgattacttggcttcctcgaaccattcgcgttcggaaccgtcgtcaagggtgacatggccggtttcgccgctcatgtgcttgacgcggtgcgcgatttcctcgtgtcggccgtgcaccatcgggcgctgcaccggattgccgaggtagccgcaggtgcgcttggtcacgttgcagcggtccgggtcggagttgccgcattcggggcacttgaagccttcttcggtcggttcgaagtcgccttcgaaaccgcattcgtagcaacggtcgattggcgtgttcgtgccgagatagccgatgccgatggtgtaggcgtagtcccacaccgcttcgagcgccttcggattggcctgcaggcacgggaattcgcagtagttgatgaagccgccggacgcgtagtacgggaagtccttctcgtagtcgagcttctccatcggcgtgggctgcagccacaccgggtagtggaaggagttggtgtagaagtcgtggtcggtgacgccgcccacttcgccgaacttctcgcggtccatgcggttgaagcggtcggtgagcgattcggccggcgtggagtacacggagtagtggtagccttccgcatcgctccattccttgcacagctcgttcatgcgcttgacgatggacagggcgaattccttgccttgcggatcccagtcgtggtcgcgcatccagtccttgccatagaacacgctggtcgcctcatacaggccgatgtagccgagggacacggtggcgcgttcgttgcggaacagctggtcgacgctgtcgttggcgccgagacggccgaatgcgccgaagcggaacagggtcggggcgttgaccggagtggcctgcttgcaacgcatgatgcggaactgcaatgcctgatgggcgacggtcatgcgctcgtcgaagatcttccagaagcggtccttgtctccgtgggattccaatgcgatgcgcggaatgttcacggtgaccacgccgaggttcatgcggccgtcctcgacatccttgccggtcttcgggtcgatccagccctgcaggaaggaacggcagcccatcggcgctttgaaggagccggtgatcttcacgatgttctcgtagaagatgacgtccgggtacatgcgcttggtggcgcattcgagggccaactgcttcaggtcgtagttcgggtcgcccggatcggcgttcacaccgtgcttgatggtgaagacgagcttcgggaagatggcggtgtgatgctcggaaccaaggccgcggatgcggttgaggaagatggcgcgctggatttcgcgcgcgaaccagtcggtgccgagaccgaagccgacggtcacgaacggggtctggccgttggacacacggttggaattgatctggtattccatggtctgcatggcgtcgtagatggccttgcgggtctggatcttcgcccagatctcacgcagctgctgcagacggtcggacgtcttgtcgaacggctcgtccatcggcagtgccggacggtccttttcgaaatgcaggcgcttcggctcgacggccttggccatgcgcacctgacgttcggcgatctcgatcggcagatcgtcgggcatgatctcgtgggcctgctcaaggaacttgtcgtaatccttcttggcgtattcggcgaaatgctcgtcggcgcggttggcggtctgtccgccgtactggctggaggccacgtccttcatgatctgggtgatctgcgtggcggcgatggagatgctgttcggcgaacccatcggcgcgttgccgagggtgaagccgttggcgagcatatcccagtagttcggcagcgagcagttggactgcgcggtgaacggcgagtaatcggcgtcgtggaagtggatgtcgcccttcatgtgggcgttggacaccgcgtccggcagcatggagaaggcggacgccttggacaccgcgccggccagcaggtcacgctgggtggagtagacgttggagtccttgttggcgttctcgcgcaccagagcctcgtcacggttcaccagacgcttgacggcttcgttgatgtcggtggccttggcacgttcgatgtctttgttcagacggtagttggtgtacgtgcgcgccacatcatacaggtgatcttcgatcaggccgtgttcaacgagattctggatgtcttcgatcttggcgggaccgttgtaacggtccttgatttcggcctcgacctgattggcgatgtcgcgaatcagccgttcctcctgaggaccgattttcttgtcgaggtcggcgaaagccgatttcaccgcgctgatgatgttgatcggatcgaaatcgaccacacgcccgtcgcgcttctcgacaagcaccttgaccatttccggcgcgttctcggtttcggtcgcaacgccttccagagtctgggtttccatgtatatttcctttccgggccggacccatccggccaggtttcatgcttcgtccgcatgcccgttcatacctacagatgcacactctacgccaaggtcggcactaaatgtagtgtcaccacgccgctagagaaactatatattctacttttggtgagatttcgccattttttgccttgtgtgacaaaagtaacgatttcatctcggagtgtcgttttgacacagccccacacaccgtactatcttcacgcacggagcattcgcaacactcgaacatatgttccatttgtccgcaagatgatggaatcttgacttatgacttggaacccggattacaacccaccgacggcacagcagacgtcgaagccgctgccccgtctggcgtcggaaaccaccgccgacaacccttggccggtgagcctgctcagcgagaagttctacacggcggtcgaacgttggccctccgtatgggtggccgggcagatcacgcagatcaacacgcgtcgtcagggaagcgcctacatcacgctgcgcgacgaccagcaggacatcgctatggaagtcaacggcttcggacggttcgccgcggcggcggcgccgtttgtgcagggcgaccgtgtcatcatccacggcaagccgaacgtgtggatgaagcgcacgtcgctgtcgttgcgcggcgacgcgatcatcgcggccggcgcgggcggcagtctgaaggccatgatcgacgagctacgcaagaagcttaagggagaaggtctgttcgacgccgatcgcaagaagccgttgccggaatttccgcattgcatcggcttgatctgcgcgccgcaggcacgtgcggaaggcgacgtcatcaccaacgtgcgtctgcgttggcccgtcgtcggcttcaaggtgacgcatgtgcacgtgcagggcgagcagtgcccgtcggacgtggtagcggccatccggcagctggatgccgatccagatgtggatgtgatcatcgtggcgcgtggcggcggcgctttcgaagatctgattggcttttccgatgagaacgtggtgcgcgccgcggcggcggcccacactcccctgatttccgccatcgggcatgaggacgattggaccctgctggatttggtggccgacctcagggcctccacgccgaccgacgcagcgaagaaggtcgtgccggacgtgcatgagcagatgcagctgattcaggtgaacctggaccgcatgcgcgtgcgcatcgatgccaccgtctccaacgagaccagacttatcgaaggctacgcgaaccgtccaagcctcacccagccgctcaccatgttggaaccgcatcagcgtttccttgatgacgcacgcacaagaatgcggatcggtctgacccgtattcttgacgacgcgagcctgaccatcgagaaagcgcacgcgtcgctgaccgcgctcagcccgcaatccaccctcaaccgaggctatgcggtagtgcagggagccgacggccatgtaatcgacgatgcgagcgccgtgaacaccggcgaccagctcaccatgacattgaagcacggcatgatcgtgtccgaagtcaccaccgtaacgaaggagcagcaatgaccaacaaaaccacccccgcatccagcctgaccgacaaggaacgcgaagcaatcgcgcagatgccatacgaggaggcgcgcgacaagctcatccaggccgtgcaggcgttggaggcgggcggcctgaacctcgaccagtccatgcggcagtgggagatcggcgaggcgttggccaagcgcgcgcagagcctgcttggcgaggtccgagccaagctcgacgccgcgcaggccgagcaggccaccgcggccaacaccgcaggcacgcaagacaatctggcctgagcatccgtcgcggcacagccgctcccctcacctacggacgttccaccggaacgtccgtcaaacggcttgagcccgaacaatcaggtccgattacccgtcatgtcgagtccatattgtgtgtacaatggtgactcgttgcctcagtagctcagtggatagagcacttctctcctaaagaaggtgtcgtaggttcgattcctatctggggcactttttcatatccccgtacattgtcggcgcgcatcgccatcggcagcatccaagatcaatcgcacgtccgcaatccggacaacaccatctcaccgccaccctccagcacaggcacaatgagcctccctctgttatagtggcaaacggatacttaagcggttgagtgaatgtatccaaaaggttcccccttctgctatggaagcatcggaaagcaaccgcacaacccatacatcacctttggaagaccaagggatcagcacgcaagacataccatattcctctattgtggaacggctggcgcacacgaatccggtaggacagttgcccggaccgctctcctacaagctgctcgaccagttcaccatgccgatgctgcccacagaaccgcaatgcacgaacgtcatcgcctgcatccgatattcgaataacatgccggtcgtcaccgtctagccacggacttagccgacccgcacaatcgccagcagcgctttgtggtcgctgccgtccactttgactgtgcgcacctgtccggcctgcatgccggaatccagtacgatatggtcgattccggcgaacgacggcacgtaatcgacattcgcaggccatgagaatttcaatccctcgccggcctgacgggaggcgtcggagaaacggtttcccagaatgttgcggaacggcgtatggtcgtacgtcgcgttgaaatcacccatgaaaacgtaccgtcggctagtgtcgaaacgtagtttcgccagttcgtcgagcgaccgcttccactgctgccagtaatcgttcgtcggcgacgtggtatgcacggatacgaaacgcacctgcgtggctcccccattgaacgaaacggtgccgcccggcatgaacgacgcgctcgaatcgacatcgtcatcggaagggtcgtcaagcggactcgccgaccaaaggccgttgccgtacacgccgtccgaactcgacacctgcgcatagggcagatacgaggcgatgccggcacggttcagatcgtccacgaaagcgtcggtcgtctcctgcaacgcaagcacctcgacgtgttcgctgcgcaccagatccacgatctcacgcgcatcggcgcgccctttgtacacattgcacgtcatcagccgcgcgtagccgtcatccgtgttgacggtttcgccggacgccgccgcgactgcggcacgtggcagtttcgaaggctggtagaagaacggatactgccagaacgcctgcaacgcaatcgccagaacggccatcacgatggacaccgtacgtttggagacgatggcgcagacgagcgcgattacggcgagcagcgtgaaccatggcactagggagacgacgatcggcatatacggcaacgcctgcagttcttccggcagaatgtgcgtgacagtgcccagcagcgcggcgagcgcgaatatgaaggcaatcaccgcgcagatgaagttgcgtacgcgatgcgttttcgtcttattcagcgtgcgtagcggcttgaccggtctcgttgcggccggttttgctttagcccgattcgctttggccgacgcttgcgatttgcccgttgccggcccttgcggctggcgtgtttttgcctgagccataccattcccttgttttttcggaacgcacgtccgcgaccatccatgtccgcccgtgtccgtttatgtccgttccgttgatgttccgacggtttccttcacgccttcggcttagtcgtcgaggccgagctcgtggcggatgccgtcgatgatgatgcggctggcggtggtgccgcgttcacgcgcgttttcctgcagcatcattttcagatcggatggaattttgaaactcatgagcacacgttcgccgttgccgttgccattgccacggctgcgggtgtcctgcacgctggtcagcggagcggtggacgctgccttcgcaccaccgttcggttttctaatggccatcaggcgatcgcctcctcaagttcgagatacacgtcttcatacccattgagattgctaggaaatgcgtggccgatgactttctgcatgcccacgcgcttgggtacggacgcgtcgaagacgctggcgccgcgttcgcggatgagattgaccgcgttgccggccagcttgttgttttccactttgagcagcagcagcgcgtacggtttgccggccgcgtcgaggctttccgcggtttcgagcgcatggctcagttcgaatggcccctgggtggccggaacgatgacgaaatcggccacatcgcaggccacatccaccacgttgccggccggcgggcagtcgatgatgacgagttcgtcatccgccatggttttgcgcagtcgtttcagtttgccgatattggcggagtccacggtgaacggcagggtttcgccggcgtcttcggcgtcgcccgcccatgtggtggcgtcgccttgcggatcggtgtccagcacggacacgttgcggttgtgccgtgcggccgcggtggccaacgccatggcggtggtggttttgccgctgccgcccttgaggttgatgaccgagatgatcatgaaggttcctccgcttcgacaatcaatttatataagacgtatatactttttatatattggatagacgacagtcacgctgacggcgtaacggcattggcaatgtaaaagatagtggcgacgcactcttgtcagttactttgacgggtaacgaaaaatcccgaggagctcagctcaactcgggattcgaaaagagtaaacgcggcgacttgctactctcccacaccctctcgagtgcagtaccatcgccgtgctaggccttagcttccgggttcggaatgggaccgggcgtctcacctaggctatgatcaccgcaagaggaaacaatacgcgaacatgcggcaatcggcaaacttcggcgtgtcgcgcactgcaatcgcgttccccaatcgccaatgatcgccagtaatcgcgcgaatgccggcaatcgcaatgcatatgcgctacagtcgaagcaatgccgcaacaattgcggcgtgcttacgaaagaaggccagcaatgacgatcgcctcctgcggttccgtttccgcaaccactttgggtctgccgaattccactgcgattcccgccgagaagtcgaagctgccgaaaggcctgttcgtggcgaagattccggtttccgccaaaacaaagcagcgattggcgaacgacatcgaatcaatcaccatgctgtcgctgctgcaggcgcgcaatacgaagcttgccgccggtacgcgcgtgccggaaatactggtgatcggcctgcgtttgcacgaaccaaacgccgccgttccgacggatatcgtcgaattgattgcgatgcaacgcaagtcgggcatgctgttcgtttgcgtacgcgacgccgatttcgaaggtacgacgcgtcaggagtgcgcgttcgccgtccgtcgagcgctgccggcacgtgccgggcacacgaccacatccaaggtgttcgcttccgattggcagccggccggcgaggccacgctgaacgccacggatccggcggtcgattccatggacgccttgtgggagtcgctatgctcgcaggtgattctggacggcccctcccccatcgacgtgaacacgcgtcttgcccgacgcatgcagattgcacagctcaccgcgcaggtcgacaagctcacccgcgaccatcagcgtgccaagaatcccgaacaacgcaatgaaatctacgcgaaactgcacaagacgaagcgccagttggaggaactgcaagggcagtaataccgccgtaatacaaagctcggctgcaatcgttacgattaccgagattccagtaattgcaacaattacagccgagccgtaagcgaggtttggcaacgtggccaaagcgcgctctcaacaacgcgccacagccgcgaagccgctagaaaccaagccttgtgcggccgaactggtcgagccagcgcagaatcgcaccttctcgcagcgcccacgggcagatttcgatttctttgacgtccagtgccttcataatctcatcgatcaccaggccaccgccgacgatctgatacgtacgttccggcgtgacgcccggcaatgcggtgcgctggtccggggcgatggccgcaagacgcggtagccaatcctcgagctggtcgatcgtcataatcgacgtgtccacacggcccggttggcgcatcaccgcaccggcgagacgggccagggagcgaatcgtcttcgacgtgcccacggcatgcatcggatgcttcgatttggggaacgacttgaccattggctcgaggatcttgcggatgttcttgcgggcagcttccagatcgtcatcatccgcgacgccgctttccggcaggaactcgcgcgtcacgcggccagctccggcaggaacggacagcgcgacggtcgggtcctcgtcggagcccatggccacttcgagcgagccgccgccgatgtcgatgacgagcaaacggccggcatcccagccataccaacggcgggcggccaggaaggtgagtcgggcctcatccacgccggacagcacggtgaccggctggccgatggcctcttcgatcttgcgtaggatcttgcctccgttcggcgcttcgcgtagtgcggaagtggccaggaccagcagctgggtgatttcgtattcttcggcgagtttcatcgccttttcaaccgcgctgagcaaggcttcgatgcctgcttttttgatgctgccgtcatctttgagatactgcatcaggcgaatggtgcttttggtgctggcctcgggctcggggcgcgcgcccggagccgcgtcgacgatgagcatgtggacggtgttcgaaccgatgtcaagcacgccaagtcgggtggcgtgcgaatgcaatgtaaccatggttcacagcttaataacttaagcgattaacctattgcacgacatgccttgataacctttgcaaatatgcccaccctcggaaaggagggtgggcacccaataatcacagtgcgggaaacgattgcatcggcgtgaaaaatcgcgcttcagacatatgtttcagccgaatatctcaaccatgcacctcagccacgcactttggctacgaaatcaccgagtcgcttcaatccttcgcgcagggcttcgcgggaagccgcgtacgacaggcgcacgtgcgtatccgcggtggcctcgccgaaatcgcggccaggcgtcaacgcgatatgcgcctccttcaacgcacgctcgcagaacgtccacgcatccaaaccggtgctggaaatgttgaaatacgcgtagaacgcgccgttcggttcgacttccagcggcagaccgatctcggccaaaccgtccactacaatgcggcggcgctccagcagttcctgacggcgttcctcgcacacggccagcgtttccggcgtgaagcaggcgagcgccgcatgctgggtcggcgtgtgcgcgcacaggaagaagttggtggcgaggtcgtccatggcttcgagcgcgtattcgggcacgaccatccagccgagcctccagccggtcatgccgaagaacttggagaagctggagcagacgatggcgtccggatcgcaggccagcacggatttcacgtcggatccgtccggttcgcggtcggccaggtcgaggtaggtttcgtcgacgatgcgccatgcgccacgctcacgggctaggtcgcacacggctttcagggtgtcgaaggcgatggtggtgccggtcgggttggacggcgaagtgatcatgacggccttggtgcggtccgtccagtattctttgcacagttccggcgtcaggtggaatcgggtggcggcggacgtcggcacgtccacgactttgccgccgaacgcgcgtaccagctcgcggttgcacgggtaggacgggtctgcgatgagcacttcgtcgtcatcgttgaccgtcagcgcggcggacagcagcagtgccgtcgaaccgcccgcggtaatcgcgatgcgtttcgggtcgacgtcgacgtggtgacgttccttatagaaatcggaaatcgcctggcgcagttccggcaggcccatcgccgcggtgtacggcagcggacggccgtcatactgttcgcgcatggcgtcacgcacggccggcggcgcgccgaagtccggctcgccgaggcttagtttgaccacgtcggtgccgtcggcgatcatctcatcggccatggctccgaacaccatggcgcggaacggattggcaatctgcgcgcgcttcgacaactgcggctgcgcgccattttcagcatttcccatatttcgtttttaccacgttccctgtaatgctgcctgccgacactcatttcacggaatcgtccacgatttcgcggtaaagccgttccaaccgttcgtcgcgcaccttcttaccgagctcgcattcccacaccacgatgactttccagccgtccgcttcgagttcggcgcgctgcctcgcgtctcgttcgtgattgcgcagcagtttcgcggtccagaattcgacgttcgatttgggcacgcgtgtggctttcggacagccttcgtgcatgtgccagaagcagccgttgacgaatatgatcgtacggtatttcggtagtaccacgtccgggtggcctgggtatcgcttgtcgtttttgcggaatcgcaagcctttggcaaacagaaagctacgtaccatccgttcgatggatgtgtctttgccgcggatgtgggacatggtgtagctgcgcgtgccccgctcgtatttttcgggtttgccggtttttctaggtttgccggttttcttgggtttgccggtttttccgggtttggctgtctgcctgcgatgctctgccgtcacggcttcccattatggcaaaagggccgatcaatcgttttcgcataacgcgtgccgccgtcgcatgtggcgtacgctggtcattgcaacgtagcaaacaggcagttcaaaacaaggagatttcatggcacagatcaatgtggcgattctcggcgcgggccgtatcgcgcagagcatggccgaaacgttggtgaaaatggcggcggatgaccggtaccgtgatctggtcgcaccgtacgcggtggcggcccgcgacggcgagcgcgcagcggcgttcgcggcgaaatatggttttccggtgtcgtacggatcgtatgaggagcttgtcgccgatccgaacgtgaatcttgtgtatatcgccactccgcataacttccatgccgagcaggcgattttgtgcatgcgcgccggcaagggcgtgctggtggagaaggcgttcggcgcgaacacgcagcaggcgcgtgagatattggacgtttcggatgagaccggcatgctgtgcacggaggcgatttggacgcggtatatgccgtcgcgtggcatgatcgacgatatcatcgcgtccggcgtgatcggcgaggtgcaggcgatcgacgcgaatctgtgctatccgaccacggcgaaggcgcgtatcaccgatcctgcgctggctggcggcgcgctgctggacgtcggcgtgtatccaatcaatttcatcgacatgatcatgcataatgcgccgatcgcacgtgttgaatcgtcgatgcaaccgtatgaaaccggcgtggacgcgcacaattcgatgacgttctattaccagaatggtgtgatggccaccgcgcaaagctcgattctgtgccattcggaccgtatgggcgcggtgtggggcacggaggggtatctcacgtgccagaacatcaacaatgtcgaggcgattgacgtgttcgacggctcgcatgccgtcaccgcgcattatgacgttcccgaacagttgaccggctacgagtatgaggtggcatcggccgcacaggccatgctggacgggcgtaccgaatgcgatgagatgccgcattccgacacgttgcgcatcatggaatgcatggattcgctgcgtgcggattggggtcttaagtacccgttcgaagcgtagcgatgcgatcgatgacgtgggcgtgacgcgctccgcccacgttataattgccccttgcggcgatttggaaacgcatggaaggagcgtcatgggattgctgaggatgctgaagtacgtgctgggcacggaagatgagacgcagcagccccggcaaacgcaatcctctgccaagaatgccaacaacgccaagtctgcgcggaccggacagaccaagcagacgggacaggttgcgcgacgagtcacgcaaccgcaactgcaaccgcatgccacgccgcaacgtcaatcgcaacgccgtcaatcgcaacgccgtcaatcgcagcaacaccaatcgcaacggcctgcaaagctcaccccgcaaccgctgttgccagccgaccgcatcgacaaggcgcgtggcatcatcggcaatatcgaaaagcacgaattgagcgacgagcagatcagcgcgatcgccggcgcaggtcacaacaccctcgtgcttgcgggcgcgggaaccggcaaaaccactaccatcgtcggatatatcgcatggctgcttgccacaaaacgcgccacccccgaagagattctcgtattgtcgttcaccaaggcgtccgcggacgaaatgtcgcaacgcatcatggcaagcaccggcaaaaggatccgcgcatgcacgttccacagtctcggcctggaaatctgccgtgcggccaccatcgccaaccgtcccatcatcgacggccatgcgtcgaacgccgtggtacgagacacgtttgaccggctgctcgcacagaacatcccctaccgtctgctcgcattcaagctcatgtcgaaggagctgttcggcaagtatggcgccgccgcgaaacgtgaggatttccaactgccgacggatgattacgctttcaaccagtacaggcaaagccttgtcgagaacgcgcagaccatcatccagcacatgcggcagaacaatatcggcatcgacggcatgcgcgagctcaatgagaggcgcggcggcaaacatatcggccgtaatcgtgagatgctgcagctcgtcgggccgctgtacaacgcgtatgtcggcaatttccgcgcgacccagggcatcgattttcccggcatgatcaccgacgccattcgctgcgtaaggcgcggcgcataccgccacccgtacaaatacgtgctcatcgacgaatatcaggacatgtcgcggccacgttacgagctgatccgcgcattgcgagagcagagcgatttcacgctgttctgcgtgggcgacgactggcagtcgatctaccgtttcgccggcagcgacattcacctgattctcgatttcgccgatatttggcgcgattgggggccgacacgcatgttccagatcacgacgacgcgacggttccggcagagcctcatcgatgcgagcggcgcgttcgtcatgcaggacaaaagcctgtacgccaagcaattgcgcaatccgagcgacaagaaggattattcgctgaaggcgcttggcggcgcgacgcaggaggaacggttcgatgcgatcgtcgagcagttgcgcaaactgccgaaagccgcgtcggtgctgatgctgggacgctaccgaagcgacctgaacctgctgtcacgcaacgaccgcgacgggctgttccaaatcgacgagcataccggcggcatcgtttttccggaaaaaccggacatggacatcaaattcatgaccgcgcacgcttccaagggtctgcaacgcgatttcgtttttctgctgtgctgttccggcggtttgaagggtttcccaagcgcgattccggaagagccgctgctcggcctgctgctgccggaagtggaacgcatgccgcacgcggaggaacgccggctgttttacgtggcgatgacgcgttgcaaaaagaagctgtttttcgtggtggaccagtcgcgtccgtcgcgtttcatgtacgaattgcacgacaggatctgtccgaacatcttccatggcgtgaagctgccgccgcaatgcccgaattgcggtgaggcattgcgattgcgacacaccggctccgacccgtcccgcgcgttttacgggtgcaccggtttccccaactgccgatacaccaggccatgcaagtgacaccattgggactgatttccatcgcgtaagttgctccccattcgggcctggcgtaatctcccccgttgtatcctggacctgttcattagtcaggagaaagcaatgacggcaaccgaccagaatccgcaacagtcagcgcaaccgacaccgcgcaaaaccattaacgtcgtcggcgcggctatcgtcaaagacggcaaggtgctgtgcgcgcaacgcggagaaggccgatcactggctggtttctgggagtttccgggcggcaagatcgaaccgcatgaaacggcgcgtcaggcattgcatcgcgaaatcgaagaagagttgctgtgcgaggtcgaagttgccaacgaagtgtgcacgtcttcttacgattacgatttcggtaccgtcgtgctcacgtcgtttgtgtgccatttgataagcggcgcaccccatctgaccgagcatcatgagattcgttgggtagcgcccgccgaaatgcccactttggactgggcgcccgccgaccgagaagcggtgcgattgatctccgccatggattttccggcttttccggcagccacgcacgaaagtgacgactgatgatgcgcaatatggacgaccatgaccattcctcccttgttgaggcgctgctatccggtttcgtcaacaaaaaggacaatgtcgacgcacagtacgagccgacgttgatcgccaatcatgacggtcggaccatggaatacgccatcaaggacgaactgcaacgcagtcaggatttcgacatgtccgtcgcgttcgtcagccagggcgcgttgcaggtgcttaagcagtatttccttgatctcgctgacaacaatgaccatcaggccggtcgaatcatcacgtcgacgttcaattatttcaactctcccaaagcattcagggaactgctgaaacttcagcgggaaaccggtattcaagtgcaagtttggcagccggagcggtccagtcgaaacgatgacgatgccacagctgcctacccttatcatcccaaaggctatgttttccatcatgcgcaaggcgacgagccgttgtattccacgtatgttggcagttcgaatctcaccatcaacgcactgaattccaatcgcgagtggaatctcaaagtcgccaccaccgataccagcggtcttgccgaacagcttagcgaggaaatcgaatcgcaaatcagcgaatcgaagccgctcaccgacgcttggctgaaactgtacgaggaagacttcgaaaagtacgcgccgcaacggccgaatcgcaagccgatcgaaaaaacaagccaatcgcaaaccattcagccgaacgccatgcaggtggaagcgctgatgaatctcgcacagctacgcaagcagggcgaaagccgtgcgatcatcgtttccgctaccggcaccggcaaaacgtatctgtcagcgttcgacgtgcggcaggtcaaaccgaatcgcatgctgtacatcgcgcaacaggagcagatcctcaagaaagctgaagaatcgttccaaaaagtgcttggatgcccgaaaagcgaactcggcctgttttcgggtggcagcaaggaatcggatcgcaaatacgtgttcgccaccgtgcagacgatgtcgcgtccggaaacgcttgcacaattcgacgcagacgagttcgattacattctcgtcgacgaagtgcatcatgcggccgccgaatcgtataaacgcgtcatcgaccatttccagccgaatttcatgctcggcatgaccgcaacgccggaacgtacggacggtgcgaacatcttcgaattattcggcaacaacgtggcctacgaaatccgcctgcagaaggcgcttgaagaggacatgctctgcccgttccactattacggggtgcacgaatacattcaggacgcgcccgacgagaagatcgccggcaaagacgtcaaggtcgagtcaatgaccgaccaggaacgtaacgagctaagccgttggcttgaagaactcgccgacccgaaccgcgtgcgctacatcatcgacaagatacagatctacagcgaggccggaacacccgtgcaaggtctggtgttctgcagccgacgcgaggaagcgaaacgactgtccgacctgttcaaccagcagatgaaccagcaggcggaacggccataccgcacgaaagccatcaccggcgaaaattcgcagatggaacgcgacactgccgtggcacagttggagaacggcgaattggactatattttcaccgtcgacctgttcaatgaaggcgtggatattccacacgtcaatcagatcgtgatgttgcgtcaaacgaagtcgagcatcattttcacgcagcagctcggccgtggtttgcgcaaggcaagcggcaaggattgcgtggtcgtcattgatttcatcggcaattacgcgaataattatctgattccgatcgcactgtacggcaataccggcgaccgcgacgtagcccgtaagaatctgcaacgcgaaaccatcggcgtctcgtccatcagcttcgacaaaatcgcccgcgagcgcgtgcttgcctcgcttgacaccgccgatttgtcgaatatgaaattgctgagccagcagtaccagcagatgcggtacgaattgggacgcatcccgatgctgatggatttcgcgcgccgtgacgcgtcgctcgtgttcacgatggctgcgaagaacgacgattatctgtcgttcgtgcgttcccgtgagaagagcctgtcgcgtggcaagaacgcaaccgtttcgtatcttgaacagcttgaatcgacttcggatgcgcacaatggtgtgctgaaaatgttgaccgccacgcaattgcgcggcttgcgtccgcacgaattgttggttttggcggcattgtgcggtatggattggcagcggatcgatccggattgttccgaggatgcgctgactgcgcttcgtgaggtcgcttcacagcatgcgatcacgatcgtcgatttgcagacgttgttgactgcgctgttccccgatgcggacagtaacgagttgcaatgccgttccgcgttcgccacgttggattattcctatttcatcgccgcgaacagcaaacgtttcgggcagactcctttggtgcgcctctgcgatgatggggcttatcggttgaccgacgagttccgctcgatgcttgaacagaccactttccgcacgttcttcacggataccgtcgaagccggtctgttcaacgcgttagcgttggcggaatcgtcccgcaagcatcatatccgccagaatcatgggttcctgtatggagaaaagtacagtgtgttcgatgtgatgcgactgtgtggttggcctgcggaacaggtgccgcagaatgtcggcggatacaaattggacaccgaaaccggctcactcccgattttcattaaatatgaggcgagccagtatggcgaccggttccttaatcccggcgagatcgaatggttcagcaagaacaatcgttcgcttaaatcaaacgaattccggtggctgctggacggaacggaacgtactccggaatggcagaatcgccattttgtgccgattttcatccgtcgcaaagccgaagaacaggagaaatcctattacttcgtcggcagcgcggtcgcattggacgatgtgcacgcgtcggtgaaccccggcgaggatggcagcgagtcgaaggtggtcatttccacactcaaactcggcaaaccggtcgatccggaactctaccgccacctcaccggcaagtccgccctgtaattcgcgaccttctgacacctatctcgcttatagatggcggatttggatcactgacacatgccatctcgcttatggatggcggttccaacagcaaaaacgaagtttgggggtatgaatcatacccccaaacaagcgatttacttcagtacaccgccatccataagcgagataccagcagacgcacatgaaaatccgccatccataagcgagatagccccgcaatcactccagccacacatcgaaacatataaaaagcggcttgcgtatatacgcaagccgtccgagctgaaagtagccgaaactacggaaggtcactcaccgaccgtcggcgtagccacccatgtcgggcccatcgaaaccgccgtcgaagccagggccgtcaggacccgggccgaatcccggaccagcaggaccacccggaccgcccaggaattcgcgcgccgacatgccgttctctctacgggaggcatccactgcttcctgcagcaccttgcgaacttcgaatccgttcagcacgttcttcaatgccactacgccattgccggacgactgatcgcgcgtatccagcacaatcgtgcccatgccgaagatgcgctgcaggaatgtacgttccacgctgatatccacgatgcggaacagtttgatcaagttgaaactctcgttcagaatgccggttttgacgctcagctcacggtcggtaagtgtgtacacggtgaacgtgaacggcgtacggcaccaattgcgcttgcgctgctgccacaggacattgccacttgcaaccttcatatggttcccccttttcatcagaggcctaattggactggccgccctatgcggcacagcacaccattctaccgtcacgctcgcacgaacaccgttttatctatcgcacagcgcagacgtttcacacactgtttcacacgtcgttccgtgtaggaaaaagagacacttcacagcacgcgcagcagcttacgcagcaactcgcgccgcatccgtcacgtcgcgcacgataacgcaaacacaggcgagcgccgcttccgcggcattggcaccaatcagcaccacaccgtcaaatcagttgtagcccttcacttcgcggaagatgccgctcaaattgccgttgcgtccgtcgaacaccttgccattggacagcttggccaaatcgttgagctgctgcgaatccgcgtcgccgaacatgatggagaaaatcggaacgcctttgccatcggacgcatactgctgcttgaactcgtcaagcttcgccgtgtccgactgcccgtcggtcagcagcgcgatcgccaccgtgtaatcgtcgcggtcggacggcagattcttcaacgcgacttccagcgcattgtagatgtccgcattgccatttgccacctgattttcgctggcggccagcaaggtcgcggtttgcttgccttgcgcgacctgcgccactttcgcgctgctgttgaaggggatgaacacgttgacgtcgtcatcgcccggctcgatatgcgaggcgcgtgcctgatcggtgtcgagggccgcctgcaaaccggccacggcaccgcttttgcccttgcctgacatcgatccggaataatccaccacccacaaggtgtaagcgggcttgcgcaggacggtctgatactggtcgagcgcctgttcgatgatgtcggaggatggcatggtgatggttttcagcaccgatgaatccgatttgacgccccattccttacggaacgaatccttcaccttcgcatctttggcatacgccagcgtgccgtccgaaccggttctacgacccgcctgttcgaacagtttcttggaatccttcgacgtgatcgacttgctgaatcgcttgaacgcatcctctttgtcctgcctgcgatccacgtaagcaagcggcgaatcggaaatcgcgatgccgtcggacggatagacggccagcagcggctccttgttcttcgccgtcaacgccttgtccgcctggatgacgagcgattcgtagttcaccatggaatcgttcgtatccgggtcgttgacgaccatgtccttcagccagtcggacgagccggatgaacgattgacgcccgacagtacggttttcacggacttacgtaatgaagcatcgttcaaatcgtctttggtgagtgccgacttaccgccgttcagcgccgtcagaaacgccatgtacgccgacgctccggaattcgattgcgtggcggacgtcatagcgaacgacagcttcttggccttcaccgcatccataatgtctttcgtggacaccggcttcgttgtaccgtccgtattcgcccagccgagttcctcagccttgctttgcttcacgccgaacaccaccggcgtggtggacgtggagacctggtccttgacgacgtgcttgatatcccccatggtgatccacatgctgctggccggccagaccgcatcgtaatccctgcccgcgtgatggcctttgttgcgcagcgcgtccataacgtccaacgaccccatgtagtcgacggtcactgacactttcgattgtttggccgcctgttcgatggccccgctcacttccttgttttcggagccggaggcgatgcggatggaatctttggcaccgtccacggaatatgtcgcggttgtgccgctgttcgaatcgccgtccgacgtcgcattggaagcgctgttcgtcgaaccgcatcccgtgaacagacctacgatcaaagcgatgcccccagccgccgcaccaagtttgcgtgcgttcatcttgtgttggccctccgttcatattgcgccaaaaaccgttcagcgcacccggaaaacatttccgaatgcgctgaaaacatgttctgttatgtgcgattgattatagtccgattttaccgaacggccattttgccgtctcattttcgtcattattttcgtttccccctcattccgccctttccgctctcttccacagacgtagccgacgccgcctatacttggtgcggctacttgttgcggcacaatcgcaactatgcaatcacaggcatcgcaacggaaaggtgggcgcatgggcagcttcaatcgcaggcaggaagccgacgatctcaccgactacgtcaataacggatggctcagttccgccgaattcgacgggccgactttcctgtggaatcatctcatccgcgaagcaagccaggaggatgccgcgcaacgcaacgatgtgccggtcgccaatctttccgacgcggacgtggtcatcaacatgcccatgcaatggtatttcgacgccctcgcctccatggtgcccaccgcggaacgtaccgatacgggcgtggagattccgcgcatcgatatgccgacgttttcgatcgattcgcaggcgctgtccggcgtggacgcggtggtcggcaacgcggtgatcagcacgcgatggcttgacgcggtcggcaatctcgccaaagctgtggagatgaccgcacgattcgtcggcaatgtagccgaccgcgacaacgagggtttcgactatctgaaggatctgattcagaccgtacgcgtgtacatggatgccgtggcctgcaacgccgatccgatgacgggcgagcaggcgttgcgcatgatcacgcaggtggcgtgcaatgaggatttccggctcaacgccatgcagatggtggagctgctgtcttgcggactgtcgttcgcgcaatgggatgatacgcgcatgttcgcctatgacgcgttgaacaagggcattgccgcgatgcgtgatttcgcagcgaagtccggtaatggcgatgcaagcagcacgactggcgacactatgaacagcgtcggcagtatcgacagtgatgttacgggcgatacgggtgcacgcgacgccaccgcaacgcaatcgcataaccttcgtgatacgtcctctgacgcggacagtgcgcatagcacgaatagtacagacgctgcggacggcgcggataccgcgaactcgatcacgcattccacgggcgctgccggcgattccactaccggcggttcgcccaccctctcccccgaggaactgaacgatctcgccatgcttgacccatcattcctgtccaaacagcagcttgcgcagaccgcgcaaaaccagttcgaccatgccgtgcagttcctgcggcacgatctgatgcggatcagtggcgatgccgaggaggccgatcgtttcctgcgcgacaaccatacgtccgagccgcttgccgacgcgtacgcggcgcggctgatcgctgccgaacggtggcaggatctgctgaatttcgtcgatctggtggagcgtgacgcaccgaaccagtgcacggtcatgttccccgaggaagtggtgccgtacgaatgggagtcgattcgtgaggccgctttggaggcgttgggccgcggcggagaactggtcgcgatgtatcaggagcggttggatgacacgtacgatcccaacaccgagctcaatcgtatgaagcttcaggcgtggactcaagccaaggaataggcggcgcgcggctcagcacatccgccgccagttcctcatctatcgcagacttccactcttattcccatcagtatttccaccatcgcttccacaactgacgcgcaacgtggccaattggaacggatgcaggctcagcatcgctccttgcgccgttcttgccacggacggatcaccgtcggcaaaagccgcgggcaattcggcatccagccgcgcatcctccataatggaacactcgcgtaccgtggccttccccaaagcggcgttgacggcaagtctcgcatgggcttcgccgccgaccgcctcatagacgcgcagtatcagatcaccggaaccgtcatcggcaagcttgacccagtcaagcaccatgacgccatccaccgggttgagctgcgccagcggatcgaacgccggcacggcaggcagcacggccgcgttgagacggttcgcctcgtcaagcacagccggcatactggcatccgccacaacgttccacgcgaactcatgcacgcccttgtcagtgttcggatcggggtatagcggggacgacagcaacgaaagtcgaatcatcgtgccacgcaccggcccggaagccgtgttccggtgaatcggcgaaacgtcggaaccgtaggtgctggcgttgacgaccgcagccgcatagccggcatcggcgacgcgtacgaaccggtgcgtgcagctttcgtatttcgcctcgtcggaacgtgtgttcttctgaatgggccgttccaccatgccgtactggcattcgtactgcgcccggtcggcctggatagccatgggaatgtcgactttgaggaatcgttcggatgcccgccaatccactttggtccggaattcaaggcttttcgactttggccgcaatgtaatgcaggcatcgatggacaccccgtcggcggtgctggacacgtgcacggtggctccgccgcgttttgtctccgtcactcgttccacatgcgagtcatcgatgccttcggcgctgaggaaggcatcgcgctggatgtcccatgcgtcccactcgtatggctcgtcgcggagaagctcgtaatgcccgattccactgccgtcgggcaccagttcgtgtccattatcaaggtcgatcagtgaacggaccgtaccgtctggtgcgatgatggcacgtagcaaaccgttgtcaagtatgattcgaccgtcgtcgcatgtcgttgcgatggtggattcatcggcgaccgcgtcggtgccgttcgcgtcatcatcctgcgttctcactgccgcggtgcgagcaatccacgaatcgccattctttgccgtatatgggacgatggccgcgttcgatcgcatgtcggcatcatcccgcgccgatgcgatggaagcacccgcttcagcggcgatatcacgcagtcttgcgatgtcgcgcacgtagtccgcacgcgcctgccgatgcacccatgcgatcgccgatccgggaagaatgtcgtggaattggttcagcaggagcgttttccagataccgtcaagttcctcacgtggatatcggtattctgggttgaacacgctggctgcggcgcacagatattccgttgttctcagcaggttttcttcccgcctgcatccgcgtttcatttcctgttgcgatgtcagtgtggcgcgatgcagttccagatacagttcacccttgaaaaccggggtttcgtccggagcctcatcgacgatatcgtgtcggacgcggtcgaacagttcgtccggagtgccgaaatcgatgctcggagcgccggcaagatcatggtccctgcggatacgtgcgaccatttcgcgggtgggaccgccgccgccatcgctgtatccgtacagcagtatggcgttgcgcgacaggtccttgtcaaggaagttgcgctgggaatactgcagttcctgcatgcttacggtcgagccgtacgtgtccgacggcgggaagtgcgtaaggattcgcgatccgtcgatgccttcccattcgaaggaatggtgggggaatttcgtggtgtcgttccatgagatcttctgtgtgaggaaccattcgaaaccggcacgacatgcgatttgcggccatgccccgcaataaccgaaactgtcgggaagccacagtccttttggttccacgccaagatgctcacggaagtaacgcatgccgaacgtgatctggcggatcagcgactcacctgtgggcagcatgttatcggattcgacccacattccgccgacgggaatgaatcgtccttccttgatgcgctgcagcatgcgcgcgaacaggtctggatgttcctgttccagccacgcatactgttgggcggaactcatcgcgtacgtgaaatccggatcctcgtccatcagggcaagcacgttggacaccgtgcgggccactttacggtgggtttcgcgcacgggccacagccatgcggaatcgatatgcgcatgggcgaccgcgacatgatggatgacgctggaatatgcgggttcggataataccccggcaagcttttccttggctggctccagagttccggcgatatcacgctcgtcatatgtgttgagtgatcgttgcagcgctttggccagctgccaatatcgaggatcatcatccttgagttccctcatcagcgaggtgacggtttccaagtccatcagatagtcgaacacgttttggttgaaagcgcacacgtccattgtggtgagcacatagtcggatggacgaccgtcggcacgctcccccagattcatcggcgcgaatggcaggtcagcttcgaccagtggattcgatgcggcctcgacatataccgtgaaacgaccggcatcgtcaagctccacattcgccacgccattggcatcgataagcggaatccagcaattgtctggattcaccgctttgatgacgctgccgtcaggtcgatagcataatccttccgcttggaagcccgggccacgatgtcgtttccatcccagatctacaaccagttcgacggctctgcctttgaccgactcacggtcgatacgtccacgaacctcgaaccatgtggtaccccatatcgtgccccaggcaccaggaaccatgaagtcgagaaaatccactttgttttccctgacacgggcaagaaagtcggcgctctgttcgggttcgccttcattggcgaaagcgcgtaactgacaatgcgataatgtttcgtgcacatatggcacaagtcgttgccgcatcactcgatcggcacgtctgagttgctgatctggaagaagaaacatagctatccccttggcacatgattcctatggtgtatccatggtgccacaacacaatctcaaatcaaaaaaacatcaacgagaaaagtggttctcaaagcggacatccggtggagactccggataaggaccttcgacgagcccgaaaggcgttgccgggaggcccgggaggtgatgaaaaaatggggttcccggagcatatccggtgggaattccagggaacataaaaaaaggggcctcccgggagccaaaggctcgaccgggaggcccaacatgtgaagcggcggcgtgctactctcccacaccctctcgagtgcagtaccatcgccgcaccgcatggacgagttgtgtcgtgacacgatcaaaaacacgatcatcagcctgatctacggcgacaaggacaccgaccacagcgaggccgtcagctacgagttgtcgaagcttgagaaattggacgcgcaatgctggatagtcgccgccgccgaaaaatatttggaggacaggcaatgacgcatctcatgatcgcgggcggcatatacctgctgctgctcgcgctcattctcatgttcaatcatggcgcgcacaagattcaggctggtggcatcgtggctggcgctgtcacgacagacaaggtggtggccgacgctgtgaccgccgacaaattggccgcgaacagcgtgcaggcgcggcacatcaccgctcttgcagtcacaaccgacaagctcgcggccaacagcgtgacgaccacgaaactgcgcgtcacggaggacatgacggtcgcgctgctcaacgcgcacagacattgatttttcacacttcaaagccatcccacttcgggatggcttttctatttgcccctgacttgggggcgggaaggagaggatgtgggcatcctcaacaaaggcaacccgaaacacaagcgtctgcgtcggcatatcggcaagccgttgaccgcgttggctgcggtgctgtgcgtcgccgtcgcgccggtcgccagcgcgaacatgaacgtcatcgacgtttccggctggcagagtgcagacgtgacgcgcgtggtggacgccgacgcggccatcgtgaagatcaccgagggttccggctacgtgaacccgtcttggcgcagccagaccgattggacgcggcagaccggcaaggcttgcggcggctaccattacgcggacggcggcaacgtcaccgcggaggtcaaccattatctcaaccagttcaacggctatgtgggccagtgcgtgctcgcgttggactgggagtccaacggcaacgcagcttggggcaacggcgactgggtgcgccagtgggtcaaccaggtgtattcgcgtaccaaggtctggccgatcgtgtacgtgcaggattccgccgtgtatcagattccgtccgacgtgcgatcccattgcatgttgtggaaggctcagtatgcgtcgatgaacgcgaccggctggcagtccactccgtggaacgccggcagcaagggcgagggcatggtgcagtatgcgtccaccggctatctgaacggtgttggccctctcgaccttaacctgttcttcggtgagcgtgacgcatggcagaagatcgcgaacggtgataggggtaagacccatgccgaggtgaggcatgatccggtcaggccgcaggtcactgccacgcctgattacaatgacatggccacgaaggtcattcgcggcgtgtacggcaacggcaatgagcgtcgtcaggctcttggcggtgcctatgacacggtgatggcgattgtgaaccagcgtcttggcggttctggcggcgcgcctgccgccgtgaattgcggcagcgtgtgcgtgaccgttcgttacggcgacacgctcagcagcatcgcggccagtaatggcggttcgtggaaccagtacacggggtaccgttccggcaatccgaatgtcatctacgctggcgagaccgtctgccgtcgcaccggcgcggccagtacgtccaccgtcgccaccggtggacggtacgtggttcgttccggcgacaccctcggcggcatcgccgcatattacggggtcaacatgtacagcatccacgggtaccgttccggcaatccggcgttgatctatccgggcgagaccctctactggtaaggagactgacaatggtcgataacgtcaaagagactggaaatgatggcgaaaagccgcaggaagaaacaggcgaagaaaacaactacatcctgccggacgaagcgtacaaggtgctgaagtggttggcgcttatcgcgttgcccgctttggctgtgttcgtgcatgtggtcggcccagcatggaaccttccatgcgttgaccagatcgtgaccacgttgaacgctctggccgtcttggttggcgctttgattggcgtcagcgagttgaaggcaaagtattccgagtagaaacctttcatttctctaacatgatgttagagaaatgtaagaatactatgcccaactagtacgcgtcctgtacaagttgcccctctctcagcatcatgctgggggaggggcttttctgcgttttagggcttctattctgcggttcgattggctctatcgccatcaccaaagtctatttgttggcccatttggtcgtaatagcggttttgatacatgttgcaaaacttttccctgatgtgatccaccacagtttgcaccgccgtatgtttctcaatgtccaactgctgttcggtgatggttatcttctttgggaactcgtcttctggatgccaggtatcgtaaccggctccgtttatcaccattctgggtgcgttgaatacgaacccatatcgttctacgagtttcaacgcttcatcgaatcctcgaccgtatccttccctatacgaaactacatcaagctcatgcggcatttacgacacctttctgttcgatctgcttcaagtctaatgcggagttcatcgtttccattgcggccaaccgttctttcaacccggcatgacggtagtgttcgaccatcagacggctggaatggcccacgatttcctcgaccagtccgacatccacgcccattgacatgaggatggtaacgacggtatgacgggtttcgtgacggctcctatgctccgcattgggtactcccgccgcttccaacagtttgcggaactgttcgatatcctcttccggttcgataggggagccgtcatcatgacggaacaggagtccatgcgggttcggtatttcagcggtatccaccaagtatgcttcgagtgtctgcgccaatgcgggaatgattggcactttccttccacgcttcgatttcggcggggtgagacaccagcggccttgcaactcgatcatgtcgaagccgtctggaatacgccacctccattgcggacatgcggcaccacgcttgtatccgcacgggtacacgcctttacggtctggttcgccgcaaccgtgctccttcttcaactcctccagtttccagttgacggtgtattcgccgtaggggatgccgtttgccgtggtggtcagttcgaggtcttggagtgatgcgcccaagatttcgccggggcgcatgccggtgcatagtctgaaccattccctcgcgccgttccgtatgcctagttcgttggcggcttggaggatgcgtttggcttcatcgtcggtgaatgcggtacgctcgtgggcttcgttcttgcgttcgtcggcaagactgatgtccttgtccttcggagtgggaacgccacccatcggattcgtgggaagaatcctatccgctacggcggcattgcaaatctggttcaacgtggtgtgcgtctggcggcggaggctgagactggccttcacgtgcattttcttgccgtcgatggtcttcgcgacggtaaggccatttacgatgcggtcgcagactgcggcgttcaggttcgacattttctgcgaatggtatgggcgtagatgcttgcggacgatggttcgatagttggcgaaagtcttcgggtctgcatccctctgccgtcgttccaaccattgttccgcatatgcgcccaacgtgactgacgtgttgctggtactgccgaatttggctcgctcttggagcagttcggtcagacgccggttcgcgtcggcgtacttcttgcagctgtaggtcttcccgtcgatcttgaactcgaagctggggtaagccttgattgtgccatcggccagcttctttttccgttcgactttgtatgggtagacgatgccgtttcttgctttgcgtgccatgattacctccttgcttccatattctcagacattctcagacttccatttgaccttcacttgcgggtcaagtgaccctcaagtgaggttaaaccgttggaatgaagccgttttgcccaatcgttccaaggggtattctatcaaactctctaactgttaatcggacggtcactggttcaagcccagtcgcaggagccattcgaaaaatccccttggaaacaaggggattttttcattttcaacgactcttggcatttttggccaccctttatgtttatccgtcggcggaagccgtggttcgtccagccgtccatgcgtatgatgaacgcaccgggtcaatcaaacaaaggaaggaagtccatcatgtgcactggcgttcgtttctccgacgaagagggaaacatgtatttcggccgcaacctcgactggagcttctcatacggcgaaagcatcctagccactccacgcggctaccactacgacaacgtgttcggcgcgagcggcaaggccacgccgaaagcggtgatcggcgtgggcgtggtcatggccgaccgtccgatgtatttcgactgcgccaacgagcatggtctggccatcgcgggattgaatttccccggctacgcggagttcgtgcatgagccggtcgaaggcaccgacaacgtcgcgaccttcgaattcccgctgtgggtggcacgcaatttcgattccgtcgacgaagtcgaggaggcgttgaagaacgtgaccctcgtctcccagatcgtgcccggccagcaggagtcgctgctgcattggatcatcggcgacagcgagcgcagcatcgtcgtcgaacagatggcggacggcatgcatgtgcaccatgacgacgtagacgtgctgaccaaccagccgacgttcggcttccatatggagaatctgcgcaactacatgtgcgtcggcaacgagatggccgagccggccacgtggggcaaggcgtccctgtccgcttggggcgccggcgtgagcatgcacggcattccgggcgacgtgagctccccgtcgcgtttcgtgcgagtggcctacgccaacacgcactatccgcagcaggagggtgaggcggccaatgtgtcccgcctgttccacacccttggttccgtgcagatggtggatggcatggccaagatgggcaacggccagttcgaacgcacgctgttcaccagcggctattcgtccaagaccaacacctactatatgagcacgtatgaggatcccgccatccattcctatgcgatggccgatttcgacatggattcctcggagctgatcaccgccgcctgagcatgcgtgggctttttcgtccgtcggttcccatacagacggacgaaaaagccgcacgattgccgaaaggacatgaaaatggagtcgtgcgacagatccacttttcggataccggctcttccattgcccgctcaatgccgtttgacgtcggaccaatacgacacgccggaatatggacttcgagcactttaagtttttagagtgcggggtatgagcaatacgacgaccacctggcattcgatccgtgaggcgtccatgatttccggactgcccgaatcgacgttgcgttattacgagcagatcggcatcatcgatccgatcgcccgcgatccgagttcaagccaccgagtctattcggacaaggacatcgaatcgctgaccaccatcgcatgcctggcggcgacgggcatgccgcttgaatcgatgcgcgaatacctgaagaaccgtttcgacggtccggaaggcgcccgacggcagatcgaactgctcgacgcgcaatcgctgcgtctggccgcgaaagcggaagccctgcgcatccaacaggcgtatgtgtcgctcaaatcgctgtactggcgagccattgccgacggtcatgaggatgaggccaaccgcatcctggaggaaaacaaggacgtcatcgacaacgtcaagaaacagcaatcccacaaataagaggaggaaatccatgaaagcggcgatttataagggcatcaagcagatggcctgcgaggagcgtccgaagccgggcatcgttgacggcggcgatgcgattatccgcgtggtgcgcgcctgcgtgtgcggctccgatctgtggttctaccgcgatggtggcaaacccgtcgacagccaggctggccatgaggccatcggcgtcgtcgaagcggtcggggaggatgtcaccatcgtcaagccgggcgattttgtgatcgttccgttcccatacagctgcggcaaatgcccggtgtgcaaggccggtttcgaatccagctgcccgcatggcggctatttcggcgatgaggacggtatgggatgtcaggccgaatacttgcgtgttccggaagccgaaggcactctggtcgtagttcccggcgatgccaagaccttctccgatgagatgctcgcctcgctgctgacgctgtccgatgtgatggcgaccggctatcatgccgcggccagcgccgaggtgaagccgggggatacggccgtcgtgttcggcgatggcgcggtcggcttgtgcgccgtgctttccgccaagcttatgggtgccacgcgcatcatctccatgagccgtcataccgaccgtcaggagatcgcgaagaaattcggtgccaccgatttcgtcgaggaacgtggcgacgaggctgtggccaaggtgctggagatgaccgatggatacggcgcggacgcggtgctcgaatgcgtcggatcggccttgtcgaacgacacggccatgaaggtggcccgtgccggggccatcgtgggtcgggtgggcctgccccacgacgtcgaagccgatattcccggcctcttcttccgcaatgtcggtctacgcggtggcccggccgcggtgcgtacttatgacatgcggcgcctgctcaaggaggtgctggacggcaacatcaatcccggtatcgtatacactggcgagtacacactggatgatatccaggaagcgtatgccgctatggacgaacgcagtaccgtcaagtcgctgctgcgggtcagcgaagtctgatttcgtggtgcccaacgatatttgaaacgatggcattgggctcgaattgagccgcgtgagggaaggatatcgacatgttcgaggaactgcataggaagatgaacgccttttggaacaacgatcggacgctgtcgcagaccgacccggaattcgtcaagttgttctccgatttcgcctatgacgaagtgataaacgaaccgggtgccaaccaccccgatctggacgaccagacccgctccctggcgatcctcgcggctctggtcggctgccagggtctcgacgcgttcgaaatgatgctgccggtcgcctatgagacgggactgacctccgtggccatcaaggagatgatctaccaagccaccgcatactgcggattcgggagaaccctgccgttcctgaagaagctcaacgttttccttggagccgcgaatgtgcatctaccgctggagccgcagggcacgaccacgtcggagacccgcgcgcaggccggagaggacaagcagattgaaatctttggtgaaggcatgcgcggattcgctcaatccggtccggacgagacccgtcacatcaacaaatggctcgccgacaactgcttcggcgactattacacgcgaggagggcttagcacccgcgagcgcgaaatggtcacgttgtgtttcctggccgcgcagggtggttgcgaaccgcagcttacggcgcatgcgaaggcgaatatggccgtcggcaatgagaaggcgtttctgattgcggtggtctcgcagtgcatgccgtatatcggctatccgcgtacgttgaacgcgattcgttgcatcgatgaggctgtgaagggctgacctgcccgttaaaaacgccggcaaacaaacaaagggctatccgccgaacaagacggatagcccttccttatagctgattgtggatggcgtgctgtgtttactcgccccacacgtccttggcgatggattggacgagtgcgatcttggcccactgctggtcttcggtgagcttgttgccttcctgggtggaggcgaagccgcactgggtggacaggcacaggcggtcgagcggaatgtactgggcggcttcctggatgcgggccttgatggtgtccggatcctcaaggtcgggcttcttggaggtgatcaggccgagcacgaccttcttgtcgccggagacttcggcgagcggcgcgaaatcgccggaacggtcgtcgtcgaactcgaggtagtaggcgtccacgttctcctcgccgaacagtttggccgcgaccggcgcgtagcctccggaggaaagccaggtggagtggaagttgccgcggcacacgtgggtgttgatgaccaggtcgtccggctggtcggcgatcacggcgttgatgacgtcgaggttctcctgctgcaggcgtagcgcgtcctcgtcgctccagccgagacgttcgcgtacgctcgcatcgcacaggcgggtccaggtgcagtcgtcgaactgcacgttgcggcagccggcggcatacaggtcggcgatgacctggcggtaggcggcgacgatgtcggcggtcagctcgtcatcgttcttgtagaactcgtcatacgggtaggcggccgcgttgccggtgagcacgaagcgggtctgcgcgggggagggcatggtctggcgggccacggtgttctcgtcctcgaactgcttgacgaacttgaaatgttcgacgaacggatggttctcgccggagattcttccggtcacggtggcggtgtcggccggggtcacctcgtcgtggaaggcgacgcggtgggctgcggcggcatggtccacgccgttgaagccccacatgaagtcgaaatgccaccagccgcggcggaattcgccgtcggtgatcacatgcaggccggcggccttctgcttggcgacgagttcggtgatggccttgtcctcgaccgccttgagcgctgcggcatcgattttgccggcggcgaaatcctcacgcgcggccttgagctcggccgggcgaagataggagccgaccacgtcggcgcggaacggcgcgttatgcgagtataccattgaatacccctttttttgggaaagcgacaaatacctagtgaaggttacacgcacgtcccgaaacacgggcgcacacggcttctcggccagtattcgtgcttgaatggatgatgttatccgttacacattcgagaatggaaggcaatgagcgaatcgcgcgatcccgcaggcgacagtacgaccacgaacaacatgggggaggtgcgggaagccgaacatcagggcgcggccgtcaaggcggcgttgggtgcgaacattggtgtcgccatcgcgaagctgctcgcggcgttcttcaccggatcgtccgccatgctttccgagtcggtgcattccatcgcggattgctccaacgaaatcgtattgatggtgggtggacgtttctccaagcgcaagacggacggcgaccatccgttcggcctgtatcgcgccaaatatcttgcttcgttcgtcgtggccacgctgctgttctttgtcggtggattcttctcgacgtccgaggccgtgaagaagcttgtcgcgatcagcgccgatccggcattgtgtgacgtgaacaggatggaactgcttgtcgcgttcatcgtggtcgtcatcagcgcatgcctggaaggattcggcctgcaccagagcatcaaggaggccaacgagcgtatggaacgcacgaacacgccgcgtatgggcgtgttccgtttctggagacgcaccaagtccgccgaactggcttcggtgatcatggaggatacgctcgccctgatcggcctggcgttcgcaggcctcggcatcggtcttgctatcgcgctcgacgacgaggtgttcgacgcgttgggcggtcttatggtcggcctggtcctgatcgtcggctcgcttctactggcgttcaagtccggttcgctgctgatcggcgaggccgtggattccgatacgcgcgggaagatcgtcgaggcggttaccaccacgccgggcgtcgaacgattgctgaacatgcagaccgtgcacatgtcggaggacgacatcctcctgtgcgtcaaagtgcagaccagcaagctcgaccgcgactatgacgtggaaaccgtcgacaagatcgagaaggccgtgcgcaccgcgttgccctggtacagtttcgagatctacgtcgagccggacatctacagcgccaaacacgtgcacgcgtaaccggttcccgcgtaacaggaaccgttcaatatgggaaagcccggacgatctgattcgtccgggctttcccatatgcgtgtcggaaatggtggaagtgggattattcctcggccaccagatccaggtaggagtcgttccacaggtcctcgtcgccgtcgggcatgagcagcacgcgttccggattcaacgcctcgaccgcgccctcgtcgtgggtgaccagcacaatcgcgccctcgtatttggcgatggccttcagaatctcgtcgcgggacgccggatccagattgttggtcggttcatcaagcagtagcacgttcgcgcggctcgtcaccagcgtggccaacgccagacgggtcttctcgccgccggaaagcactcgtgccggtttcagcgcgtcatcgccggagaacaggaacgacccaaggatggaacgtgcctgtgtgtcgtcaagttccggtgccacgtgaatcagattctgcaacacggtggcgtcaaggtccaatgtgtcgtgttcctgtgcgaaatagccgattttgcagccatgtccatattccacggatccggtgtcgggatcctccagatgggcgagcagacgcagcgtggtggtcttgcccgcgccgttatagcccagaatcaccacacgtgaacctttgtcgatcgccagattcacgcctgcgaacacgatgttcgaaccatacgctttggagatgtccttcgccatgatcggcgtacgtccgcaaggtgccggctcggggaagcggatgtccgccaccttctccttcttctgtgcttcggacgtgttctccagcagtttctccgcgcggcgcatcatgttctgcgcggccacggccttggtggctttcgcgtgcaggcggatgccctgctgcatcagacgttcggccttcttctctgcgacttcacgttcgcggcggcgacgttcctcgtcgaccacgcgttggtgcaggtaggccttccagccgagcgagtacatgtcgatctggccgagctgtgcgtccagatgccacaccttgttcaccacttcgtcaagcagttcggtggagtgggagatgaccaggaaaccgccctcgtattttttcagatagccgcgcagccattcgatggaatccgcgtccaaatggttggtcggctcgtcaaggatcagcgtatccgcatcggagaacaggatgcgcgccagttcgatacggcggcgttgaccgccggaaagcgtacccaactgctggcccatcacgtcctgcggcaggccgagactggccgccatcgcggtcgcttcggactgtgcggcatagccgccggccttttcgaaatcctgcatggccttgtcgtagcggttcatcgccttggtcatgacatccggatccggatcggtcatttccttttcggccttgcgtatgcgtttgatgatcgaagcgatgtcgcgcgcgctcatcatgcggtccagtgcggtctgctccgggtctgcggcatgcgtgtcctgtggcagatagccgagtttgccggagacacgtaccttgccggcggtcggcagcatatcgccggtgatcacacgggtcagcgtggtcttgccggcgccgttgcgaccgaccagaccgatcttgtctcccttggcaacgtggaagttggtgggatgcagcaacgtgcgcgcgccgatctgaatctcaagtccctgcgcctcaatcgccatgccgtgatacctctagtctttcgtgttccttcaaacgccaatcgaacatcatagcgaacacccgcaaccgtttcacctcatctcacgtttcatttccaagcagatgccggagcagtgattcgcggtggttgatgaagaccctggtgatttgatagctgtccgtatcctcataatcgcagggatggacgccgttttcgtcgaatgacaggatttccgcatccggcagaccgagcagaatcggcgaatgggttgcgatgatgaattgcgatccgtcgtttgccattcggtacatgtgctccagcagagtcaattgccgctgtgtcgagagcgcggattcgggttcgtccataagatagagaccctttcccgtgtgggacaggagtatctccaggaatccttcgccatgcgacatctcgtgcaaacgggacatgtcgccatatccgcgactgtattcacgagcctgtgtcgccagcgtgaaaaactttccgcacgcaggaagaagcttgatgggccgatcgcatactgccggtatatcgtcatcgccttggcgagatccgacgtgtcatcgtatgtgctgaaacggtagttgcgcgtgccgccttccgcgttgaagccgcaggcgacggcgatgccttccagcaaggttgatttgccgctaccgttctcgcctaccagaaaggtgacattcttgtggaattcaagttcgtcaatcgaacgcaatgagggaattcgactgacgtatgaatcagtcagcatattccaatcgatgcgcagccccgacacaatcagatcatccatgctttttaacaaaaccacacttccatatccggcagaaccgacctacagaccggtggcatagctcgatacgcgcaacggctccaccggtctcatattttcctacgtgccatcgtctcttcagattataggatgggccgtggggaaaggcgcatatatcacgacgacgttgtggatgaaacgaattatccaatcacgtgatcgattcgctacagtggtttcggaacctttcaggagggaagaagcatggcaaaggctttgattgtggtggatgtgcagccgacgttctgcgaaggaggcgaactgggcgtgcagggaggcaatgcggtcgccgaacgtatcgcggattatgtgaacgagcaccggagcgaatacgcatatatcgcgaccacgcaggactggcatatcgagccgggaacccactggtccgaacatcctgatttcgtggatacctggccggtgcacggcaaggccggaaccgccaatgccgaactgcatcccgccatcgccgcattgaacatcgaacatcatttcaagaagggccagtattccccctcatattccggcttcgaaggctttgaggacaacaccgaccgcattcccacccgtgaggaagtctccaccgccatggccgcgggcaggacactcgccaacgggttgaagaccgcgggcatcacatgggtcgatgtggtcggactggccgaatcgcattgcgtcaaggagaccgctctcgacgcgaagaagctgggtttcgaagtgcatgtcatcgagaacctgaccgaaccggtcagtgaggaactcggtatcgcagcccgtcggcagatgagtgaagccggcatcatccttgactgattggccggagtcgcacgactgcagatccgcacgggtatagcggcatcaatccgtgcaaagcacatacgctcgcgaacgcaacggatggaaaatcggccagtcatgatgagtggttcctcgaccaagtagccagataagccaagcgatgactatgccatcgaaagcgggtttgcgttccgcgtgatcaggacgcgtaggcccgctttttatcaatgctgtactaaagccaatcgtcatcgtatggtttcgacatcatggcatggtgcacggtattccgttgaactttaatatccctcgtcgatgaagatccatccgtgttccgcccgcgcggaaccgggattccacgcgtaccagcttccccagccatcttgggacgagttctgcgagcccgcacggcaagagatgtcattggacaggtaaatcacattgtccatcccgtattcgtcaatggccgtggaaatcgaagaactgccaccggaagccgtgacgtcgtgttcggctgcaagcagcgtggccgaacgctttgcgtcatatcggacggcatccacgcggcaaccgttccaggatttcagcctggcaagatccgccttcaccgcgccgtcgatctgggattcgtcgaacttgcccgtcgcgttgatgctgatccgagcatgactgacatcggcaggccggagtggcaggtagacgaaccggtacgcgccgacagcgcatgccacggcggcgacgcataccgatacgacggtgatgggtttcttgcttttcgtggtccgcatgatcctcccacataacagctttccctaaagcatacagcggaaacgtgataagaggaatggataccaagaccaacaagaacgcccttcaacggatactacgatggaacgtgtcaaacaggcggaatgattcccccgctccgcaaacgagatcggcaaacgactcatggtatttgaatatgcacggtgacgttttgacgcgtataaagcgtataaagccgaatccgacgaatcagtactggaatgctgcaaggagggtcagatgatattggccgatgccatcaatctcgttctcgccgaatatcctggaatgaaggcgattggtgccgcggagagtgccgatgcgtggatcatcggactcgatttcgcgtcttcaacagatgaccatccggtgccgggcacaccgagcgtagcggtcgaaaaaacatcaggcgttctgcatgaccttattccggggacggaagatttctggcattacatgaccggtgccaaaaaggtgactattcctcggatttaaaatccgccttagtcttcccataagagctcccgccttccgcgtggaaggcgggagcttccgttattcgctgagcagtttcggcgtgaacgccatgaacaggattcccgcggtgacggcgaagacgatgtccgaaatcggttccgcgcggatcagacgccaagcaatccaacggaaaaagcaagaggaaaaagacacgaagaaacacgccgggccatctcataccagaggatgagtcaccccaacatttacgccaaggaatgaatacgacggacgatgccacggacacgaccagccgtactaccgttgaaaccaacaacggaaacgaaacccacgcacacaccacgcgcatcccacacgcccagcaaaggaaaccggccatgtcatacgtcctctacttcagcaagccattcgcgctcgccatcgcaatctggccattcctctcactcctactcaccctgcccgtgctcgcactgctctaccaccgcgacaaccggctacgcttcacctccgcactgaccgcatatctcgtggtgctctacctcatcgcgctcgcatgcttcaccatgtacccaatgccagaaaacccggccacctactgcgccgcccaccatctcaggccacaactcaacccattcgaattcatccacgacatccgaaccgacggcatcacaggcgtcatgcaactggccatgaacgtcgtgttcttcctaccgctcggctacttcatgaaacgcgtcttccgctggaaattcgccacggcgttgccggccatgttcctcacctcgctgctcatcgaaaccacccagctgaccggcatctggggcatctatccatgcgcctaccgcctattcgacgtcgacgacctcatcaccaacaccctcggcggcatactcggctacgccatgggaagcattgtcacccacttcctaccccaacagcgcatcgacgaagacgccatcaccaccgagccaggcttcgtgcgccgctgcgtggcgctcgcgatcgacctgttccttgtcgaaacggcgtcgctgtccgtcacggcgcttatctatctggttggcgtgctgttcgatgtgaaccgcgcgaacaacgtcaatgcggccgtctccgccgtggccaccatcgtcatgttcgtcctgttcgaagggatcattccgtggaggcgcgccggccgcacgttgggcggcggtttcacgcgcatgacggtggagaccagggagcgttccgacatgcgcaggatcgtgttctatacgttacgcgcgttggtgttgtattgcgcggtctacggattgtggacggaccgtggcttctacgcgctgctgctcggcatcgcgcttatcgtgttctggcgcgttaaaaagcgcatgccgtacgactatgtctgaccgtcgtgcggagctgccgcgagtccggcgccgcaaaaacgcgacacgccgggcttgcgcgatggcggacgctcctgtatattttcaactcgttgcccaccaaggtggaaaacatgcggacatagcttagttggtaaagcgcaaccttgccaaggttgagaccgcgggtccgagtcccgttgtccgctccacaaaacgaaagctcccgggagggagcttttcttgtatttccggcagtcgccggcaccggcgaatccaatggaatccgatgccggcggtcttgttttttcagtcgccgatgttgtcgcgtgccggcgtgaccatcgtcagcatcatgacggacggctcctcggcgtatatcgcgtgcgggatgcgggtgggaaagtaggccaggcctcctggaacaagctccacggtcctgccgttgcccgtcaccttaagccgtcccttcagcgtctgcacgaacaccggcatcgcggccgtatgctcgccgagctcctcgcccgtgtcgaaggagaacagcaccacgttgcctccggccttctgcatgacggtgcgggacacggtggccccctcctgaacggaaatcatgtccccgaggtcctcgatgtatcccagttcgatcggttcggcctcatcgcgttcgtcgctcatcatcgtcctcctttggttggtggcagggatgcccccatcgtatcgtcttcacgccggagacacggcatgtacgcgtggaggaaaaacgtttgaccacgatgtgaacacgctcttgcatcgaacgcgtttatggtccagacttttgcctgttccatgaaagtcggcaatgtcgccgggggcaagtgggacgaacggaggtattaaggaaatgaacgagaacatcgacatcgacaccactttcgtgccggacgattccgccagccattcctggacggagcgcgacagcgagcttgtggaggagtatgcggcccagctcatggcgatgagcatctgagcggacacgatccgaaaacgtgggggacgccccttccggaaactccggaaggggcgtccttccgttttttcattccgccgggccgaaacgcctccggcgcgtccgtagccacatgtgtgactatgctttccagccgtagcgtttgagacgaccgggaggagaccgcatgccgacggacggaaaaccgaaaaacggcatcgtcagacaattgttcagctatggcggcgtttcggccatgcagaccttcgtggaattcggcgtgttcgccgtgcttcagctggccggcctgccgttccgtctggcgaatgccgtggccgtcttctgctccggctcattcaactacgtcatgaaccgcaacgtcacattcaaatcctcgtcgaactacgcgcgttcgatagccatgttcgtggccatgtactgctggaacctgctgttctccaacctgatgatggcctggatccccggactgctcggctggcccaccacggcggtcaagatcgtcaccatgggcatgcaggcggtctggggcttcctgctgtgccgctacgtcatcttcaaatgacgttcgcgccggacggttttcccgccgcgatcacgggaaaacggacatgctatcttacaatggatgcgcatcgggaaacttgtggctaagggaaggacgggacgccgttggcggatgtaagacgggaaatggaacggctccggcccgtgtatgagaccggggtgctgcgattgctgctgcgcggcaattccatgctgtacgtcgcgctgctgcgctccacgttcgacccgctcaccggcgagctgccacgcgagatcgtcgaggaacggttctcccgcagtctgacccgacttgcggaaacgggcgattacacgcccaaggaagggcagacgtccgcggaagccgcgcacacgatcctgcagcagctgacgaaggaaggcgaaggcgactacgcctggctcgccaattcgctcgacgtcgcagcccaccgctacctgtaccgtctcacggcgcgcgcccaccgtgcgatcgaggcgctcgaccggctcgaggacaccacgaaagcgctgtccggcgcgcaggccaacagcatcatcatggagatcgagcatgcgcgcatgcagctgaccgccgacccccgcgaacgcatccgcctgctcgaacgcgacatcgaggagcggcaaaagcagatcgacgaattgaagcacagcgacacgttggacaagctcacctcgcagcaggtcggcgacatcatcggcgtcatccacaacacgctgcgcggcgtgccgatcgacctgcgcgaactggcgctcgaggaacgcgacaacggcgacaatctgcgccgaagcatgcagtcgggctccatcagcgtggagcaggcgctcggcacctaccatgacgaataccacaggtcgttccacgaatccgacagcggccggcgtttcgaggacgcgttccaggtgatcgtcaccgacgagggacgccgcgaaatcgacgaggcggtgcgagacatcgcccagaacccgtatctcgagggcgagccaggcatcctgctcgcccaggtacgcgccgaactcaaacgcatctacgagggcatcgaggacgtgcgccggcagatccgcatatccgacgaggcggtgagccgtctggtgcgccagcagaccgacacgcattaccgcaccatgctcgacaagctccacagactgttcgtgcgggccagcgacgacgcgaagacgcaccccggctcggacgaacgcccataccgtacggacaccggcacggcgcaattccaagcattgccgtccaggcccgcgaaatcgatggcgcgcgcggccacggccggattggacgacgcgccttcgacgaacgtcgacgcgccggacctgaaggccatggtcgagatgtgcggcccgcggctgacgcacatgatcggactcatcaggcgcgatccggtcaaaacggcggacggcaggttcgtggatttcgcggcgagcttcaaccggctgccccgggaggaacggcgcgaaagcgagctgatcggcttcctaagcgccctacgcacgcaggacggaccggcaaccgtggcatggcattgcgtatccatcgacggaggcgagcgcgtgtggcgcaccaggccgatcctcaccaccgaggcggcgcttgacgagatcatcgaggagggatgagcatgacggacaacaccgacggattcgacactggcatcggcatcgaagaggagacaggcccggaatccggcatgccgtccgaagggccggatatgacgagggacaggccggcattgttcgacggggatacgggagacatgcctcttgaggcgcgtatggccgcgatcgcgctgaaacgcgaacgctacatcgacggcagcctgtacgacagggcgtgccagtaccgtgaggccgtggaacggtcgttgaacaacgacatgctcagactggtcgacaacacgaaataccggatcatgtacgcgtcgccggtcacggacgcggagacgaacatccgctcgttgaagacgcgtgtgagcctcacccgcgaggaggccgccacgctcgcggccctgcgcatcaaggtgctggagtacgagaaccagaagacgaagccgggcgactggctcatcagcttcgacgacatccgcgcgctgctcgccacgggagcgggcttcctcacggccagcaacgacgaggagggcacggcgaagaagatcacgtccgtcatctcgcgcatgcgcacctacgggtatctcgcggaaacgggggacgagaacatgtacgtgctcacgccattggtgccgatggtgctcgaccagaagctcgccgaccggtggctcggctccgatgatacggacggcgatggtatgaaagacgcggatggcgatggttatgacgattcgtccatcggcgcggatggtggcgatacttccgattcgaccgggacggtttcgtccggcgtcgagcaggacgcgttcgatttcgattcggccgatgacgcttttgatggaggggaacactgatggaagacggcatgaaaatcgtttccgaccgttggatgctgcaaagccggcagatcgtcaactggggctcctacggcggctaccacgcgttccgcccgtccatggacgatgcgatgccggtgaccctgctcgccggcgcgagcgaatcgggcaaatccacgctcgtcgacgcgcagatctcgctgctctacccatccggcaccccctacaataaggcgtcgaattcgggacgttcggaacgcaacgactacacgtacctgcgcggcatgatcggcatcagcgacggcgaaaacggtgagaccccgatcttcctgcgcggcagggacgcggacggcaccccgcagaacatctggggcgcgatcgtcgacacatacgcgaaccgcagcgacggcggactgttgtcctgcgcaaaattcctctacctgaccgcaggcgacgggccggacggactgcgccgccaatacgtcacctggaaccagaccatcgacccgcgcctcatggaccggcaccgcgacacgtcattcacgcgaggactgatggaacagacctacccaggatgcacgacgcacgtcaacgcgcaggcgttccacgcctccatctggcaggacatgggcctaagcgccgaagcatgcaggctcctgcacaagatccaatccgccgacgcgccctccaaactcgacgacatcttcaaacagggcgtgctcgacgtgcccgaatccatccggctcgcccgcgaaaccgtcgacgactacaaccggttcagcgagaacttccacagcatggaagacaaaatggaacgcgtcgccatcctgcaggacatacaagcccgctacggcgaatacgccaaacaagccagcgaacgccgcgaatacacgcccatcgaccccgaccgcgagcaaggcgagacgacgctcgccgcatggacatggtcgcgcatggccagcgaagtacgcgccggactgccatcggcgcaacgcaaagccaaggaatcccaggacgccatcgaccggtctcagcagcgcatcgacgaactcgacacgcaaatcgaagccgtcaaagaacgcatgaacggcatcgacggcggcagcctgcagcaactcggcaaggacttcgaacgcgcacgccaggacgccgacgaggcgcgcagacaacggcacgccatcgccgaacggttcgaacgcgtcgaaggcagactccccgccgacgagcagacatggaacgccaaacgcgccgcgctcgccttgtcgctcgacacgtacgacaagcgtttggaagacgcgcgatccgaataccagcggatggtggtggaacgtcacgcccggcagggcgaacgcgacctgttgaggcaggattaccggcgcaagatcgaacacaggacgcgcatcagcgacgacatggaccatgcgcgcacgctcatcgcacgggcgacgggcttggacgagacggaactgccgtacgtggccgaactgatggacgtggacgagggggacgagcaatggcgtctggcgatggacgtcacgtacgcgcccatcgcgcagaccattctcgtggacaagcggcatgagcaggggttcgccgcgaaggtcagcgcgatcgatccgacgcgtatgacgcggcgtgcctggcgtttcgtcgataccgacgcgcaatacgattcggcctgcaacgaggggtggatgtcgtcgaagctgcggtacaaggaggattcgccgttcgtcggatggttgaaggagcagaccgcgtcgcaacggttcgacgcgcgttgcgtggaggcgatcgacgacatggaccgggccgaacggcaggtgcaggtcgacgggcagatcaaatccggcgaccgtggcttccatggcgtcaaaggcctgcgtcaggtcatcggcttcgtgaacgaacggtatctggccgaattggaacgccagcttgacggggcggaacgggcgttggaggacgccgaccgccgcggcaggcagatggccaacgccatgactctgctgcaggacgagcatgagctcgcattgaccgtcgcggatctgccatggggcaagatcgacgtggacgggctcgagacgaaggcggaacggatccgtctgcagatcgaacggatcgaaagcgatccggaactggcacaattgcaggacgagttgaaacagctgctacggcagaaggacgacgagggcaagaccaggtaccgtgccgaagcggaattggaaaacgcgcagcatgccgtccaggccgaacaggcatggctcgacatgcatggcgactccgatttcgacgatgccgcattgcccgacatggtgtcgaatctgctggccgacacgtatgagacctgtttcgacacgtcgcgtccgcaggaacggccgcagcgcatcgccggcggtttcgaccgtgaggggacggcgccgttcgacgtgcgcgtgctgcgcagaatcggcaacaccgtgcgtgcgagactccagcagatcgacgagcgtgccgtccaattgcgcgccgacacggaacgcgccatgggcgactatctgaagcaccattccacggagggcgacaccgtcatggcgagcgtggaggactatccgtatttccttgacgagctcaagaacctcaacatgctcgtcacccgcgccgcgaccgacgaggagtatgcgaacagcgtcgaaaagctgtatatgagcttccaacagctcaaccgcgcgttcaacaccgacgaggagaacgtcagggagcagctcgaccgcatcaacggcatgctcaaaggccaacagttcggcccccgcggcggcaggctctcgctccacgtggacttccacccgatcgaccggcagttcaaaacctcgttgggccgcatcatgtcgaagctcgacgattggacacgcaacgcgcgcagcaatcccatggagacgcgcaaggcgttcgcaggctgcgaaacgttcatcggcaggctccaggcggaactcggccagatccgcgacacgaacggcatcaaggaatacggtgcgcgcaacctcgatccgcgcgtgcgcagctcgttctacgcgatcgtgcaccataacgatctgcccgacgagcgcatcagctccaccggcggcaagtccggcggcgcgttgcaggaactcacctcgttcgtctacggcgcggccctgatctacctgctcggcggcgacctgaccggcaagcccacctacaccacgctgttcctggacgaagccctcatcaaagccgacggacgctacacgaaacgcgcgctgaccgtgctgccgcgcctcggcttccagatcatcgtatccgcgccggaaagcaaaaccgccgaaatcctcagcatcgcagacaaggcgtacgtggcatacaaggatcccgcaaccggcaactcgtacctgcaggagctcgaccgcgagccggcaacgcaagccgaaacacaagacgccaccgtcgagcagacgcaacccgcgacggaggcataatatggcagcggccagaaacaccacaggcgaaacggacatccgccggaaactcgacgaatacgtcgacgcccacctcaccaggcacatgtacgacaccgacgaatcctggccgctgcgcaaaaccatccgactgcccaaacaagccgaactagagcagcactacaaccaaatccgcgcccaaaacgaaaccatccgcgactgggcgcggcaacaccactgcgaaaccagcgagaaaaccaaaatcgtctccagcggactcatccaacaaaaaagcccgctcatcgactccgtgaccatacccgacctcgacaccgccctccgcatcgccaccaaacaaacccgcgaacgctacctacgcgaacacgaccgcatgagcgcgctcgccaaagaattcggcctcgaaccggcgaacgccatgaacgtcgccaaaaccctcaaagaccacgacgacaccgacttccacctcgtcatccaagccgcccactacttcgcaaaccacgactgccacaccatgaccccacgcatggcgcccatcccaggattcagcgccaaatggctcggcgcacccaactcccaacgccgcaaagcgatatgccagctcaccggacaagacaacctcaccttccaggaacgcccgaacgaactccgactacgcctcatggacgccgaacaccacgaccaacccgacctcatcgtcacccaaccatgggtccgcagccagccaaccgacatcgaacacgccatcatcatcgaaaacaaagacacctaccaggccatgcccaccgtcgaacacgccatctgcatcctcggcaacggatacgccgcaacatcacacatcacaacactcctgccatggctcaccaccatccccaacatcatctactggggcgacatggacgccaacggactcgacatcctctccaaactacgcgccaccggcatcccatgcacatccatactgatggacaccaccgcataccggacatacgaacaatacggcacccaattcgacgccaaaaacaaacccctcaccacacaaaccccacaacccacacccggactcaccaccgaagaacgcaaactctacgaaacactctgcacaggaacagacatccaatacctacgcatcgaacaggaacgcatccccatacgcgacgccacaaccatcctgcacgaccaacaccactggccaatcgacatacccggcaacgacataccaaacaacaacaccaaatagaacacctgttcgaacccacaacaaaaatacgctatcctatacaacagaacaggcaacaccaagcggaagaacaccatgacaaccaaacgcaacaacacgacacacaacgaagtcgtggtcgaacgcgtactcaccagcgacgcattcctcacacgcgaaatcaaaaaagcccccatgaaaacaacgaacgactcactcatagcagacctcacccacctacccaacgacctcaaaatcaccatccaaggcgctcgcgagcacaatctcaagaacgtggacttggagtttcctcgcaaccgcatggtggtgttcaccggcctgtcgggttcgggcaaatcctcgttggcgttcgatacgctgttcgccgagggccagcgcaggtatgtcgaatcgctgtcggcgtacgcgcgccagtttctggggcagatggacaagccggacgtcgacttcatcgaggggctgagccccgcggtttcgatcgaccagaagaccacgaaccgcaatccgcgttcgacggtcggcacaatcaccgagatctatgattatctgcgactgctgttcgcccgcaccggcattccgcattgtccggaatgcggcgccctggtaagcgcgcaaacaccgcagcagatggtggacacgttgctgaagtatccggaacgcacgcgtttccagattctcgcgccggtcgtgcgcggccgcaagggcgaattcgaggatctgctcgaactgctgcgtggcgatggttacgcgcgtgcgctgatcgacggtgagatgcggcaattgtccgatgacatcaagctcgccaagcagaagaagcacaccatcgaagtggtggtggatcgtctggtggtcaaggacggtatccgccagcgtctgaccgattccatcgaaacggcgttgaagctttccaaaggcgtggtcgtcgccgatttcgtcgatttggacgagaaggatccggaccgccgcaagccgttctccgagaaacgcgcctgcccgaacggccatcagctggaactcgacgagatcgaaccgcgcaccttctccttcaacgcgccgtatggcgcctgccctgaatgcacgggtatcggatacaagctggaaatcgaccccgaactggtcattcccgatccggacaagacgctgaacgagaacgccatcgaaccgtggggcatgaccaaaggcaccggcgaatactaccgccatgtgcttgagggactcggcgatgagatgggcttcgacctagacacgccttggaaggatctgcccaaggacgcgcgcgacgccatcatgtatggccgcgatttcaaggtgcaggtctcgtaccgcaaccgttggggtcgcatgcgcgagtattccaccggtttcgagggcgtggtgcgcacgttgatgcgccggcatgacgaaaccgattccgaccagatgaagcagtattacgagtcatacatgcgcgaggtgccatgccaggcgtgccatgggcggcgtctgcgttcggaagtgcttgccgtcaccgtgggcgacgagtccatcgcggacgtgtgcgacatgtccgccgaacggagcctcgcatggatcaacggcctagaactcgaaggctcggccgcgcagatagccggcgaagtcgtcaaggagattcgcgcacgactcggcttcctcaacgatgtcggcctgaactatctgacgttgtcgcgtgcggcgaagaccctgtcgggcggcgaggcgcagcgcatccgactggccacccagatcggctccggcctggtgggcgtcatgtatgtgctggacgaaccatccatcggcctgcatcagcgtgacaacgaacggctgatcggcacattgcatcatttgcgcgacctcggcaacacgctgatcgtcgtcgaacatgacgaggacaccatcagaaacgcggactgggtcatcgacatcggtccgggcgccggcgaacatggcggcgaggtcgtgtattccggccccgccagaaaaatcaccgaagcgccacgctccatcaccggcgactacatcgccggccgacggaagatcgaagtgcccgccgcacgccgcaagacgcataagaccaagcagctgcgcgtggtcggagcccgcgagaacaacctcaagaacctgaacgtcaatttcccgctgggcgtgttcacctgcgtgacgggcgtgtccggttccggcaaatccacgctggtcaaccagatcctttatccggtgcttgcggacaagctgaacggcgcgcgcatcgtgcccggcaagcacacgcgcgtggaaggcgtggaccagtgcgacaaggtgatccacgtcgaccagaatccgatcggccgcactccgcgttccaatcccgccacctatacgggagtatgggacaaaatccgcacgctgttcgccaagacgcccgaagcgcaggtgcgcggctatggtcccggacggttctcgttcaacgtcaagggaggccgctgcgaggcatgccacggcgacggcacgttgaaaatcgaaatgaacttcctgccggacgtgtacgtggactgcgaggaatgccacggccggcgctacaaccgcgagactctcgaagtgaagtacaacggcaaatcggtcgccgacgtgctgaacatgcccatcgaggaggccgcgcagttcttcaaggcgtacccgtccatctcgcgttacctggacaccctggtgcaggtcggtctcggctatatccggctcggccagccggcgccgacgctgtccggcggcgaatcgcagcgcgtgaaactcgcgacggaactccaacggcgttccaccggcaaaaccgtgtacatcctcgacgagccgaccaccggcctgcatttcgaggacgtgcgcaaactgctgctcgtattgcagggattggtggacaagggcaacaccgtcatcgtcatcgagcacaatctcgacgtggtcaaatccgcggattggatcatcgatctggggccggaaggcggtgacggcggcggcaccatcgtcaccgaaggcacgccggagcaggtcgcgcgatgcgaacagtcgtggacgggcaagttccttagggatatgctgtgactgatttcgaacgacacagtccggacgtgtggcgcaaaacggcggatgcgttacgggaaaccgcagtatcggacgccggcacccaatccgacggcaggggagtgaacaagaacggcgcgcccctgttgggggatactcgcgacctgttccgtccgaaaacctccgacattcccgcgcagccgggcgtatacaagtggcgtgacggcgaggggcgcgtcatctacgttggcaaggccaagaacctgcgcaaccggctgacgaactacttccagccgctctaccagctgcatccacgcacccagaccatggtgttgacggctcgcagcctcgaatggacggtagtgggtacggaactggagtcgctcacactcgaatacacgtggatcaaggagttcgacccacgattcaacgtggtgttccgcgatgacaagacctacccgtatctggccatctcatcaggcgaacgcatcccacgcgtatgggtgactcgcagccgcaaacgtcgcgataccagatatttcggcccgtacgccaaggtatgggatcttcggcacagcctcgacgcgttgctgaagacgtttcccgtgcgcacatgctcgaagaacgtgttccacaaggcgcagttgacgggccgtccatgcctgttggcatcgatcggcaaatgctccgctccatgcgtgaaccgtatcggcgctgacgagcatcgcaggatgtgcgagcagcttgtcggcgtgatgaccggccgaatcggcaaatcgtatatcgcccaactgacccgcgacatgaagcaggcgagcgccgaactggaattcgagaaggcggcccggctgcgcgatcagatccaaatgctcgggaccgtggtccagcagaacgccgtcgtgttcgattcggatgtcgacgccgacgtgttcggcatcgcgtccgacgagcttgaagccagcgtgcacgcgttcttcgtgcggtccggatcaattcgcggcgaacgtaactggagtgtggagcgagtcgaagatgtgagcgacgcggagttgatcgccgatctgatcactcaggtatattcggaaaccacgggggagagcgcggccgtctccgattcgaccgtcgtgaccgagcagcgcaatgcgatcggttcgacacagaccgtgaccgcaacggatgctatcgcccgtgcgcaggccacgaaggaacgcaacgaacgtcaggagcagacgggacgtgccgacctgctggctccaatcgcgcctgttccccgtgaggtgatcgttccaatcgaaccgtcgcgcagcgcagggcttgagcaatggctaaacggattgcgtggagcggccgtcaccatccgtgtagccagcagaggcgacaagaaacagcttatggaccgtgccaacgacaatgccaagcaggcgttggcacgcagcaagatgagccgtatcagcgatatgggcgcacgttccgatgcgatgaacgatgtggcgaaggctcttgggcttgaacaggcgccgttgcgcattgaatgctacgacatttccaacacagtcggcggcgcgttccaggtagcgtccatggtggtgttcgaagacgcgatcgcgaaaaagtcggagtaccgccgtttcgccatccgaggtgcggacgggcagggcgcgttggatgatttgagcgcattgtatgagacgttgacccgtcgtttccgccatggcaacatcgccggcgattccggggaaagcatggacaacgagcgtcggatggccacgcaaaatgataggtcggatggcacgaatggtcctgaaacggatgccgtgcagcagaacaccaaccgtcgccatttcgcctataagccgaatctggtcgtggtcgatggcggcaaaccgcaggtgatgacggcggccaaggcgcttgccgactgcggcgtggacgatgtggccgtctgcggattggcgaagcgtcttgaggaggtttgggtgccggatgacgactatccgatcatcctcaagcgacaatccgaaggcatgtatctgctgcagcgggtgcgtgacgaatcgcatcgtttcgccatcacctaccatcgtcagaccagacgcaaaggagctttgcgttccgctttggacgacattcccggcatcggcgaagcctatcagaaacggcttctcaaccatttcggctccgtacgcgccatgcgtgaggcgagcgtggaggatttcgaacaggtcaaaggcatcggccatgccaaggccgagaacatttaccaggcattgcattcgtccgttgacattgcttcgaaggcggaggatgccctccgaacagtgaaatcggatggaaacagtccgaaagatgaaaagaaatagaatctgtaacgagcaatcgcttctgcgttgctagcatgatgaatggtgagagtaagggagggaacatgaccgaggtggaccatcggtgcgcggtccttggcaaacccatcgcgcattcgctttcccctgtattgcataatgcggcctatcgagctctaggacttgacagctggtcgtatggcaggcacgaggtcggcgagacggagcttgaggattttttggagtcgcttgattccagctgggcgggactgagcctgaccatgccgttgaagaagaccatccagccatatggcgtgccatgcaacgcgtgggcgaaagagctgaaggtggccaacaccgccgtcttcgactggtctggcgcgaacgataagaacgccgccatccctgcgatcaggctctacaacacggatgtgaagggaattgagctcgccttcgagcactcgtatcgggcacgtggcatgcggatggattctggacaagacggcgaggcggtgatcatcggcaatggcaacaccgccacctcggctttggcggcctgcaccgagatgccccacattggacatgtcaccgtcgtggcacgccatcccgataagaacgaggcgcttgaaccattggcggaaagccatatgggcgtcggctccataagcatcgtcgccatggaccatgcggtgaatctgctgtcccatgcggacgtcgtcatcaacaccatccccggccttgccgccgatccgatcgccgaggcgtttgcctcagccggcatagtcacgaacggcacgctactcgacgtggtctatgatccccgcccgaccaagctcatgcaggcctggaggtcatgcggcggcaccgccatcggcggcgaggagatgctgctgtaccaagccatgattcaagtctggctgatgaccggcatatgggacaacgatccgccgaccgagcccaccagccatcagaaagtcgaagcattggagcatgccatgcgctccgcgcttaaggaggccctgtgatgaacgaaaagaacaacgccgtcaaccaggcaggcaggcatacgagcgcgccttctccggccgcaggcttcgaagtgctgctcatcaccggcatgagcggcgcgggccggtcccacgcggccaacagcatcgaggacatgggctggtatgtggtcgacaacatgccgccgaaactgcttgtcccgctggtggacatgatgaccagctccggttcgaacatccacaaactcgccgcggtcatcgacgtgaggtcacgtgactatttcgacgacctgtccgccgtgctgagccatctggacgatcttggggtgaagacccgcatcctgttcctcgacgccagcaacgaggtgctcatcaagcgctacgaatccgtgcgcaggccccatccgctgcagcagggcaatcgtctgatcgacggcatccttgaggaacgcgacctgctgaagaacctcaaagagcacgccgacatcgtcatcgacacctcggcattgagcatccatcagctgtccacgaaactgtacgagggtctgcttggttccggaccgaccacggtttccgtgcatatcttcagtttcggattcaaatacggcattccgatagacgccgatttcgtggcggacgtccggttccttcccaacccgttctgggtgccggagcttcgttcgctgacgggcaaggacaaaccggtcagcgactacgtgctctccagcgagggcgcggaggagttccttgacgcctacgagaaagccatcgccatcgccatcgaaggttatgcgcaggaagacaagcactatgtgaccatcgcgttcggatgcaccggcggccagcaccgttccgtggccatgagcgaggccttggccaagcgcctgcgtgcgcgtggtctcacggtctccgtatcggcccgcgagctggacaagcgttcggccgattgatgaccgcattgtgagaagacagtatccaaatacaaagaaaagctgccggctttgtccaagttattcggtatcacagtaagccggtagcagtgcgggtcgagtccgcgactcgcctgaaattatagggaagaacaggaaagtaggaggttggctcttggctcttctggatgacgtcaaaagcgagctggccgcaatcgacaacgagttgcccatcgccaaaaaggcacaggcgactgcgatgattcgattcggcaatggtttgcactcggtggatcaccacattctcgtgcaggcgcagcttgattcccaagacgcggccatatggctgcaggacaccatcagaaatctgtacggccacgaagccacgcttacccccgtttccaggcagacgccgaccggcgtggtgcagcgcttcatagtccgcgtccccaagggcagcgcggctctggtgctgcagaccggcctgtacagccgttacaccaaaaacatggtgctgggtctgccgggcgacatcatcaacggcaagatcgcccagatcaaggccgcctggcgtggcgcgttcctcgcaggcggacacctgtccgacccgggcaaggccagctatctcgaaatcgtatgtccgaatcatgaggccgcgctggcgctggtctccaccgcgcgtcgtctcggcatcaccgccaagccgcgtaagctgcgcagctccgaacgtgtgacgttgcgcgaccccgatgccatcgaacgcatgctcatcctcatgggcgcccctcattccgcccgcgaatggaccggaaagcgttccgacggagaggcccgaggcaaggcgaaccgtctggcgaacttcgatgacgccaacatgcgccgtagcgccaaggccgccgcggaagcctgcgataaggtccgccaggcctttgaaatcctcggcgacgacgttccggacaatcttaaatccgccggccagctccgactcgaccatgccgacgcgtcccttgagcagctgggccgtctcgccgacccgccaatcaccaaggacgcgatcgccggacgtatccgtcgactgctgcaattggctgagaaaacggagaaggcacgccgtcaagcggcctgattttcgtttccggaaacaaaacaccatgcgacttttccgtcgtatggtgttttttgttcgtttgggcttgtattatgcgtaagtggcaatatggccattccacgcttacaagcggctaggaaaggatatacatgaagacactcaaggatcttggagatctcaagggcaagcgcgttctggttcgcgccgatttcaacgttccgctggacggcaccacgatcaccgatgatggtcgtatcaaggccgccctgccgaccatcaaggctctgcgcgaacagggtgcgaaggtcattctgatggctcatctcggccgtccgaagggcaaggtcgttccggaactgtccctggctccggtcgccgcccgtctcggcgagctgctcggcatcaccgttccgctggctgccgacacctatggtgaggacgcccaggccaaggtcgccgctatgaacgatggcgacgtcgtgctgctgcagaacgtgcgtttcaacccggaggagaccagcaaggatccggaggagcgtgccgcatacgccaagaagatcgccgctctcggtgaggtcttcgtctccgacggcttcggtgtcgtgcaccgcgcccagggctccaactatgatgtcgccgccgatctgccggccgccgctggcctgctggtcgagaaggaagtcaaggcactgtcccgcgccaccgtgaacccggagcgtccgctgaccgtcgtgctcggcggctccaaggtctccgacaaactcggcgtgatcgacaacctgctggacaaggccaaccgtctggtcatcggcggtggcatggcgtacaccttcctcaaggccaagggctacgaggtcggcacctccctgctggaagaggaccagatcgaaaccgtcaagggctacatggagcgcgccgagaagaacggcgtcgaactcgtgctgccgaccgatgtcgtcatcaacccggtcttcccgaaatccgatgaggacatcgctccggaagtcgtggccgccgatgccattccggccgacaagatgggtctggacatcggtccggaatcccagaagctcttccacgataagatcgtcgattccaagaccgtcgtgtggaacggcccgatgggcgtgttcgaggtcccgaccttcgctgaaggcaccaaggccgtggcccaggctctcgtcgatgccactgctgccggcgcattcaccatcgtcggtggtggcgattccgcttccgcagtgcgcaacctcggcttcccggaggatggcttctcgcacatctccaccggtggcggcgcctccctcgagttcctcgagggcaaggaactgccgggcctgaaggtgctcgactgatctcagaatcatgaaggggtgcttcctcatcagtgggtgggggagcaccttttgcgtatttcgcatacaatgtcacaagaacgacctttcgctttgacgagcacggacgggagacgacgaatattatggggccgaaacggattcctttggtggccggaaactggaagatgaatttcgatcatcttgaagcgacgtatttcgtacagcagcttgcatggaatcttcgggccgtccatttcgactacaaacgttgcgaaatcgcattgatgccgtcattcacctcactccgcagcgtgcaggtcgccgtcgaatcggacaatctgaaaatccgctacggggcccaagccgtctcagtcacctcgcagggagcgttcaccggcgacgtctccgccgatatgatcgcccatctcggctgctcgtacgtgatcgtcggccattcggaacgacgcaaataccatcccgaagacgacgcgaacatcgtcgaccaggtgagggccgtgcttgctgccggcatgcagccgatactttgcgtcggagaaagctacgaggaacggcgcaaaggcatagagctcgatttcgcggtcggccaggtgcacgacgtgacgcgggacctgtccgatgaggaggccgcgaagctgattgtggcgtacgagccggtatgggcgatcggcaccggcatggtggctacgcctcagtcggcacaggacgcggccagggcgatccgaaacgacctgtccgatacgttcggaacacgggtcggcgaaacggtgcgaatcctgtacggcggttcggtgtcctcgaaaaacgcggtggaactgatcaacgagccggatgtggacggcttcctgatcggcggctccgcgttgaaggtcgatgaactcacacgcatctgcaagctgacattggaaacaaccgcctgaaaacttttaaaaagcatggttggacgctcgattttttcaacaccatgcgctattatcagaaacagtgtttacgaactggaggttcacccgtgtccgctatggctactgtcaagcttgtgctgcagattcttcttgtcatcctcagcctcttgctcaccttgcttatccttatgcacaagggtaaaggcggcggcttgtccgacatgttcggcggcggactcacccagaacgcgggttcctccggtgtcgcggaaaagaacctgaaccgttggaccgtcatcatcgccctgctgtgggtggccatcatcatcgccctcggtctgatgacgaaattcaacctcatctgattgacgtaatttggtttggcccatgaccggcttcacggtcatgggccaaacttgtctccggctagattgctcccgcaaaggattcaaatgacttcgacaaacaacacctatgatgacgtgaccatggtcgtcgccgatctggacggcacactgctgcacgacggaaagactttcgaggaccgtttcctgacgcaacgatccattgacagcatcaaccgcatgcacgacgccggcatcaaattcgtggtggagaccgcgcgaccggtcagcaccggctactcgttcgtgcagaagcttccggttgacgccgtcgcctatctcaacggggcgctgttggatttcaaccccgtctcgtccgattacgatatgctcacctcaccgacactgccgaaggacggacatctgcagaagatcggattctcttcgaaaagggcctgcgaggtctgcaagtacctgctggaggaactgcctggcatggaagtgggcatcgtcatggatgatgtcaggtacacgaatttcgacgtcacgaaatactggaagacgcagacctggcgatacacggatttcgatgacgttccggacggcaccgcggacaagctgatcctgttcccgaacgaggagcagtggaagcgtgtgggacggctcatccccgacgatttcgacgtgcatatctccgaaggctcgctgtggatgctgatgaatccgcaggccaataaggagcatgcattgagcatcctcgccgatcgcatgtcgacgccgttgtcacggaccgtctcattcggcgacgatttggtggacatcgccatgcttcgtgaatccggcaggggagtggccgtggccaacgcgaaccccgacgtgttgaaaatcgccgatgagatctgcccttcgaacaatgatgacggcgtggcccaatgggttgagaacaatctgctttgaccgaccccccacatggagtcttttcacggaattgaactcattcatgcagcggcatgaaacacatccaccaaaattgaactctttgtctttcttggtgccctgtcgtgctattctttgaactagcttttgtttaaattgaactggaaggataggcatgacggaatcattctcgaccagattgaatgatgccatggcattacgcgagcttaaacagattgatttcgttcatgctgcggaaaagttcaatatcaagctcggcaaaagccatatgagccaatacgtcagtggcaaaaccgttccccgtgccgatatcgcgcatttccttgccgcgtatctgcgggtcaacgaggattggctgatgggcaaggatgttcccatggaagagcatgccgcgattttgccggattttgccggtgaacagcccgaccatgttgacgatgcatccgagcaaccgacagaaggaagaaccatgcgcacttttacgaaatcccacaagctcgacaacgtgctgtacgacgtccgtggaccggtcgccgacgaggccgcgcgcatggaggccgccggcacgcacatcctgaaactcaatatcggcaatccggcaccgttcggcttccgcacgccggatgaagtggtctacgacatgtcgcagcagctgcccgacacggaaggctattcgccgtcgaagggcctgttctccgcgcgcaaagccatcatgcagtatgcgcagctgaagaacatccccaacgtgtccatcgacgacatctacaccggcaacggcgtcagcgaacttatcaacctgtccttatccgcgttgctggacaacggcgacgaggtactcgtgccgtcgccggattatccgctgtggacagcttgcgtgaatctggccggcggaaccgcggtgcattacgtctgcgatgaggattccgaatggtatccggacatcgacgacatgcgttccaagattaccgacaagaccaaggcgatcgtcatcatcaatccgaacaatccgaccggcgcgctgtatccgaaggaagtgcttcagcagattgtcgatcttgcgcgagagcaccagctcatgatcttctcggatgagatctacgaccgtctggtcatggatgggttggagcacatctccatcgcgtcccttgcgcctgacctgttctgcgtgacgttctccggattgtcgaagtcccatatgatcgccggctggcgtgtcggctggatggtgctgagcggcaacaagcgtctcgccaaggattacatcgagggtctgaacatgctggccaacatgcgtatgtgctcgaacgtgcctgcgcagtcggtggtgcagaccgcattgggcggccatcaaagcgtcaaggattatctggtgcccggcggccgcatctacgatcagcgcgagttggtgtacaacatgctcaacgatattccaggcatcaccgcggtcaaaccgaaagcggcgttctacatcttcccgaagatcgatgtgaagaagttcaacatccattccgatgagcagttcgcgcttgacctgctgcatgacaagcatatcctcatcagccacggcggtgcgttcaactggcaggaaccggaccacttccgtgtggtctatctgcctcgcatcagcatgttgaaggagaccatcggcgaaatcggcgacttcttcagcacgtattggcaggcttgattttcggttcgcttttctttcgattatggccgcgatctgatatcgcggcctttttgtctttccgtatgtcttctgcgcgtattatttcggcatacgaaaaagaggtctccatcaaaagatggagacctctcggcttttatccgtttaacggtgctgtatcagcgaatgattcagccgttgacgcggtcgatgccagcctggacgtcggcgaggacggtgtcccaggacttgatgaaggctgctacgccgtcagcttccagcttgtcggtgacatccttgatgttgatgcccagatcggcgagcttgttcatgatggcgtgggactcttcgtaggtgcccttgatggacggagcgccattgccgtgatcggcgagagcgttcagggtcttctccggcatggtgttgacgacgaacggagcaacgagctcgtcgacgtacttgcagtcggagtaggcggcgttcttggtgccggtggaggcccacagcggacgctgcttcttggcgcccttggcttcaagagcggcccaacgcggatcgttggcgaacttgttctcgaacagctcgtaagccaggcgagcgttggccacagcggccttgccctcgagagccttggcttcgtcggagccgttggcttccagcagcttgtccacagcggtgtccacgcgggagacgaagaaggaagcgacggagccgatgtgcttcaggtcgtggccgttggcgtcagcctgggcgatgccctcgatgtaggcgtcgatgacctgctcgtaacgctccagggagaagatcagggtgacgttcacggagatgcccttggccagggtggcggtgattgccggcaggccttcgagggtggccggaatcttgatcatggcgttcggacggttcaccttggcccagagttcctcggcctgcttctcggtggcctcggtctcgtgagccagacgcggatccacttcgatggagacgcggccgtcaacgaaatcggacttctcggcaacctcacggaagatgtcggtggcgttgcgcacgtcggtggtggtgagctcgcgcacggcggtctcaacgtcgaccttgcccagttccttcagctgcggatcgtacgggccgacctcgtgcagagccttctggaagatggacgggttggtggtcacgccgacaacgttcttgttggcgatgagatcctgcagagagccggactcgatgcgggagcgggacaggtcgtccagccagatcgagacaccggagtcagaggtgcgctgagttgcttcagtcattgttttttctccttgatacctttttggatcaaatcttgtttatcggtgaaaggggaggggcacatgctgtcgtgtccctccccgtatcatcacttggcggcttcgacttccgcgatggaggccttggcggcttccacaacgtgctcggcggtgatgcccagatcgatcatgttctgagcgccatcaccctgcaggccgaactgctcgatggacaccggcttgccgtaggagccgaggtacttgtaccacggcatggcaacgccggcctcgacggagacgcgggccttgacggcggccggaagcacggcctccttgtattcggcgtcctgctcctcgaaccattccacgcacggcacggacacgacgcgggccttgatgccctcgccggccagggtcttggcagcggacacagcccactggacttcggaaccggtggccatgatgatgacgtccggggtgccctcggtgtcaacgagcacgtaagcgcccttcttcacgccgtccttggccttctcagcggtctcggcgagaaccgggacgccctgacgggtcagaaccatagcggtcggcagggtgttcttcttctcgaagaagtaacggtaggcttcagcggtctcgtaagcgtcggccggacgagcgacctcgagctgcgggatggcgcggaaggaagccagatgctccaccggctggtgggtcgggccatcttcgccgactgcgacggagtcgtgggaccacacgtacaggttcggaatctgcatgagagcggccagacgcacggcggaacgctcgtaatcggagaacatgaagaaggtgccgccgtacggacgggtgtgggagcccagcaggatgccgttggtgatggtgcccatggtgaactcgcgcacgccgaagtggagctgacggccgtacttgctgcagttcggccactgcttggtggcgcactcagccggggcgaaggtctcagcgcccttgaggtcggtcttgttggagccgccgaggtcggcggagccgccccagagttccggcatgacggctgcgatggcgttcagagtggagccggaagcgccacgggtggcgacgttcttgccgacttcgaaagtggcctcgaggtcgtcgatggccttgtcgaagccttccggaagctcgccggccttgatgcggtcgtacagggcagccttgtccgggttggccttgcgccatgcgtcgtacttctcgtcccattccttgtgggcttcgagaccgcgctcggcgaccttgcgggcgtgggcgagggcctcttcgtcaacgtggaaggactcctccgggtcgtagccgaggagcttcttgaggccggcgacggcctcggcgcccagcttggagccgtgggaggacgggtcgttggtcttgcccggggtcggccatgcgatcagggtgtcgaccttgatgagcttcggctggttcggggcggcggcgcgggccttggcgatggtgtcggccaggccttcgacgtcctccttgtaggagccgtcaggctggatgaagctgaactcgtcggtgtaccagccgtatgcctggaagcgcttgagcacgtcctcggccagcaccaggttggtgtcgccttcgatctggatgcggttggcatcgaagatcacggtcaggttaccgagctgctggttggcggcgagggaggcggcttcgccggagatgccctcttcgatatcgccttcaccgcagatgacccagatgttgtggtcgaacggggactcgccttccggagcttccggatcgagcaggccacgctggaaacgctggccataggcgaagccgatggcggaggcgaagccctggcccagcggaccggtggtcatttcgatgcccggggtcaggccgtattccggatgacccggggtacgggtgtcggcgccgccacggaagttcttcagatcgtccagggtcaggccgtagccggagaagtacagctggacgtactgggtgagggaggcgtggccaccggaaagaatgaagcgatcgcggccttcccagttggggtcgttcggatcatgcttgatgaagtgctggtacagggtgtaggcgataggcgccagggagacgggggaacccgggtggccgtgtcccgcacgctcaaccgcgtcggccgacaggaccttggccatcttgatggcgcgttcgtccagctcggtctccttgaattcggtcatggattactttccttccaattggtcgggccgcgtatccggcttgtgccgagcgctcgacgccctcacattgcgtttcccatagtagcgatgtgaggtgacgttgtggtgaaattttggcgtgttttggtagtttgtgtgctgttagcgctcacaattaacattcgcgtgaacttcagatgttcgtttgtcgatatatctcccaatgccagtcgccgcaagcctttgccgcatgaaggaaactactctggaagcgaacgaattagcactccgggtgccggagtgctaaaacattaaaagaagttttccgggtacgtctcatcagcaccgtcaaacataaggcgtaccggcacacacctatgcataaggaggcgcgcatggcgcaatcaagacgcatgctggtgttgcgtgccgtggtcgaggattacatccgttctcaggaaccggtgggttccaccacactgacccgggatcatgacctcggcgtcagctccgccaccgtgcgcaacgacatggcggccttggaagatgaaggctatcttattcagccgcacacttcggccggcagggtaccgaccgaaaaagggtaccgttacttcgtcgaccgtttggcgacggtcgttccgctatcggaggcccagcgccgcggcatcaacagctttctgtccggatcggtcaatctgcaggacacgctgcagcgggccgcccggctgctggcgcagatcaccggacaggtcgccgtcgtggccgcgccgtcactgtcgaagtcgacattgcggcatatcgaaatcgtgccagtgtccattaatacgctgcttgccgtagtgatcaccgataccggccgtgtcgcgcagcatatcctcaacgtcacgaaattgccggacgtgacgacgctcactcatctgaccaacgagatcaacacgcaatgctccggcgtttcgctgacccgcacggccgattgcgtacgacagatgggagcgcgcaaggaataccatgcgatcagcacgcttgcggaaacgcttgcgcaggcctttgatggcatggcggatgacgaacgcgcgagcgaattgtacatggcgggcacttcacggcttgcgcatcaacgcacggtggccgacctggccccgctgttcgacgcgttggaggagcaggtggtgctcatgaagttgatgagctcgctgagcgaaaccacgcaatccgacggcgtcggagtggcgatcggttccgaaacgcacacgcccggtttgctgcacgcctcagtggtaaccagtggctacgggcgtacctccgcggccgccacggacggcgcgacgcatgcggccgcatcatcacagacggaaaatcaaagcggtgatgatacgcagcaggcgggcgaaccggtcgcattcgtcggatcgatcgggccgacgcatatggactacgcggcgaccatggccgccgtgagggcggtcgccagatatctgacggcgttcctcgcccacgatgaaggtcagccggccgactgaccccgccttatggcacaatgacacgcagaaccaacagggagaaagaataatcgtgacggactattacgaagtgctgggcgtcgaccgttcggcaagcgacgacgagatcaaaaaggcgtatcgaaagatgagccgcaaataccatcccgacatcgcaggtccggaattcgaagacaagttcaaggaagtcaacaacgcgtacgatgtgctgtcggatcctaagaaacggcagatgtacgatgccggcgtcgatccgaacgatccgaatgcgggcggcatgcacggtggcggattcggtggcggattcggcgatatgggggacatcttcagcatgttcaccggtggcggattcggtggcaccggcggtggaccgactccgcgcacccagccggggcgtgacgcgcttgtttccgcgaccatcgatttgaagacggcggtgttcggcgacaccacgcacgtcaaggtcaacacgttcggcctgtgccaggaatgcggcggcaccggctgccagaacggcacacagcccacacaatgtcccgactgccacggtcagggatatgcgcagcgcgtggtacgcaccatgctcggccagatgatgaccaccgcgccatgcgaacgctgcgaaggccatggaacggtcatcgagaagccgtgcccgtcctgcctcggccatggccgcgtgcgcgtcacccgcaatgtcggcgtcgcggtgccggccggcgtggcgaacaacacccgtctgcgtctcgctaatcagggtgaggtcggcgaaaatggcggcgtcgcgggcgatttgtatgtggatatccgcatcaagccggatgacatgttcactcgtgatgacgacgatttgcattgttggatcaaggtgccgatgagttgggccgtattggggcacgaagtcgaaatcgacaccttcgacggcaggcagacgctggatatcccagccggcagccagccggacgataccgtgacgttgaagaacctcggcgtcacgcatctcgacgacaagaacgagcgcggcgatttggtggcgcacgtagtggtggagattcctaagaagctgtccgatgacgagcgggagctgattgagcggttcggcgagatgcacgacacggacgcccagcatgttgtcgtgaagtcccgtccgtcgtccggcgcgaagaaggggttcttctccaagctgaaggacgcgctgcgctagttttcgcaatccaatcgaatacgggacatgtgaaagaagtccgtatcccaactcataaccttgggatacggacttctttcacatctggcgtggcgggtgattcccgcctatttgagcagcgacctgcacatggtgcgatactggctcacatatcctccaccgaagaacacgcaatgtcctgcaatggggtagagctgccataatgtgatgcggtcctgccatccggccttaagcggatgcgccgactgatagccttcgaggatgtccgtaagatatgacatgccgaacaggtcgagcatggcaaggtcttcctcacggtgcccaccgtgagccgcaggatcgataagcacggcttcgacgtcaccggaatcagcagtccacatgacgttgccgctccacaggtcgccatgcacgcgtgcgggcttgtcgttggcggccttgcctaggatgtcgggcaaggcgtcgataacggcttcagtcagttccatgtcatagtcggtcagttcgcgacgtttcatgccgagtcgtaccatcggacgcaatctgccgtccgccagataggtggccacatcatcccaggcaccggtatccatcgggacgggatcctgcaatggcccgaaatagcaggtgccgtcgtatccagttggagcggagccaaaatgttcggcaccggcatcatgcatatgagctagcgcaacaccgaaatcgcgcgcggcttggatggtcggaccgcaggcgttcacgcgttcaatgtcgagataatccttgccccagtcgtatacgtcgaccacgcgtgggccgccctgcgattgcgcctcgccgagccatttgaggccgcgtccctcgcattcaaagaaaccttcggggctgaatgccctgcttttgcggtatttgcccatgccgatgagcctttctcccatgccggacatgccggcgtacttttggctccattgtgtgcatggtttgagacaactatgccgggatgccttgaaaactagacccctctcgctactcttggtcacggaaaaacagacgaaaccgtatttctacgaacataaagagggttcatgaatttcttccaagcgattttccttggcctggtgcaggcgttgaccgaatacttgccggtctcttccagcgcccatatccgtatcatcggcgatttgatgctgggctccgatccgggtgctgcgttcaccgccatcatccagatcggcaccgagcttgccgtgatcctgtatttccgtcatgacatcatccgcattctcggcgcgtggttcggctccttgttcggcaaggagggcaaggacttcaagagccgtatgggcgcgcataaccgcgacacgcagatgggttggttcatcatcatcggcacgctgccgattctgattgccggtctgttgttcaaggacgccatcgaaagcacgctgcgtaatctgtggatcaccgttaccgtgctgattatcttcggtattctgctgtgggtggtcgacgcccgcgccaagcaggtcaagaccatggatgagatgacctggaaggatgcgctgatcttcggcatcggtcagatgctggcgctgattcctggcgtttcccgttccggcggcaccatcaccttcggccgtgcgatgggttatacccgtgaggctgcagtgcgcgtgagcttcctgatggccattccggccgtgttcggcgcgggcatcctcgaagccgtttccgcggtcaaggatgtggccgcaggcaatgcgggaatgttcccgggctggggtgcgaccatcgcggccaccatcgtggcgttcgtggtcggctatgtggtgatcatcggcttcctgaagttcgtgtccaccttctcgtacaaggcgttcgccatctaccgcatcgcgctggccgttgtcgtggctctgctgctgatctgcggcgtgctgcacccgacggaagtcgttgccgccgcgtaagcgtgattcggcgtaaataaagcgaatcccggccatccgtaaggtggccgggattttttcgtctgcgacctcctcctggaggggaacgactcagacgccgttgcgtagaagtgattcggcctcacgaagcagttcctcgcaggcaggcatgccattcgaggcgattcgcttcgctctcgcgtccaaatcgtaatcatgttccagacgagccaaatagtcgccggcatgcatgtctgacaccaatccatcggcgtcggaacgccattgcatggcctttctggtcaaatctccttcaataagcggatactcgattattaaagacaaggcgcgcagcagctccaaagtgccttgcatgcattcggtattggcacagtaatgcggtacggatacccatatggatgttgtcggaaagcccgcttcggcggcgaaggcgtcaaggatgttggggatgcccaccggaccgttgtattccctgtcggattcgcattcgcagccgcttttggagatgtcaagcggcaatggccgtgtgtgcgggcattcatcgaacatggagccaagcgtgatgacatcacttacgtcatagtcttctgcgacacgtagcgtctgcctgcagtattcctcccaccggtaattgggttcgggtgcgatttgcgcaagcaggtgcagcatgggggagacggcaatgtcatagaaagtcgtttgcggccagatgatgcgcttacgcccctgcacggagcagatcatgggccgggccacctgatagtcgtagaaaccttcgttgtcaatatggcgcacttcctgcgactcataccgggacaccaaatgacggacgacgttcgtggccgcttggcttgcatcgttccatccttcgaatgcggcgataagtatcgtcttgggcattgcgctctcctcacacatgcttttaatgtataccgaaaacgggtggtgtgacacgcgcttcagccatcggtgaatacgaataaaccaaaccgcgacacgctgacttgcaaattacacgaatgtggttatagtagatactcgtgctcacgcagtgaatctgctgaagacatgcggacatagcttagttggtaaagcgcaaccttgccaaggttgagaccgcgggttcgagtcccgttgtccgctctaaggttccgattgattatcgacctttatggtgggttagccaagcggttaggcagcggcctgcaaagccgtatagacgagttcgactctcgtacccacctcgcatcatgtgagattagttttcgcatgttgacatgacccgggcggttggcgcagaggtagcgcacttccctgacacggaaggggtcacaagttcgaatcttgtatcgcccactggagcattgctccgtacaaattaagactgggtgattggcgcagcggctagcgcacttccttcacacggaaggggtcataggttcgattcctatatcacccaccgttatcacagctcggttttgccgggttttttgtttccattccttttcacgctacttcgtcaaataagaatgcaagcatcgacgcgccggcaaaaacagcgatcgacgaaaaacgattcaccacattacacaagaattgccgatgaaaatacagagaatcaaacgagagaagcatgacttttgccaaacgcatttctaaaatgagtatcgtaaacaaaaaagaaaacaaacaagacgcaaggtgcgtcacagcacaccagcaagaaaaggaaacatcatgaacaagaacaagatcttctccgcaatcatgcgtggcttcgaagtcagcggcatcaacgctctgtcttcggctgccggctcctcttccgtcaacggcgctctgcaggaaatcatcgacacccgccgctgattcggacaccacacactgaatccttcttgaaaaagcctggaacgcgattaaaaagcgttccaggctttttgttccccggcaagcggctacaattgcctattgtgaacgagagacaattgaacctcaaccaagcggttaaggatatgggccccaacgaattgaaagcgtacgccgagctggggcagaaacaacacgatgaggcgaaccgcgaactggaacgacgctggcgcagctacgatgacatgctgccgaaggacgaattcgtatccatcatcgacaagaacgaacggtaaataccgttcacagtgtatgattcgtgaccatgccggccacaataccggccaattgcaaggggagagggtagaatgacagctatgactgatccgattccaagcgcaggcgaaacgaccatcattggtcttcctgctatcactgtaccggttacttccaccggagaccgtcctctgacgaaggaggacctcaatacgatcatgcgtctggccgacggcacggcgctcctgatttccaccaggggagcggtgtccggctcgcgttatctcctcgacgaggacgagatcaccgtgggacgcgacccgagttccgatatcctgctggacgattccaccgtctcccgcacgcacgcggtgttccgcaggattaacggaaattattcggtgattgacgccggcagcctgaacggcacatacgtgaaccgtcaacgagtggatagccaggaactgaagaacggcgacgaaatcattctgggcaagttccgtctcgtatatttcaccaacaaggccgtcattgcctaatgaaacgcccgatgcgggataaactgtgagtaacggttttccttcaatcgcctatgggctccgaatggaagctcataggcgattgttttatggcgtgtaggagaagacaatggacggcgaggcagaaccaacaatgcggttgcatctgcacgtgtcgcacgcggtgcagggggagttgttcccctccgcggacgcgcagcccgtcacacggggctatcgtggtacggtcgcgtcaaaagtggcgggtatcacgtaccgccagcttgactattgggcgcgtaaacagatagtggaaccatccatcaccccgtcgcacggatccggctcacgcagattgtattcgttcaaagatgtggtgattcttgccgtttccaaaagattgctggatgccggaatcaatctgcagaacgtgaccaccgccatcggcttcctcgcgcagcgcacgcccgaacagttggccggcatcatcatcatgtgcgatgggcagaatgtgcatgagtgcacggacagcgaacagatggtggctctgctccaaagcggcagagctgtgttcggggtgtccgtcggatcgctatggcatcagatcaaagaggctctagaacatgaggaatacgtcgatttgacgaagacgccggcatcgacagacaccaataggccaatcgacgacattgccgcgatacgtatgagaaagaagctggaatcgcgacgcaaatcccgcgcagcagcctgatcgcatacaattggtacgattcagcccggaacgttcgaacgatataacccgcaggggggtagcgcatgcttgatattctgccggcactgttgtggatcatagccgccgtcatcgcagtgaacatttgtttgattactgcgattcgaggcaatctgttttccaaaaaacaccgcgatgtgcatccggtgcgttggtcgatcatcgcgctgcatttcacctcattggtcattggcgcgttgccatatccggcatatgcgatgttcaggtcggatttctcggagaggttccagcgtttctacgaacatgtcggatggccatcggctgcggtgatggtcatgctgatcgcagcggaacttgttttcatgtatcttcaggcccgaaacggcatgcacagcgagatggagcggaagctcaatcaggccgtcaaatagaaatctgacataacgtacattatcggctttttaggaatgacgtttttccaggcttgaggaagcgtcaaacacgcggttctgacataacggcctccgtcactcaataaataaaaacgtggttgctgccacgatattgcgacagcaaccacgtaactggcctacagcgtttccgtttacggactcaggcgaaatactcctcgacggcctgtgcgagttcatctaccgaatccagaatacggtatgcgccatgggctttgagctctccgggctccgcatagccccagccacagccgaggcagtccaaaccgcacgccttggcgccgtcggcatcggtccaacggtcaccgaccatcagtgccttgtctcctgcgttctcgtcgaaatcgatgtgctggaaagcccaacggatcacttggtccttgtcaagacgggaattgtcctcgctggcaccgtagatgccgtcgaccatggtgtccaagtggaaatgctcgcaaatcggaatgcattggtattgcggcttgcagctggcaatcgccagatagtatccgtcggcacgcagtttggcgagctgctccggaataccttggtaaatcgtgttgttcaggcggccggggactttctgtccgggattgttcgggtcgtcgaacacggcctcgtcggcgtaatacttgcggtaaatcctcacgccttcgtcaagcttgtcatccggaatgccgttgcgttgcatcgattcgctgatggccggtccaatgaaacgatgcaattcggcatcgtccggcaccggatatcccatctcttcgaacgccttgacaacgcagccaatgattcctggatcggatttcgtcaatgtgccatcgaggtcaagcagaacgactttcttcggatgttcggacatggatctgattctccccttggctgtgtgctataagaattgatgacagaaacaattatgcccggtctcaatgaccgggcattcgttcaagtgtcgttcaactgcaggtcactcgtagtccgggaaccatccgtcacgatgcatttgcagacgcttctccagcaaagccttcagttcgtcttcggtacgacgttccatgagcatgtcccagtgcgtgcgtgtcggcttggcgatttcatcagcctcgtcgtcattgtctccttcacggtgcgcgacggcgccgcagcggcactcccactcatctgggaattctgcgccctcagcgaacggcagaatcgtacgatggcctttcggacacacgtatgcgacgtcggttcgcgccgcaaaatccacattgtcatcggattcaagcgacttcgcaccgatgctcatgcctcgcaggctacgttccgccatattgcttttgcctccttgattatctgcttactctaagctacaaaacacttcggacgtgtcacttattcccggcgtccgcgaaaaccgatctcccgattgcgcacatgctcagtcgacacctgaataggcgacgatgccacggttgacgttctcgtacgcctgtttcgcgatcggagcgagcgtttcggcgcgtttacccaggtatggtccggccacggcgatctgctgcaacacgtcggcgagacgtttgcatccgcgtacgaaatcgccgccggtcaaatcggtgccgtacagcacacgcgacaggctttcgccctgagcccattcgtagacgacatcggtgatgccgaaatcaagttggcgcggctcgtcgagggcatagtcctcacacagcatggcaatcgacgcgtgcacgcctttgagctgcgccgcacagacggcgacgttcccctgcattcctccgggataatggcgcggctctcccccgctgcctctgcgtggctcgtaaatcaacgacatgacggcgctggccagctccgtcgcatcgagtccgtcgaacgcgccatcatcgatcgcctgggcaagcaccaaatcaagctcgctgtacaagtgccgcaacagctgtccacgttcggtaagccggtaatcgatatgttcttttgcgccttcatcaagccgatcgaggtatccgagctcgttcagcacattgcagatgcggtcgaattgacgtgccacggagccggtgcgtgaatcgtagcggtgctgcacacgttccaattcacgcatttcacgcgcccaccgatgcccccatttgagatgcttctgaatatcggggcatttgcggcagggatggtccctgcctttttcgcgaagctccgcgatacgcctgtcaaggtctttgaacgcttcgcttcgcgccttctgcgtgcggaacacctcgtgcttgagtttgcgtcgttcgttcttttccaagtcgctcaagcgcatgcgcagccgcatgaactccttgaagtcgccgaactcacaatcgaacgcccgttcgtatccgtccaacgctttgcgcaacgtatccatctgcgcttcaagctgccaggcggattcgttggcctcccattgcgcgaaggaatggtcaagcgtgatgcgagcggtctcgtaatcgctggaattaagcaggttgacggccatgttgaacgtcggtttgaaactggagtgcagcgggtacacgcgcttgctggacagcgcggcggcagtggcgggaatgaagccatgatggtccacaaccaccgcatggccgatggtgtcgatgccacgtcggccagcgcgtccggtaagctgggtgaactcccctggcgtcaatccgacatgcccggtcccatcgaatttctcaagtttttccaccaccacgcaccgtgccggcatgttgatgcccaaggcaagtgtttccgtggcgaagacgaccttcaccagcccctcttcgaacagtcgttcgacaatttggcggaagagcgccaccatgccagcatgatgcggcgcgaatccttcctccaaggcgaagcggaactgcgagaaatgcaaagccttcaaatcctcttgactgagttggccttcgaccatctcatcgacgatacggcggatgcgacgcatctcgtcatcggtggtgagttcgagtccggcgttgatgcattgttcgacggcctgatcgcatccgttgcgggagaagatgaaatagatgcccggcaggatgccgaggaaattcaattcatcaatcacggcccaacgacgtggcgtatggcgttcgggtctgcgggaatggtcgttccatttgccgcccttgccgccctttcgtctgtcggggcgctgctctcccctacgtttcgcggccttgcggtcgagctgatcgagcctgctcaccagctgggcgttgagcttgtctgtctgattgccgtctttatcacgtcgatacaggtcgatgagttccggttcggtgtggtcgtccgcctgaacaagcacatgctgttccaacggcacgggccgtttttcggacaccaccagcgtggtgtcgccacggaccgattcaatccatttggagaagtcctcgacattcgacacggttgcggacaggccgatgattctcacgctttggggcaggtggatgatcacttcctcccacaccggcccgcggaaacggtcggcgagatagtgcacctcgtcaagaatcacgtaacgcaaggcgtcaagcgtcatggaatgctcgtagagcatgttgcgcaggacctcggtggtcatgaccacgatgtcggcttcggagttgatggacgtgtcgccggtaagcaggccgactctgtccggcccgtacgtttcgaccagatcatggtatttctgattgctcaacgctttgattggcgtggtgtagaacgctttgacgttacgctcttgggccagatagatcgcgaaatcagccacgaccgtcttgccggctccggtgggcgcggcgacgagcacattgtcgccggcttccaacgcatcattggctttgacttggaaatcgtccaattcgaatggcatggaccgtgcgaaacgagacgagaccgattggcgtttggcctgcgtctgtttgaacgccgcatagcgttgcgcgggagatagggctgtggtcatctcggcatcgtatgtgccggtgtcgttattgccatgtcgacgatgatgagtcatggttccttttcgaatcagtcgttggaatgtttccactgcgcccactgccgggcatgacggacgcgcttttcctcacggcggctgatgacttcggcatgagcgtcgatataacgattggccgcgtcctcaagtggacgtgtaaagaacggggacgtgttctcctttggttgcggcaacggctcggacatggcctcgaaacgtttggacatgcgtccgcctactttgatggcatctttgaacgcatgatatccgcggatgcatgcgtatgcgccgccgccgaccagcatcgtcagcatgaacaggacgagtaccagccaaatccaccaaggcatagcgcctcccccgtcagtcttcgttctctcggtcgccgacgctcagctcatgctgtgctcgggcgatgatcatcgtgcgcaacgtctccggcgcgacggcagtaatatgacgggcgtgcgcgatgcagaacgcgacataccaggaatcggaagacacaatcagatgcaccttctcgccttcgccgcatttctcgacggtggctcccgacaggctgtcgatgaacgacaggtcgtcctgattggttatgaacacggcaggtgtgccattgtcgaaactccacttgcgcagttcggatgcgggcacgtccggaatgtccactttttcagtgggttcgaccagctccgcatgctcgatgcgggagatgcgaagcacctgccagatacgaggcttgccagtagccttgttgatggtcgtatccgtcttgacgaacttcatcttgtccgcgggcgccgcgttggacacgtcggtccataccgccacgtagtaaacgccttcgtcgacaaaaatcttgtctggcgccactagcttgcgctgtatacggcccgcaccgtccgtatattccatgtcgagcagcatgcctttggagatggcgctcttgacgatggagaagttccttggttccatctcgtatccggtcaggctcagccacggcatgtcgccaggcttgacgtgctggcgcagtcggctgtacagcgattccgcctgctcacgcagcttgtccggaagcaaagaggagtgggcgagatagctcaccgatgcggtcagcatgctcaggtactgctgggaaatgccggcaaggcgttcaagccccagcgaattcgtggcggagacgatgccttccgcgtcaagcaaggaccaatcgatatcgaagaactggcttccggccatctcgccatcatcggacaccgtggtcaacgtgttgatgtccttatgaatgatgttgacgaacttcttcaattcgtcatcggacttcggcctgccgatgaatcgttccgcaagttcttcaagagagtattcctcacccatgtgggcggacaggaacagcatcaggcgaagacgccgatcgacctcactaccggtctggaacgcggagttcttcttcggacggcccttgccttcctcggtatcatcctcatcagtgctgttgcggttgatttccggagacaccacggtggagctgtcggtgccggtggattcatcggccggcacgaactgcgtggccgcatgcagccggcggttgaacgcgtcgacagcctcctgagggctcactatggacgcacccggatgagacagcacgaacatggccagatcatcggagtcggcgtaggcgacattgagatgctcgccatcaacatccacagtggcggcgaaacgtcgctgatcgaccactttgaccagctcgtcgggaatggattgcgtgccaagacccggcgcgatggaatccaagccaagtcctggaatcggcgtctgcggcacgcgcggcgcggtacgggaagcgtgctggggttcgtgcgcaggagccgaggaaatcgacatggagcgcgcaaggtaattcgcagcggcaagaatcggaagatcctcgtcgccgaacagcagacgcacgcgcggctcatcgccaagctgcagacggtaggaagcgaaatcctgcccttctgacttggaggaatattccggctgccttgattcgatggcgatgcccatggcggcgagcttggcgcggtcacgctgaaattgcttggcgaaggcggccttcgccgcttgatcggcgagctctccgtacgaatcggcatacgccttcacacgttgcgcgatctgacgtgaggtaagccattgcggaaaggctgaggagagcacagccaacacatcaagctcatgcttgccccatttgtcggaaaaacgtcgcctaccgttacttccctcagccattagtcctcacgtctcgttaacgtttctttttaagtgcttggcctcgtaagccgcacacaacattctatgatagaggttttttaagcgatttgtgcctatttcacgaaaaaacatcgttttcgtgttgcatggccgtccaaaatcagacccaatcgtccggttccacgccctgcgggccgacatattcgccattcggcacatagcttggttcgccttgatcctccagtcgcgcgtcgctaaacagcatcacatccctgccgaaggtccaatcgccatcgatattaacggatttcgccgcggcgagcgaaggcacaccgtatgggaaacgggcatcgaaatcgtggatgttcttgtaatagcgcgcgtccaaatggacgtcggggaagatgtagttgccgtcttccatctcgtactggtccgtcagatggaatcggtcggaccgcatgatgaacaaatcgtcagtggtcttcaccggcaggaaacgcatacggtcgacgcatacgcaggtcgcgccatcgaaaagcgacaccgcggctcccatggcggtctccagctgaatgaccggctcgctggtcggatcggtcgggtcgaccgtcttcttattgcggattaccggaaggggaagcacgccgtcataggatgcgagtttcgctttcagcgcatcgatacgcacccaaatgctgttcgtgttgaagtacggatgcttatcgatgttctgcgcgtcgtccttgtcgtctggatggacctggctcatctcacgcagcatcagacggcccgtggccttgtctcgcacgatgtggccgcccttacgatcggctggggtgcgtttggcgacctcgatcatgaacggtgcgcccgtattctcgaaatgctgcgcaagcgtacgggagggacgcgcgcccaggttgtcggaattggagatgaaaaggtatttgaacccctgcgcctcaagcgcgtcaagcagaccggattcccaaatggtggagaacaggtcgccgtggcccggcgggcaccattcgagttccggattggccgggaagctgacgggcattcccgtttccgcgctgatcttcggctcctgatgctggatgatttccatcgggatgtcttcctgatggaatttcttattggtctgcagcaccttcatggtgtctttggaggtacggaaggagttcatcagagtcaatggcagatcgacgccaagtctggtccgcgcggtcaacacctgtccgatgatgatgtcgatgaaacgcatctgccgtgccttgtggcgacgtaccggcagcagcgacttggcgcaatcgagtcccatcgaagtgccaagaccgccgttaagcttcaggaacgccgttttggcgaacgcgtcaacggccttgtcgtgattgatggtctcatacacgtcatggaagctgggaacactgacgagcggttcgacctcgtcctcacgaatccaactgctggcctcctcattgcgccagacctcgtacagacgacggaactgggcgatggccatgtcggtcattccgtgcttccgcatcttcgcggcagagtattcgaatacgtcctcagtcaatgtctctccctttcgaacgggcgttgttattcgatgcgcttatgccataatacgacattccgccaaaatcgggggcatttagacacagaaccaacatgaacttccggtggagcaattgccggaaaaccctcaaatatccgaagccaaactctccggaatggatgcgactcgctttccgacacgatgtgtttgaaaaaccgtagagattatgctatgcttcatattcggtgcttttcgcaccgttcggaccatagcgcagtttggtagcgcacttgactgggggtcaaggggtcgcgggttcaaatcccgctggtccgaccaagaaagcccgtcgttccgccgttttccacggcatcggaatggcggggttttcgttatgtttgggcaggtttgggcagtgaactgcggcatacagcccctcagaatggcatctatcggagccggaagccggacgtcaggacggtcttgagcgcatgcaaatatgtagcctgcgatatttttcatgtttcttgccgtttaatgcgattaacgcatgggttcagagaggtgattcggtttgcagcagaacgacacgcagccacagttcgatgacgtcgacgaattcgcccatgtgttcgattcaacgcttcccgaagatgaatggaagattcgattgccccgcgagcttggcttggaagcccgcgaacgcgctcggcatgatggcatcacgcttaccgaattgacccgcagggcactcttgtccgacgattccgatggctgttcagacgcggtcggcatcgggcgcatgccaaagaacagcgacgggcgcaaacagcttggcgacgaatggaagatcaaactcccctacgccgtaggccataaggcgcgggccaaggccaagcaggacggcatttcattaagctcgctcgcgcgcagagccataacggggtatctcagaacacgcaaccaggatgaacatcctctgttctgacgctgtcggcctaagctgtgcgtaaaggaaaacaaaagccggcaacgacccagattcaataaggcagatgggcgtgcgccatggtctaaaccaggcgcacgcccatcttctaacagttccggtggttacttgcgtttcttcttctcacggacattcaccgaaatctgaatcggcgatccttcgaagccgaattcctcgcgcagacaccgttcgatgtagcggcgatagccatgctccaagaagccggtggcgaagatcacgaagcgcggcggtctggtggacgcctgcgtcgcaaacaggattcgcggctgcttgccgccacgcagcggatgcgggtgggcagcttggatcttgccaaggaacgcgttgagtttgccggtggggatgcgcttgtcccatgatgccaaggcgccacgcatggcattggccaaacgattggtgtgccatccggtctttgccgacagattgacgcgctgagcccaagtgacgcgattgaactcggtcttccacaggcgttccatacgctgacggtcgaactcgtccatcaggtcccacttgttgaacacaagcacgatgcaacggcccgcgtccacggcctggctcatgaccttcaggtcttggtcggaaatcggctgggaggcatcgaacagcaccaaggcaagctcggaacgttcgatcgcggcctgcgtacgcaacgaggagaagtattccgcgccggacagcttgtgcagacgacgtttgatacctgcggtatcaatgaacagccaatcctcgccatcgacggtgacgacctcatcgaccggatctcgcgtggtgcccgcaagatcgttgacgacggtgcgttcctcgtgggccagctgattgagcagggaggatttgccgacgttcggacgtccgaccagagccacgcggcgcagatgcgacggcgtaaggaagccggatgtcctttccgctttctccaacgagtcgagtgcggcgtcaagcagttcaccgatgccacgaccatgcatggcggaaatgccatacggctcccccagacccatcttccagaattcggcggtcaggtattcgctttcgcgatcatcgaccttgttcaccgcaagcgtcaccggcttgccggcggcacggagcattttgacgatgcgttcgtccgtgtcggtgaggccaaccagaccgtccaccacgagaatcacggcatcggcaagctgcacggcgatttgcgcttgggatgcgatggcggattcgatgccttccacgtcggcttcccagccgcccgtgtcgaccagtttgaaatcggtgccgcaccattcggcgtcgtagctcacacggtcgcgagtcacgccgggggtgtcctccaccacggctgcgcgacggccgagaatacggttcaccagagtggatttgccgacgttcggacgtccgaccacggcaagtacgccgaccggtttcggaccattcttgctttcgccaccagagaacaccgttccatcgatcagctcctcatcgccttcatccagctcatagccttcgaggttggaaacgtactggcggtattcctgttcctcgatggcgtcgtcaacgatacggacgagcacgtcaagggtctcgccgaagttgagatcggagttgtcgacggtcaacacgccttccgcggcggatgtgaagttggtgactttcgaatcggccttgtcgcgtgccgcgacattctccgcacccacacctgagacggcctgtccgctacgtcgggcctgacggacctcttcacgcgcggtaagcaggatgcgcacttcggcgtcgggagcgacgacggtggtgatatcacggccctcagcaacaataccggcgccttcggagaaggaatcgaccgaagcctctcgtgcgatgtaggcacgttgcgcggcgatcaacacgtgacgcacggggatgatgttggacaccttggacacgtgcgaagagacctcggaagaacggatggcctcgctgatgtcctcgccatcggcgtacaccttcggatcatccggatcgacgctgatgtcgaaatggccgtcggtgaagaattcgccgacggtttcggtgacgagctgctcatcgatggtttcggcatccaaatcgatgcctttgtgcatgcaccaccaggcgcaggcacggtacatcgcgcctgtgtcgaggtatgcgaaaccataatatttggccagtgccttggacgtggatgatttgccgacgcccgcaggcccatcaatagctacacggatcacagtcccaccgccttggatagagaacggacctcagcctgcgacaacacgcgatacgtgccgcttttcaggtcgccgagtttgatcggaccgatctgcgtgcgtaccagacgcttgacgggaaaaccgatcgagccgaaaatacggcgcacgatgcggttcttgcccgaatgcagcacgaccttgaccaacgtgctttcgcggctggagtcgagaatagcgcagcggtcgagtttgatccacccatcgtcgagcttcacgcccgtggtgacgagcctgcggcacacctgaccgctgatgcgtccttccagcgtggcgatgtaggtcttttcgacctcatatttggggtgcatgacgtgctggctcagttcgccgtcgttcgtcatgaggattaggccttccgaatcataatccagacggcccatgtggaaaatacgctcgtacttgtctccgacgatgtcgcgcaaagtgtagcgtcccttgggatcctccatggcgctcagcacgcgtttcggcttgttcaacgcaagcgtgacatggttagggttcacacgcacgcgagaaccgtcgacacggacctcctgacgtttcggatcgactcgggtgccaagttcggtaatcagctcgccatcgatctcaacgcgaccatcggtgatgatttcctcgcatttacggcgcgagccgaagcccgcctgagcgagaagtttctgcaggcgaatgccttcattgtcatgattgtgcgccttggcggcgcgagaatatgcgtttggcatcgttctcccaacgtggccggataatacttacagggactgctggtagtatggcagtcgtttggcggctttcataaaaaccgcaacttgtccactatatgacagaggaaagactatgactgctgttgaagcaacgtccgtaacagaggaagaacagagcaagccactggcccttcgcataggcgcggagctggtgggaagcttcatcatctgcttcgccatctactcgatttgcacgcttggttccgcgatctacggcgtgaatatggcgttcatcgccttgctgacaggtttggtgtacgccgccgccaccctgatattcggcacgatttccggcgcccagttcaatccggcggtctccgttgcggcgatgctgtccggcaaaacccatgtgcttgacggagtgctctatattatcgttcaggtgctgggtggtatcggcgcaggcgccgccatccgcttcctgctgccgacatccgagcaggtaacgctgaaaatctggctgacgccggtcattaacggttttgacaagaattccgtctcctatgccacgctcggcaactatggcgtgtccttcagcatcactctggccatcgccgttgaactcgtcgcgggcatcatcatcgtcgccaccgcgctcaacaccaccagtgaatccggaaagaccaataccagccatgccatcgccatgggtctcgcctacggtgtcggcgccgcaatctcctatccggtaacaggcgcagctctgaatccggctcgtgccactggcatcgccatcttcgcccagaatcagggcctttcccaagagcctctgcagcagctgtgggtgttctggatctgcccgattctcgcagccgccatcgtctcgcttgtggccatagtcgcgtccatgatcggcaccaagaaaaacgtttcggaagccgagcaggattccgaaacgctggaggccatagccgacgacgcgtcagacgatgccgacgggcacgagggcgagcaggatgaacagtccgacgcccagaccgatgccgatgaaagcgtcgaagccaactgaacggactttccaaggactacgctcgcgcattacgagtctgattagtcctgttatgatggccgtcaccgcgattaccatggtggcggcttttacatggcctaagaccgcaagcactgtggctataaccaccattgccgcaacgatccattcaaaccacggcttgccttcatggtcttcggaaacgtagggatgactcatatcgcaggcctttcgttatatgtcaacgcgcgtccgcgcacggaacccaatcataataataaaacgtggcgtccgaaaccagcgaatggtttcggacgccacgtcatttatcgcgccgcaacgctcccagcttgccggtcgacgcttccactgaactcagtggaagaagtgtcgggtaccggtcacatacatggtgacgccggccttgcgggccgcctcgaacacttcctcatcacgaatggacccaccaggctggacgatggccttgacaccggcgttgatcagaatctcggcaccgtcggcgaacgggaagaacgcgtcggacgcggccaccgctcccttggtgcggttggctccgtcagccagcgtgttggcacgctcgacggacagattggcggaatccacacgattgacctggcccatgccgatgcctacggttgcctgatcgtgggcgataagtatggcgttggatttgacgcaccggatggcacgccatgcgaacaccagatccctgacggtttcagcgtcggccggctcgccggaaaccagcttccacgcgttcggatcgtctcctgaagcgtcaatcagatcggtggactgcacgagcagaccgccgtcaatctgacggaactgggtcttggtcttcggaggctcagacaccttcaggatacgcaggttcttcttcttggtctggagcagttcaagcgcatcggcgtcgtaatcgggcgcgacgatgacttcggtgaagattggacgaacactttcggccatttccatggtgaccttgctgttcgcagcaatcacaccgccataggcgctcatcggatcgcatgcgtgcgccttcttgtgcgcctctgccacggtagcgccgatggccagaccgcatggattgttgtgcttgaccactgcgacggcgatctgaggcgcgaaatcccacacggcacgccatgcggcgtcggcatcgacgtaattgttgtagctcatcggcttaccgccaagctgttcggcgtgtgcgaagccgttctggttgagcggatccagatacagcgaagcctgctggtgagggttctcgccgtaacgcagcacgtgcgcgcggtcccacgtacgggtgaacgtggctgggaacttggcctcattcacttcggtctcgccttcggaaaccggctgttcgatggacgccggcttcggccaatgcttcgcggtccactcgttgatggtggcgtcgtaggcggccgtatgggcgaacgcctttcctgcgagccagcgacgctcatcaagggagaagccctcgccgttctcgatgcgggaggcgacgagtgcataatcgttcggatcggtgatgatggcgacggtggcgctgttcttggctgcgccacgcaccatggacggaccgccgatatcgatcttttcgatggtggcggcttcgtcagctccggagcggaccgtgtcggcgaacggatacagattgacgaccaccagatcgaacggcttgatgccaaacttctcgagctgggaggcatggtcggggttggtcatgtcggcgaggataccggcatggatatgcgggtcaagggtcttgacgcggccatcaaggcattccgggaaaccagtgacttcggagacctcggtcactttgacacccagctcagccagacgcttcgcggtggaaccggtggaaaccacctcggtgcccgccttgatgaacgcttcggcaagcacctcgatgccttccttatggaagactgataccagagcccgtcgtatcggtcgattcgttgttgtcaccctgatcctccttgttattgttgttcgaggcgaccgtgcgaagcgcacgtgtttcctcacggctgttttccgtggattcgggagcggtctccctctttccacgttcgcgtatacgcttcatcatccagcgtatggcgaaaaatatgctcacggccaccaaagtcagcagccatgcggagaacaaacccatggcggtgggttgtcccaccttacgggttgacgcgatcacgtctacgccgacgtgcgcaagatgtttcgatcccaagcctccgtttcccaaggcgaacagcaagctggaagccacggacacgacggcgctggtaatcgaaaaagcagcaatcggataggcaaaactcagcacaacgcgtttgacgtcgatgttccgtcctgattcacctactctgatatggaatcccttattaaacaacatgacgaccatgccggtagcaaaagcggatgccaatggtatgcacatcagcgcgattctcacccaatccgtctcaaccgcctgtggcatcataccgaaaagcggcaaggcggggagcccgtcgccctgcccggtccataatgtgaattcggctaaatcgccgattgagaagccggcgccgaaagtccatgagacagcccaaatcatcagattcggaagccatgcgagcatactgatcgtggtaagaatacgagacccgttctgcatgcccgaaagttcatatagcttcgctatcgatgattgattgcttattgcccaaaaaacaacgacgatcagaccgaccagcagatacgccgcctccagcagcagccctaggacggaaccgatgaccatggtctttcgcaccggcgatgacacatgagatcgaatccattcggtacaggcttgggtccatgacgcattcggaatcgccgcgaccgcatatccgaggatgaaaacaagcgccgttttgatggcgatcatcgtcatcgaatcaacgatttcgatatttatgcttctggcgaagaagatgtttacggcttcccaaaagaccagaccggccgcgaatccacgcagactcgtgccgaatcttctggcgagctgcgcgataagggcgataagcagtaccgtcaagagcaacggcacaatcgtcaacgtgatgacatcagtcttgaacccgataccttggctgagcagcaccaacgcctcggtaagaggcaccgagaaggcggagagattgcccccgccttcttccatggatatgaccagaagcattagggccatatagcagcccaaggcaacggcgtaaataatcatggacgctgccgcgacggcaagccctttcagccaatacttcaggttcgtcatcatagcgattgggaagcgagcacctctcgcatgatttcagcggtctgtccgggagtacgaccgacacggatgccaacggcctcaagggcttctttcttatcctgcgcggtgcccttgccgccggaaacgatggcgccggcatggcccatctgcttgccttccggcgcggtgaatcccgcgatgtaggccacgacgggcttggtcatatgttcggaagcccacttggcagcgtcctgttcggcgctgccaccgatttcgccgatcatgacaacggctttggtggcttcatcgttctcaaaggcttccaaagcctcctgcaaggtcgtgccgacgatcggatcgccgcccgcgccaaggcatgcggtgaaaccgatgtcagacagctcccccatcagctgataggtcaacgttccggacttggacaccaaacccaacgggccgcgggacacgatgccatctggaataatgccgaggttgcagcccttggcgtccttagaagatggcagcgtcaacagaccaggacaattcggcccaacgatgcgcacgcccttacgcaaggccaactcgacgaaatacgcgctgtccgccaccggaatgccttcggtgatgacgacaatcagttcgatgccggcttcaatggcctcaacgacggcgtccttggcgaagcgcggcggcacgaacacgacgcttgctttggctccagtggcttcgatggcttcagagcagttggcgaacacgtgaatggtggcgtcctcgccatttttggcttcagggaaggtgacgtccagcccagccttgcgggcgttcacgccaccgacgatgttggtgccggccttgagcatgcgggccgtgtgggtcataccctgatgcccggtcatgccctggacgatgaccggagcgccatcttcaatgaaaagcgtcatttcagcgaacctccttggccgcgaaacgtgcggcctgctgtgcggcttcctccatggtctgagcgacgtgcaggttggcgcggccggcttgggccaaaatgttcagaccttccgccgccgcattgccatcgaatcgcacgacgataggcttgctgctgccaagttcgtcaagcgcctcgagaatgcccttcgcgacctgttcacacgaggtgatgccaccgtacacattgatgagcacggattcgacctgcgggtcggacagcacgatttcaagactattcgacatcacttcggcggaagcgcctccgccgatgtcgaggaagtttgcgggcttgacattcgtgccctgatcctcgcctgcacctgacaccgcgtcaagagagctcatgacgagtcccgcaccattgccgatcacaccgacggaacccttgagatgcacataatgcagtccatgttcgcgggctttttgctcatatggatcgacatgaatcggatcggtgaaacgtttccaaccatcatggcggaacgatgcattgtcatcaagggagatcttggcgtccagcgcgcacaacgacttggaagattcgtcatccggatcgccgatttttgcaagcgggttgatttccacaagcgtggcgtcgttctccttgaagcaatgccacattttcagcagaatctgcgcggcctgatcaacatcggcatgatagaagccgatgctttcagccatcttggtggccgcttccaaatcgaaatcgtcaagagcatcgatatgcagacgcttcacggattccggatgctctttggcgatttcctcaacctcagtaccgccattcgcagtggcgagcacgtcgaaatcacgagaggatcggtccactgagatggagacgtaatactcgtgaaggatgttcttcgcctcggccaccagcacgccgctgaccttgtgcttgtgaatggtcatcggcagaatgtcttccgacgcgagaatggactcgtcacgggtcttggcgagcttgactccgccggcctggccacggtgtccaatcttcacctgcgccttaatcacattgggatatccaatctggtcggccgcttcggcgacttcatgggagttctgggcgaatattgccttaggagtcgggataccctgttcttcgagcaattccctggcttgatactcatagagatccatggatcattccctttggttgtttgttctgaatggttgacgaaaacggagttatcaggcaggcatgcacaccagcgagcttgtcggataatcgcctagcgatttcatgccgtcaataccggtaagttccatgacgaagctgaatccagcaacgacgcctccgcacttctcgatgaggctacgcgctgcattggcggttccaccggtggcgatcagatcgtcgacgatcaatacgcgcactccctcatggacaacgttggtttcgatttccattgacgcctgaccatattcgaggtcatagctttgcgacatggtttctggaggcaatttgccggctttacggaccgcgataaacccctttccgagacgggcggccaacgctggaccgaacaggaatccacgagcttcaaggccggcgaccatgtcgaaatcatcgacgtctactggcaatgccgcttcaagggcccccatcaaaataccgaacgcgcgcgcatcagccaacaccggcatgaaatcgcggaataggatgccctccttcggaaagcccggaatagtacgtattttcgatacaagatatgctgcgtcttcggctccaactttgttcaagcccgaaacggtgatatccgatgctgccatgacagtggtttccttctaccttggtttacggcactttgaattataggtttcccgtgcgaaaaagaacggcgaaaacctcaaaaatgaaattttcgccgtctaaaaatcaaagaaatcaattgttcttctgctcgtcaatgggctgctgaataacatcggcatcctgtgcgggctcttcagtcgcgtcgacgataggcttctggtcgggctcgtcttccttggatagcggattgccgttctcatcgacctcatcatcatgcacgtatgccggacggacatattcacggctgatggcgttgaagccgaaacgcagttgcgatccttcggaatcaacgacgatctcctcgtattccgtatcgacggaaacgaccttgccgatgatgccaccgatggtgatcacttcagtgccgggctgcagactagaacggaaatcctgacgttcagcttgctgctgcttggctttcttggactgccagaacatcatgccgaacattacaacgataagaacaacgagaaaaaggatatccaaaataaactcctcggagtcagggtctcaaccggaacacattactcaagatgtgaagtctatgacatcttattgacatcatatgcggattcgtcgggagtgataccaagatgctcccatgccttgcgcgtggccacgcggcctttcggcgtgcggatgaggaagccctcacgtaccagatacggttcgcataccgtttccaccgtttccgattcctcgcccaccatggccgccagattgttcaagccgacggggcctccgttgaaattggtgacgatggccttaagcactgctatatccagacggtcaagaccttcggtatcgatctgataaagcgccaacgcctccttgacatcatcgggacgcaccgattcgagatcgtgcacgatggcccaatccctaacacgacgaagcaggcggttggcaattctcggcgtaccgcgggaacgcatggccagttggcgagcggccccgtcctccaactggattcccaacactgcggaggaacgctcaatcagcttttcaagctcctcatgcgggtagaaatccagatgcgccgtgaaaccgaaccgcgcacgcagcggcgagggaagcatgccctctcgcgtggtggcaccgataaccgtaaaccgaggcaatgtcagcggaatggatgaagctccagggcctttgccgaccatcacatcaacacggaaatcctccatggcgatgtacagcagttcctcggcggcacggggcagacggtggatctcatcgataaagagcacctcgccggcgtccagcgaactcagaatcgaagccaaatcaccagcatgttggatggcgggaccggaagtgacgcggattggaacttccaattcattggccacaatcatggccaaagtggttttgccaagtcccggaggccccgcaagcaggatatggtccggaggaacgtcacgttttcgagcagcatcgaggaaaagctgcaactgcgctttgagtcttggctgtccgatgaatcccttgaggatatgaggacgaagctcctcgtcgctgaccggttcgttgccgacgggtgcggcggaaaccatacggagggattcctcattcgccccggtgttcggctgttcgaatgtatcagtgttcgtcataatggtccgtttcatctacctctatccaacgatgtcagcgcgagcttcagcacgcgtggaacatcctcggcgttcaacggcgtctcgatttgattatcggcgcagaccgtctgcaccgcatggacagcgtcctgctggtgccatcccaaagacatcagaccttcgacgacctgttcggccccagtgtcttcaggagtcgaagcggttgcggaagaaccctcgatctggctcagatcaatggaacctttcagttcgaggatgattttctgcgcgcctttcttgcctaatcccggagccttggccaacgcagtggcatcaccatccgccacagccctcgcaagtcgatcgggaggcaaagtggacagcaacgatagcgcgactttcggtccgatgccactgaccttctgcaattgcaggaacatgcgtttcgaggccagcgtgccgaagccgaataaagtgatggcgtcctgggacacattcaacgaagtgtagaccttgatttcctggccggcgtgcatggaagccaagtcggcggatggcatcctgacctcgtagccgactcccccgacctcgataatggccgatacggcgtctaccgactccacatggccacgtagcatgccaatcattatggacgtctccttcgcacaggtctagaacatctgttcgatacagcttacatgcctctgcggacgccttgtctgcgcgctgctttttgcgaagcctgcgcccactgtcgttgcgccgccgtgagatgctgttcgcgttcgccgccttgcagcgcaccagccggacgcaacgcgtgacagatcgcaatagccagcgcgtcagccgcatcagccggctttggcagcgtgttcaagcccaatatccgcgccaccatacgttccatctggattttctctgctttgccgttgccggtgattgcaagctttgattccgtcggcgtatgcaacgctacaggaatgccgcgttgcgccgcagcgagcatcgccaaccctgccgcctgtgcggttcccagcaccgtgttacggttttcttgcgcaaacactcgttcgatggacaccgcatcgggagtaaatcgttcgattttttccaccaagccgttgtagatggccagcagacgcagatcctgggaggtttttggatcggaacgcaccacatccacgtggataaaagaaagccggcggtatgcgccggcttcaatcacgccgaccccgcagcgagtcagcccggggtcgacgccaagaataatcacgctggattactcctcgtcaagctgggccatgacctcgtcggaggcggtccagttggagtagatgttctggacatcgtccagatcatcgaggttgtcgatgagcttggagaccttctgggcatcctcaaggctcagctcgacctcgttcttcggcatcatgaccagatcagcggaatcgtaatcgaaaccggcgtcctggagagccttgcgcacgtcgatcatgtcggacggatcggtgatgacggtgaatacctcaccatcgtcggtcacgtcttcggcaccggcttcggcggccttctcgaacaggttgtcgaagtcaacgccttcggccggaacaacgatctgtcccttgcgttcgaagttgaagctcacggaaccagtggtggccagggagccattgcccttggtcagggtggaacgcacgtcggcggccgcacggttgcggttgtcggtgaggcattcgatgatcaggccaacacctgccggggcgtaaccctcgtacacgatgtcttcatagttggcgccgccggcttcctcaccggaaccacgcttgacggcgcgcttgatgttgtcggccggcatggaggccttcttggccttgtagatggcgtcatacagggacgggttgccgtcgggatcgccgccacccatacgtgctgcgatctcgatgttcttgatcagcttggcgaacagcttgccgcgcttcgcgtcgatggcggccttcttgtgcttggtggtcgcccacttggaatgacctgacataatgctcctaggcaggttgcggatgtttcaaacgaaatgattctaaagcggttcgccgacaaaatgccgaatacgaacctgtggcatttcgcttttcgaacttttggatggggtctgcccccggctgtgactaccgccgatatgttttctcccctatgaccatttggcgcttggcttcgaagatgcgttggaatacggtgactaatcccaatccggccaacagtatcatggcgatggcgagccacaatccctgacgcgtcaatccggtgatggccatgcccaccagaatgatggtcaagcgatcggcacgagtggcgatgccgtttttcacctcatagccgactgattcggcacgagcacgggcatatgaagtgacgaacgatgtcatcacggccaccgcggcggcggcgataccgatcatgctcgtatagtcaggcgtgttgtcgatggccgtatgccaccagtcacgatgcataagaaagaagatgatcacgcctacgagcatcgcccaatcagcgatgcgatcgagcgtggagtcgagaaaagccccgaattcggtcccacccgtggtaagcgcggcgatcgagccatccaacgaatcggcaagcacaagcagagtcagaacaaccgctcccccaaatagccatccggtcacaccggtggcgatggccacgacgatggtgccgacagcaccaatcaccgtcaccgcattggcggtcagtcctatggcgatcaacgctttggctattggctcgatgagttttttgaacggcgcacgaagatgctcaagcatgtgttacttccttctcgatgagaaaatgagaaacggcgcacaaacctcttgtcgagattcgtgcgccgtttcacggttcatggtcgcgtgcgacttgttgccaccggtctcgctcagtcggcgagggcggccttgaagtcgtctgcggtgttgacctggacgcgcttcttgattacggtcagaatgttcgccttcgcctcatcgaccggcacgccgttcaactggctgccgtcgcggaagcggaagctgaccgcgttgttgttcatatcctcttcgccgacgatgaggatgaacggcgccttggacttggatgcgttgcggatcttcttgccgaagcgatcgtcggacaggtcgatctcgcaacggacggtctcctcttccaagctggcgatgaacttctgcaggtgcggggcgaactcgtccgcgaccggcacgccaagcacctggaccggggcgagccacgccgggaaggcgcccgcgtaatgctcaagcagcaccgcgaagaagcgttcgatggagccgaacagcgcgcggtggatcatcaccggacgctggtgcgtgccatcggcggcgatgtattcgagcttgaaacgttccggaaggttgaagtcgagctggatggtggacacctgccaggtacgtccgatggcgtcacgggcctgcacggagatcttcggaccgtagaaggctgcgccgcacggatcgtcgaccaagtccaaaccggattccttggcgacctcggccagcgtgttggtggcttcctcccaaatctcgtcggaaccgacgtacttgtgcggatccttggtggacagctccagatagaagtcatccagaccgaagtccttcaacaggccgagcacgaaggtaagcaggctcttaagctcgtccttcatctgctcgcgggtgcagtagatgtgggaatcatcctgagtcaagccgcgcacgcgggtcaggccatgcacttcgccggacttctcataacggtacacggtgccgaattcgaacaggcgcagcggcagctcacggtaggaacgctggcgggacttgaagatcaggttgtgcatcgggcagttcatcggcttcaggtagtaatcgaagccttgcttgatgacgttgccgttctcgtccttctcctcgtccagacgcatcggcggatacatgctgtccttgtaccactgcaggtggccggaggtctcatacaggccgcccttggtgatgtgcggggtttgcacgaagctgtagtggtgcttgcggtgcatctcacgggagtagtcctccatggcgttgatgacggccgcgcccttcggatggaagacggcaaggcccggaccgatctcatccgggaaggagaacaggtccatttccgcgccgagcttgcggtggtcgcgcttggcggcctcctccagacgggtctggtatgccttcaggtcctccttggtggcgaaggcggcgccgtaaatgcgctgcagcatcggattggcctcgctgccgcgccagtatgcggcggcggaacgctcgatcttgaacgccttgatgtaacgggtgttcggcaggtgcggaccacggcacaggtccttccaaaccacattgccttcacggtcgacgttatcgtagaagctcagttccttgccgctgatttcggtggcggcttccgggtcaagatgcgcttccttatccttgataagttcaagcttgtagggctggtcggcttcctcggcaagagcctcttcctcggtcaccacgcggcggcggaaggactgggaggacttgataatgcgctgcatgcgcttttcgatttccttgaggtcctccggagtgaaaggagtctcgacatcgaaatcgtagtagaagccgtctttgatgaccggtccaacaccaagcttggcgtcagggcgaatctcctgcacggcctgggccatgacatgggttgcggaatggcgcatgatggccacaccgtcctcgctatcgagcgcgatgggttccacaacgtcgccgtcgtgcagctcggtatagagatcgcggggttcgccgttcaaacgcaccgcgatgatgttcttgtcgtcggagaagagctggacgccggtctggtctgccgccacctccttcttttcgccgttgagtgtgatggagatggtctgttcagccatgagttgtcctttgctatcggggtccgcgttaccaatgtgcaggcctggactatatatcaacgatgaacaagatagggtcaagcgcagacaacggcacgccatttcggtgaacggaagaacaacgctgattgaatgtcgcgaaaggaaaggtcctttactgtttactgtccgatgacgtgcgcatatgtatactgcggagcctgacgtgtggacttgatcatcactttgtcagaggggctgaccgataccgtagcgccatacttcactttgagccgcgacccgacgccaccggccagattaaccgcgttctgcagattgtcgctgtcgccgatcgcgcgaatggtgaatggggatttcagtttggtgccatcgcagacgagactgccggccgtgccactgatgtaagtgctggttaccacgcggacattgttgatctcaatgacctcggcaccactgttgcgcaattcctcaagcaacgtgaacaatatcgcggagtcaatcttctgtttggaaccctgcgatatgcggatgaccacgccttctcccgtagccgcgagacggccggataggatgccgttggtctgcgcgttctgcttggcgatttccgcggctttctcatttttgtccgcggtgtctttcaaagcgttcagctggctggagagttcgttcttacgctgttcgagcttttggacctgagcattggtctcgctgatgagcttggtcaattcatcttcgctcatcgtctcataggtggatgtcgtgttgtttatctggatcacatagccgaagccaagcaaggcgcacaatatcgtgaccagaatgctggaatacagtcgggttcgtgtgaccttcgcatcaagtgagattcgcttcttggccttgaccatggggaacgcaccggtttgggtgctgtcattgttctggtccttgaccctctgctcatggattctggacagcatgtccttgctgttcgcgtcttgtccgctcataccgcatcaacctttaaagatgaagcgtcgaatggaggacacattggtaaagattcgtatgccgagcactacgatcactgcggtctgcagctgggagccgactcccaactggttgccgaggaacaccagcagcgttgcggtgatgacattcgagaagaaggagatcacgaacactttatcggaaaagctgcgttggaaatacgcgcgtgcggcgcctagcaacgcatccaacgcggccaataccataatcggcagatacggttggagctcgatggggatgtccggacgaacgaatacaccgattaccacgccgatgataagtcccaagacagctgccattacttgtccttcctcacatgcgtcgtgtcgccagccactgcagcatcaagtgtaatcgatttgcttttgcttatctgcggatagatgccggcctttttgaaatcgtcatacagttgtttctgcgttgtcttgcttaccgatttcgccaaggtcgcctgattgcctatcgcctcgattcgatatgggctttgcaccgaattgactccgatgagaatcgtcgatccggcggttcgaatcgaggtttgcacgccaaggcggttgccgttgatcgcgatcgcctccgctccggattgccatagcaaggagacaagcagctgcaaatcggaatcggtgacgactcgaacctggctgccattttctcttggcagtgaggagtcggcattgtcgccgctgacggaaagcgggttggctacggtcaggacaatgccttccccttgcaccggaagcgttccattgaccatttcatcatcctgcatcgtctggtttagggaccagcttgccaaggattccgattcagattcgatttgcgaccgcaagtcgttgacatccttggtgaggtcgccgacccgcttcgtttgttcggtcagctggcttgccaactgcttgcgtacttctttgcgtgggtcagtgctcagctggcgcacgaaaacgcttcccgcggcacccacagcgatgcagatgaggaacaccagaatcctggtggcccaaatcgaaaccgccgaacgttttttagtggccaggcgggagtccgaatacaggacgtccatcggacgattggtcaaatcgtcaataagccgaagcgaatcgtcatcgacatgtctatggcgttgcggcatggcgggcatggaggccggttgcacatgatgggatgacaggccggcgaaggatgacgaaaaaatggcacgatgctttgtgggtacgttctccggggaaacggggaacgacgcgaaacgtggagcatcggacttcatatatgcgtcaatccttgctgtttgtatcgttcttcaacagttggatgccttggcgcatgtagatgtaccctgcaagccaatacagtccaacgccccagattccggtggcaagaccgcatagatgcagtgtatccgcagcggagttggaccagatgtcggcgaagatcaacgcgacgatggcgataagcagcatcgcggtaccggccttgcctacgaaatgaacaggcaatgggccataatcgtgctgcgccaaaaccagtatcagaacagccatgatcaaatctcgcagaccgacgacgatcagcatccaccatggaatgatgttcgccacacccaaagcaagaatgctgcagaagatcagcagacgatcggcaatcggatcgagaatttgcccgattttgctcacctgattgaatgatctggcgatcagtccgtccaaaccatcggatatcgccgatagcgcaagcacgaccaaggcggtcaccatcctgtgatgagagaccagcatcgcgataaaaggaatcgaaatgattctcagcaggctgatgaagttcggaaccgtgaaatagatgtctcgcggttccggactgtattgcttcttaataatcagtttgctcatattacgagctacactacattctcgaagcctgcaacgcggtgactattatgccacgggcaccaacttcatacaactggtccataagctggttcaccttcgccttcggaaccaccacacgcacagccgcccactgcttatcatgcagaggcgaaatcgtcgggctttcgaaacccggagtgatatccactgcggcggacaccttctcgaccggaatgtcgtagtccataagcacattacgctgggcagtgagcacgccttgcagacgcctgctcagaatcgtcagacgctcgtcatccgcctcaagacgaggggaacgaatcaatacggcttcagagtgcatcagcggttcagcgaaaatgcgcagtcccgcattacgcagagtggtccctgtggaaaccacatcggcgatcagatcggcgacgccaagctggacggacgattcgacggcgccgtcaaggtgcacggtttccgcgttgatgccatgctcgaccagatagtcgtgtacgagcttgtcgaatgtggtggcgactcgcttgccttcaatatcctcaagcttggtaatcggcgaatcgttcggggctgcgaaacggaacgtggaggctccgaagccaagctgcatatgctcctccgcatcggtgccggagttcacgagcaaatcatgcccggtgattccaacgtcgatggtgccgcgaccgacatagaccgcaatgtcgaggggacgcaggtagaacaactcaacatcattgtcgggatcctccacgaccaactggcgagggttgctcctcaaacggtagccggcttccgccagcatgttccaggcgggttcggacagcatgcccttattaggcacagcgattcttagcatgtttctcctctaaaaaaggccacaccttcaactggcatggccccgggtttctcacaggttcttgtagatgtcctcgagtgtgatgccacgatcgatcatcatgacctgcagatggtagatgagctggctcatttcttcggccgtacgatcagcaccctcatattcggcggcgatccaggtctctccagcctcttcgacaatcttcttgccgatgaagtgcgtgcctttggcaagctcatcgacggtcagggaaccggcctgcttggtggcggctttctcgctcaattccgcgaacagcgattcaaaagtcttcatagtcgtatgcttccttgtatggtgggcgttcacgccttgaaggctgcttcggccttctcgcggatggagtcgatagcctcggccggattctcggcaccgtacacggcggaaccggcgaccagcacatcggcaccggcttcggcaacgatatgggcggtcttggggctcacgccaccatcgacctggatcttcgtcttcaggccacggcgggtgatttcgtcacgcagacgacggaccttggccatctggttgtcaaggaacttctgaccgccgaagcccggttcgaccgtcatgataagcaccatgtcgaattcgtcaaggatgtcgaagatcggctcgaccggttcggccggacggaccgcgaagcatgccttgcagcccatgtcgcgcagctgacgcgcaagacgaaccggagcatgcgtcgctcccatatggaagctgacggaagccgcaccaagcttggcgtattccggagcccaacggtccggatcctcgatcatcagatgcacgtcgaccggaaggtcagtgacttggcagatgcgagccacaatcggctcacccaacgtcagattcggaacgaaatgatggtccatcacgtccacgtgaacgagatcggcgttggaaatggccttaaggtcacgttccagattgcagaagtcagcggacaggatgctaggtgcgatttgaatagtcatggttctcattctatggaaggtaatcgacttgatgttacttgttgtcggactggtcatcggcatatgagacggatgagccatcgtttgccgtgatttcatccttggttttcgtaaggttggccttcgcggtcgggagaccggtttctccatcctcgacgaggcttagctcaatctcggtgacggtgcgcaacttctcggcaagcagctcggtggactttcccatctgctgaataacgatgaaagccaccacgccaagcacgaacaccgccatggacacccatacgttgatgcgcacgccaaggaactcgtgcgcgaaatcaatgcgcagagcctcgatccaagtgcgtcccgccgtgtaccacatgatgtatatggcgaacaaggacccggccttgagttttttcatgattttggaaccaaggaaaacgatgagcgcagcaccgatgagattccaaatcatctcatacaggaaggtggggtggaacagcgtgcctgtcgggcaggtcgctccgtcatagcattgttcgctgtgaccgatggcgcttccctccatattcaacttcaaaccccaaggcaaggtcgtcggcgcgccgtagagctcttggttgaaccagttgcccagacgtcccacggcctgcgccacgagcaatcctggcgcgacggcgtcaccgagcagagccattggataatgcttgtgacgacaccatgcccaagcggcaagcgctccaagcaggacgccgccccagatgcccagtccgccattccagatgcggaacatctccacccaatcgccggtcggtccgaagaaacgttccggagtggtgatgatgtggtatatacgcgcaccgatgatgccgctcggcaccgcgacaagcgtgatgtcgagaatctgatcgaaattaccgccatatcgtttccaatgaacggttgtcatccataccgccagcacgatgccgagcagaatgcacagcgcgtagaaatggatggtcaccggcccgatggaaaactgcgaaatggtgggtgacggaatgtaagcaagtgtcatagtttcctgatggtagtccacgtatacgatatggtacgtggactaccagtatgttgtctttggactggttcagttgcgggcgttgtggatgccttcggcaagctcctcagtcttctccgccaaggccttgagaccggtggcttcgtcgactgcatgcttgccggattcgtcaagcatggtatgcaccagagccgagcctacgatgacaccgtccgcatacgatccgacacgagccccctgttccgcggtagacacgccgatgcctacgcacacgtttttcgcaccggccttgcgggtacgggcgaccagttccttcggggacgcatcgatggtggagcgttctccggtgacgcccatgcgggcggcagcatagacgaaaccccgcgcattgtccgcaacgactttcagacggtcttcggtggaatccggagataccaggaagatgcggtcgagtccgtgacggtcggaggcttcgatccactcgccggcctcgtccggaatgagatccggggtgatgagaccggctccaccggcgttttcgaaatcacgtgcgaatcgttcgacgccgtaatggaagatgaggttccaatagctcatgaccaatggcactcccccggcgttcgccactgtttccaccgctttgaatacgttggcgattttttcaccattgtcgatggcgatttgcgatgccgcctggatgacgggaccgtccatgacggggtcggaatacggcagcccgatttcgaccgcgttcacgccgtgttcgaccatggtgcggaaagctttgagcgaataatccggatcagggaatccgtatggcagatatccgatgaatgccggcttgtcggcggctttgaattcatcgaacatggtttccgtcgggcttggcttgtggctgatgccgagtggctggccggacggcgtggatgatgttgcgttcgtcatgatggttgctccttttctcactcgccgtccgcgttgttgccttgcgcgccgttggcttccaaggctttggcctgctcgtcggtcaggtatccgaaccatttgccggcggtgttcatgtccttgtctccacggccagagatgttgatgatcatgaccggatgctcataccctttggccttgaggtctgcagctgccttgtacgcgccggccactgcgtgggagctttcgatggcagggatgatgccttcggtttcgcacagatccttgaacgcgctcatggcttcctgatcagtggcccaggaatagttgacgcggccgatatccttgagccatgcatgttcggggccgacggaggcgtaatccaagcctgcggagatggagtacgtgtcaagggtctggccttcggggttttccaacagatagctcttggctccttggaacatgcccagttcaccggtacctggcgcgaatcgaatggcatggcgaccggattcgggcccgttaccgccggcctcgtaaccgtacaggtttactcgttcgtcatcgaggaaggcgttcatgatgccgatggcgttggaaccgccgccgacgcatgcgcagatagcatcgggatggtcgatgccataccaatcctgcagctgctgtttcgcttcctctccgatgatcttttggaagtcgcgcaccatggatgggaacggatgaggccctgcgaccgtgccgagcagataatgggtgtctttgacgttggtgacccagtcgcgcagcgcctcgttgatggcgtccttgaggatgcgatcacccaaggtgacttcgacgacctccgcgccaagcatgcgcatgcgggcaacgttcagcgcctgacggcgggcatcgatctgtcccatgtagatgcggcacttgagtcccagcatggcacagaccgtggcagtggccacaccatgctggcctgcaccggtttcggcgatcacacgggttttgcccatgcgcttgaccagtagggcctgtccaagcgcgttgttgatcttgtgggcgccggtgtggttcaggtcttcacgcttgaggaacacacgggcatcaagaccggttttctcctcgagcctctgcgcgaaacgaggcgcttcagtcaatggggacggacgtccaacatactgctggttcaaccgcgccaattccttatggaattcaggatcggccttggcttccgtatacacgcgttcaagctcgtcgagcgccgtgatcagcgcttccggaacatagcgtccgccaaactgtccgaaatatggtccttcatggcttgccaacggggtctgttcggatgccttcactcttgctcctgcctttactaatcgttccactgcctgctcatggttggccgcggtggccacgccttctcccaccagcaccacatccgcgccggcacgggcgtaatcctcaagctcaaccgaaccgaacacaccggattccgccacgcgaatcacatcgtccggcaaatccgcggccagttcgttgtacttgttcacatccaccttgaggtctttaagattgcgggcgttgatgccaatgaccttggccccggcattgatggcccgttgaatctcctcacgggtgtgtgtttccaccagcaccgtcatattgaggctatgcgcgagatcgagcagcgacttgagcttgacgtcgtccaatgcggcgacgatgagcagcaccagatcggcaccatgcgcacgtgcttcccaaatctgatattcggtaacgatgaaatccttgcgtagcacgggaatcctcactgcggcgcgcaccttgtcgaaatcttcaagagagccaaggaaccaacggccttcagtcaacacggaaatcgcgcttgcacctccctgctcgtattcgcgggccaaagcggccggatccggaatatcgctcaaatggcctttggatggggaggcacgcttgatctcggcgatgaccggaatgccatccgcctttttcagccactgacgcgcatcgattggcgctgaagcctcgaacgccatccgcttgacctcagcgagcggcacgttgttttctcttgatcgctgatcctcgacggctcccgccaccaattcatcgagcacagacattactgcttcctttcacaacacaattgaacggtcagaatgtgactcacaactggcgaagctgcgcggcgatctgtaccgcttcaacgctggcttcggccttgttgcgagtctcctgccactcactggccggcacggaatcgaggacgattccagctccggcctgcacgctcgcttcatggtcgcgaatgaatgcagttcgaatggcgatggccatatcgaggttgcctgaaaaatcaaaataaccgacggtgccgccgtaaataccacggtcggccggctcaagttcatcgataatctcgatggcgcgcggcttcggcgctccggacagcgtccccgcggggaaggcggaagtgaacacgtcgaacgccgtcatatgcggatcgacctgcccggtaacggttgagcagatgtgcatgatatggctgaaccgtttgatgtccatcaaggaaacgacttcgacgctttccggacggcacacgcggctcagatcgttgcgggccagatcgaccagcatgatatgctcgctgcgttccttcgggtctgccaatagttccttggcgagacgttcatcttcctcaggagtggcgcctcgtggtctggaaccggcaattgggaaagacatggcatggccgttgtccaccttgatcagtgtttccgggctggaaccgatgacgttgaaatcacgtccttgagcatcggtgagtgccatgaaatacatgtacgggctcggattgagggtacgcagcacacgatacacatcaaacggatcggcgggagaatcaatatccagtcgctgcgaaatgaccacttggaacacatcgccatcgatgatatggcgtttggcctcttcaacggaacgttcgtaatcgcttttctccgtgcggaatcgcagttggggctggccgaccgactcgtcgagcacattgacccgggcttcgttttcgacgggtgcggcagccttgcgctgcatatcatccagacgtgccagcgcttcatcgtaggcggcatcggcacgagtcggacggtcatcgacattcacggcattggcaatcagccataccgagccagacacgtggtcgactactgcgatgtccgtggcgagagccagaacggtttccggctgtccggtctcattcggggcttcggcacggagcgtcggttcccaatgtcggatggaatcccatccgacagtaccaacgaggccactggtcagattcggcaatccctcgacgtgcggagccttcaatgtcttcagcgcggcatgtgccacttcgacaacatcaccgtcggtgggcactccgacaggcacctgtcccagccaatcggctttgccgttgttcgaacgcagctgcgccatggaattcacgccgatgaagctgtatctactccacgctccgccaaattcagccgattcgaggatgaacgtaccggaacggcctcctgcgagacgctcgtagaagccgactggggtcaatgaatcagccagcaaacgacgtacgatggggatgacacggtagccttggtcggccaattcatggaactgctcacggcttggccatgtagcaccccacttgagggtctgtacgctgcattcgctcaccgctgaccctcctgttctttggttcgatggcccacgaccacaggcagctgtccgccttcttcaaagcaggaacgtttgccggtatggcaagccgctcccacttggtcaacttctaccagaatggcatctccatcgcaatccagcgcgaaggacttcacatactgggcatgtcccgacgtatcgcccttacgccaatactcctgcctggacctcgaccagaatgtgacgcgtccggtggtgagggtacgtctgatggcttcgtcgttcatatagccgaccatcagtacctctttggtatcgaactgctggatgacggccgcgaccaagcctttgtcatcgtgcttgagacgctgtgcgatgcgcgggtcgagagtggtggtgttgtcgtatgcttcgttggtcatgatggtattgcgattcgttgttcagtactacagggttggtttgcgtagtttccgtggttctattcagcgtacggtgtatccggctgccttgatggcgtctttgacttcaccgatggtgactttgccgtaatggaaaatcgaggcagcgagcacggcatcggcgcccgcctcgattgccggcggaaaatccgaggctttgccggcgccgccagaagcgataatcgggattttgacttccttgcggacagctttgatcatctccagatcgaagccttgttgggtgccatcggcatccattgaattaaggagaatctcccccgcaccaagttcttgggcgcgcttgacccaccaaatggcgtcaatgccagtggatttgcgcccgcccatggtggtgacttcgaaacctgactgcgtatgtcgttctccctgttcgcgacgtgcatcgacggacagcacaagcacctgattgccgaatcgttcggcgacacgactgatgagggtagggtcattgatggccgcggtgttgacgccgaccttatccgcaccgcaacgaagcagggaatcgacgtcttcaggggtacgtacgccgccgccgacagtcagtggaataaaaatctgttcggcggtgcggctcaccacatcgaccatggtctgcctatgggagcttgacgccgtcacatcaaggaacgtcagttcgtccgcgccctggcggtagtattccgcggcgagttcgaccgggtctcctgcatcgcgaagattctcgaaatgcacgcctttgaccactcgtcccgcatcgacatcaagacatggaatgactcggaccgccagtgacatgctgctctactccttcacgcataacggttgcaatgattgcaagagtaaccgcaatacgttacgtcggttcatgcggattccgagtagcggacagaaccgggcctttcggaggaatcagtcacgttctttggctgcaagctgtccgcatgcgccatcaatgtcctgtcctctggtatcacgcagcgtggctgtgatgccagcgttatggagaatctcaaggaatctacgctcgtcttctggtttggacgcggtccacttcgatccctcgatcggattgagcggaatcggattgacatgcgcccaatcatctccatagtggttcagacgcttcgccagcaatttggcatgttccgcctggtcgttgatgccgcgcatcaaggcgtattcgatgctgactcgccgtttggaagccagataataatcatgcgcagcgtcgagcacctgtttggtgttgaaacgcttgttcatgggcacaagttcatcgcgcaattcatcgctcggcgcgtgcagggatactgcgagacgtactgggatgccttcttcggccagtttcctgatgccaggcaccacgccaacggtggaaaccgtgatgttacgtgcggagatgccgaagccttcgggaggcatggaactaatttggcggactgcactcaagacggatttatagttgcccattggttcgcccatgcccatgaacacgatgttgctcagtcgtccggagcctccggccacttcaccgtcacgcatggccttcgcggccacacgaacctgctcaacgatttcacctgcggacatgttcctggtcagtcccagttgtccagtggcgcagaatgggcaacccatgccgcagccgacctggctggaaatgcaaagcgtggttctggtgggataacgcatcaatacggattcgatcagcgacccatcaaacaggcgccacaacgttttgatggtggtgcctccatcggcgacttggcgtgtcacctcatggatgagttccgggaagaaagcttcagccgcgtcggagcgtcttgccgccggaaaatcggaaaattcttccgcattgacatcgaaatggccatagtaatgattagccagctgtttgaccctgaatttcggcaatccaagttccttggccttaccgatacgttcctcttcggacatatcggcgaaatgcagtggcggcttgccacggcgggcatggtctttcgacagcacatcccggaaggcgcccgaagtgcctccaggagtgatgcctgtttccggctgatcattcatggaattcacggttattggccctttctcacattccggtggcccacaggagcacgcacacgaaaggagcgcacaggaggatggagtcgacacgatccatcactccgccatgacctttaagcagatggcccatatccttaataccaatgtcacgcttcagcatggaagcgcataggtcgccgaaggttccggctataccgatcatgaaaccagcgacaataggcacccaccatcgaaccgtccaaacggatggctcgtaagtgcaaaacatcaccacaaaagaaccggccatggcgaacaagatggatcctgccaggccctcccatgatttcttcggtgagatacggggactgagtttatgtttgccaagccatgcacctgcaaacagaccaccggtgtcactcagcgcgggcatgaagacaagcatgatggcatgtgccaccggatgaccgttgaacgtcaacggcatgatcaggcaggaggcaagcagcggaatgtacagaacggtgaacatggagactgccacatggctcagtcggctgtggcgcacttcaccctgttcatgattgaacgacgattcgagacgagcacctgcatcggtgtgcgacagtttgtccgccacggccagggaaagccgactgccgaacgtcaccttggcacttgcggcgatcgctacaagcagcaaggaggccagtacacagaccgtcatagccacaatatgatgcttgctgtagtaggtggccagcaaagtcaccgcggaacatgcccacagcaccaccacgggaatatgcaatcccgcggtggcgaaatcgacgcgcagctcccacaatgcgagcaccatgaacagcacgacaagatagacgaacaaatcaacgctgatcaacaggcatgccaagatgatggcgatcaggacgaccgccgtggcgatggcctgcggcatgttgcgtccggttttcttgttgatggcgttaatggcctcttcggcttctttttcgcgttgctcctgtttttccatcgtggtctctcctgtggtaccgtgcgtcgattgatgattatggagattcgaaggaatcagacctccatgatctccttctgcttggtttccagcagagcgtcaagctcgtcggtggtctgcttggtgaccttgtcgagttccttgagcagacgatcgccttcgtcctcgcccatgtcaccatctttgatggccttgtcaagggattccttggccttgcgacgaatgttgcgcaccgcgaccttgccgtcttcagccttgcccttggcaatcttgacgtattccttgcgacgctcttcggtcagctccggcatggtcaggcgaatgacgttgccgtcgcgacgggggctggctccgagatcggaatcacgaagcgccttctccacggcgttggcctgggacgcatcgaaaggagtgaccgccaaggtgcgcggctccggaacaccgatggtggcaacggccttcagcggggtcggtgcgccgtaatagtcaacggtgatgccgttaagcagcgccggattcgcacgaccggtgcgaataccggaaaagttctccttggtggattccacggacttggccatctgcgccttggcctgatcgacgatagttgccattgtttgctcctttaatattgttggtttaatcgatattcggctttgaatgtcgtcactcggcgagggtggattccgcggtggaaaccatggtgccgatctcctcgcccagcaaagcctgggtcacattgccggcgccctcgagtccgaagacgcggatgcgctgcttgttgtcccgcgccatggaaagcgccgcagcatccatgaccgcaagattgtcgaccaatgcacggttatagctcaacgtggcgaaacgcttggcgttctcgtctttgcgcggatcggcagtgtatacgccgtccacgccgttcttgcccatcagcacctcatcgcagtggatttccagagaacgctggatggacacggtgtcagtggagaaatacggcatgcctgctccggcgccgaaaatcaccacgcgtcccttttccagatgacgaatggccttaagcggaatgtacggctcggcgacctgtcccatggtgatggcggtttgcacgcgcgtggcctgtccctcctgctcgaggaaatcctgcagagcgaggcagttcatcaccgttcccagcatgcccatatagtcgccgcgggaacgatcgatgccggcctgctgcagttcggcgccacggaagaagttgccgccaccaacaacgatggcgacctgcacaccttgcttgaccgcgggaacgatttcctccgcaatacgacgaacgacggtggtgtcgatgccgactttgcctccgccgaatgcctctccggacagcttgagcagtaccctgcggggattgtcgccagtgttttcgccagtcatgaaatgcctttcttacccgaaaacccatgaaatttaccgttttcaagactatcggcaaacacagacaccaaaacacgatggggtttagtgcaaaaaaatgtccgcaatcctgttggattgcggacattggagatatgccaagcccacgttcgaaagcgtgagctcaattcacatcagattcactcggcgtcgcccttgccgacctccacacgagcgaaggaaagcgcggttcccccgacttccttgaacaggtcgccgacggtcttggacggatccttgacgtacgcctgctcaagcagcacggtctccttgtagaatgcgccgagacggccttccacgatcttcggagcgatcttctcgatcacggcctccggcttgcccttgctcttgagctcctccgtggtcttctcggtggccacgcgacgctcggattccagcacatcagccggaacatcctcgcgggtcagccactgggcgcccatcgcggaaatctgcagagcggcctcatgagccacagcagcgccggcttcatcggtggcaatcatggccacgatgctcggcggcatctcagcggacttcttgtgggcgtagacctcgacatgcgggccctcgaccttggcgaactggcctaccttgacgtgctcaccgaacagagcagcggcttcctcgacggcttccttcacggtggtgtcaccggaggctgctgccagaacctcatccacggaggatgcttcggccttgacggcgtcatcgagcacgctgccggcgaattccacgaacttcggggtcttggccacgaagtcggtctcggagttcagctcgaccgcatagccggtctggccgttggcggattcgacaacggtggaggcgatggtgccttcctgagccttgcggccttcacgcttgccagcggcctggatgcccttggcgcggatgatttccttggcgcgagccacatcgccttcggcttcggtcagggccttcttgacgtccatcatgccggcgccggtttcctcgcgcacctgcttgatcagagctgcagtgattgctgccattgatttgtctcctctgaaaatttggtgatgccccgatgatgggaggcatagcacctcccatcatagagcatggtctcactcggccttggtttcgccttcagcctcagccggggcttcagctgccggagcgccctcggtgaggagctccttttcccaagcagccatcggctgctcggcttcgccttcggccttggcggccttgccggaacgctccagcagaccttcggccactgcgtcagccatgaggctggtcagcagttcgatgccgcggatggcgtcatcgttggcggcgatcggatactcaacggattccggatcggcgttggtgtcgacgatggcgacaaccggaatgcccagcttgtgggcttcctcgacggccagagcttccttgttcacatcgaccacgaacatggcggacggggtgcggttcatgttgcggataccgcccagctgcttagccagcttgtccttctcacgctcgaggagcagcagctccttcttggtcagaccggagccgtgcacgtcggtgaagtccatttcctcaagttccttgaggcgggagacgcgcttggacacggtctggaagttggtcagcatgccgccgagccaacgctcggagacatacggcatgttcacgcgggtggcctgagcggaaacagcttcctgagcctgcttcttggtgccgacgaacagcacggtgccgttgtgggcaacagtggccttgatgaagtcgtaggccttgtcgatcatgtcgagcgacttgaacaggttgatgatgtggatgccgttgcgctgggtgaggatgaactgcttcatcttcgggttccaacgacgggtctggtggccgaagtgcaggcctgccttcagcatgtcgctcatagtgatctgagccatggtattgctacctctttctttgtcggttcttgcctggtcatgcgttcctgcgtgcagccaatgccttgcaggcatcagccgaccgacacaggtcgtcgcgagcatgacgcgaattggttgcgcaccggttgacaataattgggcggtttgaagcactcgcggcagcgcttctcaccaaattggcgcacaaatattaaaaataccatggggccacgtctttctgacgtggccccatggttgaatcgtcgttcgctgtttcgatcacttgcgatgggtgcgcatgtaacgcatcgcctcgcggcgttcttccttttccagacgatcaagatagacgtgaccgtccaaatgatcagtctcgtgctgcagcatgcggcccatgatgccatggccttccaacactaccggcttgccgtccagatcaatgccccgcacgcgagcataatcggcgcgacgagtcttgtaccacaatcctggaacggaaaggcagccttcatcgccatattgctctccgttggtctcctccaacaccgggttaagcacatagccgattttgccgtcgatattgtaggaaaacgcacgcagactcacaccgatttggttggcggacaacccggcgcgtcccgggtcatcaacggtatccaacaaatcctgcaccagatggcgcaccgcgggcgtgatctccttgatgggatcgcatggggtgcgcagcactggatcaggtacgactcgaatctcacggattgccaaaattaacgctcctcgttgttcttggttgcggaaggctcgacggacggtgccgtctcgtcatccggttcatcggactgcttcttgattctctcctgcatggtatcaaatgcctgccgaaccttcgggctgacggattcagaagcctgccgcatgctttccgacgcctgcttgacggtttcggtggtgcggtcgagaatctggacggtcttcggcaacggcctgttggagggttttggcgcgtaaatcacgttttcgatgacgtctgcgtagcgctgcagcaccttgggacgaacaactttcaggcttgccgtcaaggtgccgtcctgttggttgaattcctcatcgagaatctcgaattttcgtacggattccgcacgggaaacgttcgcgttggccttttcgacatactgctgcacgaaagcgcgcacggcatcgttttccgctacctgcttcatggacatatcggcatcaagaccctgctgggaaagccaagaacgagtcatatcagaatccagttcaatcaaagcgctgatgaacggcttgccatcgccaatgaccacagcatgggacacgataggacaggtgtcgatgatgtcctccatcggggcggggctgacgttcttgcctccggctgtgatgatgatgtccttcttgcggccggtgatatacacgaatccatcatcgtcgatggcccccagatcgccggtcctcagccaaccatcaggcattttgacttcagcggtcttctcaggattcttgtagtagccaagaaaaacattggggcccatgacctgcagctcgccatcatcatcggtgcgcacacccatacccggcccgggcttaccaacggaaccgacgcgattcgcattttgccagttgacgatcatcggagccgcggtttccgtcataccgtacccctgaatgaacgtgatgccatccatgccattgaagaagtgggcaaggtcgacgttcagcggggcgccgccgcatgccagatatttcaggttcggaccaagcgcggaacgaatggacttgccgacgacggacatgaagaaggaatgctcggctcgggccaccatcgaatgatgtcccccgtcctgctcgtccttggaccattgcacgaaatgatcgaacgccttggcgaagaccctgccgcgaatacccgcaccggccttctgcgaggcagcgttgtacactttttcgaacacacgtggcacgccaagcaaatacgtcggtttgaaactgcgcagatcggcgagcagatgcttggctccaggcagatagccgaccacgccttgtccgccaatcgccacgtattggatatagcgggcgaagcagtgcgccaacggcaggaacagcatcaacctgttgggctggtacagcatctcgtcaagaatgatgtagccattgagcacgatatgcgtgaagttgcgatgggacagcatcgcacccttcggacgtcccgtggagcccgatgtgtaaacgatggtgagcatgtcgtccgccttgatccgggcaatgacctgatcaagggtatcgtcatcgacgccctctccgaaatcggcgactgcgtcaagaccgtccgctttgaaattgaacacgtaacgcagcccttcatgcatgtcacgaatctgttcgagcgtctgcgtgtggacggaatctccagcgaaggcaataaccggctccacctcttccacgatggaagcggcctgcttggccgaatcggtttcataaatcggaacgcttaccgcgccgatggccgcgcatgcgaaatcgaccacaccccactcgtaacaggtgggagagtaaatgaccaccatgcttccggccttgactccaagaccgataaggcccttcgccacggcgcgcacacgagcgagcatctggcctgccgtcacatcatgccattgccgagtctcatcatcctgccattgtgcgataagatcatccggattcttctgcgcacgacgcgacagcaacgcatataccgtgtcatcatccgtggtgctgtaggccggctctggtacaaattctctcaacatggttctctatagtagttcccgtatgcttaaggcacgctgaaaacccttggcatcgactgcgaacatcgacgccaagggcttttgcagattcctaccgtatcatcgcatcaatgcgatcacccgaaatcagccaagacgcacttccacgtggagcctttgagcctgaatgcggtgttgcatctcaaccgcgtttcgccgatgttgagcaaagccgcacattcgaatttcgtggtcgaagtcaaccagccattaatggcggacacgttgatgggaagcagaccaatcttggcatatagatttgcgtcttccttcatataatggcctattatggaagctgcgattttaagcctacgcatacagtcatccgttagaatacgctctacatgcgccggcttttgccgaccacggaagatgtcgatggcatcgcacgacatgcgcgcgcccaataacgccaaggaataggcttgcttcgcgtcccacggtgtggaatcggaccggataacatggaagggcacccgcatgccggataattgtgtttccaaaaacccatcatatgaaggaagcttctcgacggattttcctatgcactgcagccattggccattgttttccgcttctttaagaccgacatacgaatcagggtctgacggtgggatttcgtcaggctcattgccttctatctccttgtcgtcttccggctcccgctcagagccggactgccattccggaggtgaaacgccatcgtcggataagtcgtccattgccatggatccctcatttctttacctgtttaatgtcatccaactctcttcactgagaaggaccaaaaacattaatacataaagacaatccccccgtcaagtcgacggagggattgtggataactttttttatccacaggacgaagctatctgatcagtggctcgaagcgaccgtaaccggacaacgttggaagctcttcaaatcgacataaccggtcgtggccatggctctgcgaagcgccccaacaaaattggtggttccgtcggcgttatggctcgggccgaacatgacctcctgcaaggaacctacggtgcccacgttagtgcggaatccgcgcggcaacgtctggtggcgggcctcggcgccccaatgcatgcctttgccaggagcctcggaggcgcgtgccagaggcgagcccagcatcaccgcatcggcgcccagcgcgaatgccttgacgaagctgccggaatcacccataccgccgtcggcaatcacctgcacatagcgtccgcccgattcgtccatgtaatcgcggcgggcctcggcgacatcggcgatggcagtggccatcggcgcgtgcactccaatcgtgttgcggttggcggataccgcaccgccaccgaagccgacaagcacgccagcggctcccgtgcgcatcaaatgcaacgcagccgtgtagttggccgcgccgccaacaatgacggggacatccaggtcatagatgaatttcttaaggttcaggggctcatggtccttggagacatgctccgccgacaccacggtgccacgaatgacaaacagatcgacaccggcctcaagcacggtggaataataatcctgcgtacgctgcggagacagcgcgccggctacggtgacgccggcatcacgaatctcatgcagacgttcgacgatgagttccggcttgatcggctcagcgtaaatctgctggatgcgttcggtggccttgtccgcaggcagctgcgcgatttcgtccagtagcggctggggatcgtcatagcgggtccacaatccttctaggtcaagcacgccaagcgcgcccatcttgcccatggcgatggccgtggccgggctggtcacggaatccatcggggcgccgatgaccggcacgtcgaattcataggcgtcgacctgccaagaggtggacacatcctgaggatcacgggtacgacgggagggaacgatggagacatcgtccagcgaataggccagacggcccttcttgcccaaaccgatttcaatttcctgagacatggtttcaaggctaatgctcagctatgacagtgccttcgcgcgtgtccccacggttttggacatttccatacggaattaacacacatgtaataagacggaacccatcaccttcaattccgacagggaggacaaaccatggccaaaatcaaggtcgaaggcaaagtcgtcgaactcgacggcgacgagatgacccgtgtcatctggaaagacatcaagaaccgtctgatcctgccgtacctcgacgtggatttggattattacgatctgggcatcgaaaaccgcgacgccaccgacgatcaggtgaccgtcgacgcggcgaaggccatccagcgcgaacatgtcggcgtcaaatgcgccaccatcaccccggacgaggcgcgcgtcaaggagttcggcctcaagaagatgtggaaatcccccaatggcaccatccgcaacattctcggcggcaccatcttccgcgagccgatcgtcatgagcaatgtgcctcgcctggtcccgggatggaccaagccgatcgtcgtggcacgtcacgccttcggagaccagtacaaagccactgatttcaaggttccgggagccggcaccctcaccgtaaccttcactccggaagacggctccgagccgattgagcacgtcgtttacaattatggccctgacggcggagttgcccaggtgcaatacaacgtgaacgattccatccgaggtttcgcacgcgcctgcttcaactatggtctgatgcgcggctatccggtgtacctgtccaccaagaacacgattctcaaggcgtacgacggccagttcaaggatacgttcgccgaggtgttcgaaaacgaatacaaggacaagtacgaggcggctggcctgacctacgagcaccgactcattgatgacatggtggcaagctccctcaagtggcatggcggctatatctgggcttgcaagaactacgatggcgacgtgcagtcggattccgtcgcacagggattcggctcccttggcctaatgacctccgtgctgatgactcccgacgggcagaccgtcgaagccgaagccgcgcacggcaccgtgacccgccattatcgccgttggcagaagggtgaaaagacctcgaccaatccgatcgcctccatcttcgcatggaccggcggtctgaagcatcgcgccgaccttgacaacactccggaagtcaagcatttcgccgaaactttggagaaagtcatcatctccaccgtcgaaggcggacagatgaccaaggatctggccatgctcatcggaccggaccagccttggctcgataccgagggtttcatgaacgccctcgacgagaatctggcaaaggctctggcagagtaatctatctgagctgtcgaaagcccgtatgcgcaatcacacgcgcgtacgggctttttgacgtccggatattacaatcgatggtcagtataaggaacgtctattcttccgcaaaggacatggcatgattctgcatcgcacaatcccggcgaaacgtctgctcgctctgctggcatcggtctgcatggcaacagccatgggggcctgctcgcccaacggtgattcgcaatcgcagcaacagccgtcatcacaatccagagcaacagccgatgccggcaatgtggcgattttcgctccgacagacagcatcaccatctctcaacagacgccattgagcaaatgggaaaaactcgttcccgaaatcgtgtcctcgttgaaacggaccggtgtcaaaagcggcgacatcaccgtgaaaaccgcttcgaacctcgacaaacaaagtcaaagcgtccaagactatgtggtgaatcacatcaacggaaccgagcattcgtccacgaaagccaaaaccaccttggtggtggcgcctgtcgccgagatgccggaatccgacaggcaatacggcgactatgcgcggcatgatatcacgtggaactccgacgcgtcggatgaggacgaacaggattatgcgcaatcagcgcaacggctggtttcggcgttgcagcttgcgcagaatgaaggaatgaaggtcgttctgatctccaatacgcttcaagggtatgcgccggacgtgtatgtgccgatgaccacggccgagcagattggagaactgcaagccaaagagctcgtcaacaagctcgagctcgacaaggcatcgtccgatgcccccaagcaaatcgaggtactactcccctacgacgcggccgacggacatgatgccaaaacggacacgtccttcgcccagaacatgttcaaaggcatctggaaagtgctcgaaccgtatttcaaggacggcaaagcggcatctccttccgagacgctcaccgcttcgaccaccaaggatgactggcggtccgtggcattcgattcgtcaaaagccgaacaaatcaaatcggtgcttgccgaacgtctcgacgcggacaaggacgattcgcaccctgtccaccttgatggcgtcatctcctgcaacgactatgtggcgaagaacatcgccgacgagttggacaaactcggctacacaggttcctcagccgatatcaacccttccatctcaatctccggcatcgtggacagcatcacgggcaaaaaagacctgaaacggcaggcagtgcctgaccctgcgaagacgtcgtcatcggatgacgacagcgattccgataacaaggaaaacgcaaaatggccgatcatcaccggctatggggcctatatcagttccatgccgaacatcgtcaacggcaagcaatggatgaccgccatggagaaccgcaaggcgttggccgatgacatcgcgcagacatgcgtgcgactgaacacttcgggcaaactttccaaactcggtttcatccgttccgcaacggtcgaggggaagaaaattacgaccatccatgaggagacattggcgatcagcgccgacaatctcaagaaaacgctgattgaacccggctacatttcgctggcggatgcgggcctatgattcttccgggattcttccggatatggtgggggccgatggcatcactcggatgtcaccggcccccaccatatttcgaacatcattcggcgtgagccgccggcttcctcggcacgtagatgaccttgtcgatcaacgtccggtaatgttcaaccactgcctgcctgcgggccttcatgctcggcgtgaccaaaccgttctcctcagtgaactcgtcgggaacgatttcgaacttgcggattgattcggcacgtgaggcgagctcattggctttgttgacggcacgctccacttccgcacgcacaatggggttcttcgaggcttcatccaaatcagcgacctgttccgctcccttggattccagccataggttcgtctccgccaaatcaagggagatgattgcggcgatgaatggcttgcgatcgccgatcatgacgcattggctcaccaccggcgaagtcatgatggatgcttccatctcgcatggggagacgttcttgccacctgcggtgatgatgagatccttcttacgcccgacgatggaaacgaagccgtcatcatcaatggagccgagatcaccggtatgcagccatccatcgacaatttgctgcttggtaacgtcaggattgttgtggtatccggcgcatacggcagggctctttatgcacagctccccttcttcgtcgacccccatggtcacgccttgcagaggcaagccgatggtgccgatcttgtagccttcggtcggattgacgctcgagggggcgcacgtttcggtcatgccgtagccttccaatagcggcagaccgacaccgttgaagaaatgcgcgatagaggaatcaagcggcgctccgccggagaccgcatactcgacgtggccgccgaacacttccatgattgacgaatacaccagcttgttgtacagggcatgttttgcgttcagcgcgagtggaatgctcccaccggactgctgagcatgcgaccaatcgtatgccgtctgggtggcgtcagcgaaaacacgtcccttgaaaccggctccggccttctgcgaggccgcattgtagatcttttcgaaaatccgcggcacggcgaggatgaacgtcggtttgaacgccttgaaatcggcgagaatggtcttcagattgctggacagaccgagtgaaacgtttccggcaaagcagaagaactgcatgtatcgggcgaatacatgggcgagcggcaagaacagcagcagtcgacgattcggtttcatggcgatgtccggcatggagttgacgccggaataggtgatgaacacgaaattggcatgcgtcagttcaacgcccttcggggtgccagtggatcccgacgtatatacgatggtggctagatcggagcctttgaccgcttgttcacgttcaaggaattcggcgtcggagaccgcgcggccgtattcgatgatcgtgtcaattgcaccaagtccgatgacgtacacgtcgccaagatccgggcactgatcacggacggattcgattttgtcgcgctggaaatcatcctcagcgaacgccatcttgacattggcatcattgaaaatcatcttcacctgcgccggcgaattcgtttcatagaccggaacggtaagggcgccgatggacatgatggccacatcaagcgcggtccactgccagcaggtatgcgcgataatggataccgaatctccaggcattacgccacgagcgataagtcctttggcgagggcgacgaccttgtttttgaactccgcagcggtgaacgccgcccattcgccctgagcgttcttgtattcgacaagattgtcgtcaggagtgcgttccacacgctcctcaagtactgagaagatgtttttgtccgagtcaattccctgttccaaagggcgcgtgtattccttgatcataagcttctcgctcctcgaaatctaatgtacagacagcatcatagccggaataccgcactttttctttaaggccacgaccccaggacaacgacaacacccgtggatatggccgttacaacggtttcagttcaacccgcatcgacctcactctgcccgacggatccgcataatcacgtcctccgctcttgaggccccaatgcagacatccatcggcgcaatgttccgagccaccttcaacacgagcgaaacgctcccccttggcgatgacggccccgaccggtcgcgtagtgaccgcgggttcaaacgtcgacgtcaggcttcccgtttccgcaccgtggcgaagcgttaccacggatttgcccgccactttgccactgaaggcgaccacaccatccgcgggcgcgatgatggcgtcttgcggccgtgcacgcaaatccaaaccgcgatgcccaggcaaccattgtttagccggcgcatcatattcgccgattacttgcgcgtgctccaaaggccactgcattgatgtgcggcatgccgcttgtgcgacttcatgcgccacgtcatcagccgattgcgcgtatgccgacgccgtaggttgcgcgcagcatatcgtgaacgcgatgttcgccaatacgcatacggccatcgccgcggcgcaccggtgccggttgcgcttgtcaatgtcatcggacatcttattgtgtcgaacacgccgacggtattcccatttgttcatgaggcctcctgtggtccgcgtctctatccgggaatcgatatcatggcacgttcgaagaccgcccgtcgacttggaacgaccttgtggtcggagaacaacacttatccacagatgccgggcgtgtcgcgccatgacatgccaaaacgccaccgaacgtggcatacgatgggacacatgagtgacaacactacgcaacgcaaggcattgcagcagttggagagcgagccgtccgaggaacgcatcgcctactaccgcaagccattcatggtgctatgggccgccattcaggaggcttcaagcgagctgcaggacgattacacgctttcacccgaattgtcccagttatgggttggcgagcaaatacggcaggtttcggattcgctagtggatcggctcgcggaaatcgccgtggcgcatggcgagtcaaaatcgaatgtggcacgtgcggccaacgcaagtcccgacaacgtcatacgtcgcttccctcgactcaaggctgatgcggcacacgaccgcacactcattgacgacgtgctcgattcgttggaatagcagcgaaaagttcttacggaaacaaaaagcccttggaaaaccaagggctaagaagctcctgcgactgggcttgaaccagtgaccgttcgattaacagtcgaatgctctgccaactgagctacgcaggaatatgttccggtgtacccgaaactgcgctcctgcgactgggcttgaaccagtgaccgtccgattaacagtcggatgctctgccaactgagctacgcaggaatgttcccaccggaagacttggcttccgtgcacaagtcacatatattacacgaatcagccatttacgcaaatcatacgtatcacagcgtgtcgcaacgtcaccattcaagctcttcgatatccatcggatgctcgttgacctcaatcgatgacacacgtccatcatgcatgcgaattacacggtccgcaatcggcgcaatcgcagaattatgcgtcacgatcaccactgtcgcgcccttcttgcggctcatgtcctgcagaatgcggagcacttgcttgccggtgttgtagtcaagcgcgccggtcggttcgtcacacagcagaatcttcggattcttcgccaccgctcgagcgatcgccacacgctgctgctcgccgcccgacaactgcgcgggaaaattgtcgacgcggtccgcaagccctacgtcggcgagcgcctgtcgggcgtcttgtgcgtcgggaacgatttgtgaggcgagttctacgttttcgcgtgcggtgaggttggcgacgaggttgtagaactggaatacgaagccgatgtcggtgcggcggtatgcggtgagttgtttgggtgtgtagttggagatgtctttgccgtcgatgattacttgtcctgaggtgttggcgtccatgcctcctaggatgttgagcactgttgatttgcctgcgccggatgcgccgaggatgatggcgagttcgccttgttcgatggtgaaggagacgttgtcgttggcggtgatggtggtggatcccatgtggtagagcttggtgctgtttttcatttcgatgtatgccatgttccgctccgttttcttgtttggcgtccatgccgtttttgtttgttgtttttaatatacgactaaagtggtgtttgtggttccacgccgagggaaaggattttccatggatgtctccgatgatgccgaccgtttgcagacgttgttgtatagttcctattccgccgatgttgtccggcagttggagcgtcctttgttggatgatggtgtgccgttgatgcgtatggctgcttctgcggtggctcgtgtgacgttgtcgttgcttgatgatgaggatttggatgttgaggatgcgcggatcacggtgttggctggcgctggggacaatggtggcgatggcttgtatgcgggggctgagttggcgcgtgagggtgcgcaggttaccgcggttgctgttggccgttcgttgcatgaggatgcgtttagggcgtttgttcgtgcgggtgggcgtgtgttggtgttggatccggcggctgatatttctgggtgcacgtctggtttttccgcgggtgaggctggtgagcggctgcaggctgcggtcgagtgtgcgcggggtgcgcatgtggtgcttgatgctatgacggggattggcgtggtcggcgcgttgcgtggtgtcgctggcacgttggcttcgtctttgggtatggatggcgtgttgccggacaagcctgcgttgccgaacaatgacccttccgctgatttgccgttggtggtggccgtcgatgcgccgtcgggtgtgggtgttgatgatggttcgttgccggggccgtatattcctgcggatgtgacggtgacgttcggtgcgatgaagccgtgtgcgatggtgccgccggcttcgtatgcttgcggacggatcacgttggtcgatttcggtttcgatgtcgatgatgctgttccgtttgccgagatgacggatggcgattttgtggcggattcggttcgtcttccgtctcttgcggatggcaagtattcgcgtggagtggttggtttggtgactggttcggcgcggtatccgggtgctgccgtgttgtcggcgagggccgcggcgtgcgcgaatgtgggcatggtgcgttatctggggccacagcgtgcgcaggatatgatattgtccgtgttgccggaggctgtgttgggcaagggccgggtgcagtcgtgggtggttggatccggcgtgcccgccgagggtgacgttgcttccggtgatgacatgcaacgtgcgaccattgccgcgctgctggatcattacgcgttggaggatggcgatggctcgcggaacgagcgggcggagggcatgcctcccattgtggttgatgccggcgcgttggatttgctgccgtgccatgttgtgccgcaggtcgttatcactccgcatgccggcgaattggccgcattactgaatcggttggatgccgatatggccgatgttgtttccaggcagtgggtggaggcccggccattgcgggcggcgttgcgcgcgcatgagcttacgggggccacggtgctgcttaagggcgcggtcaccattgtggttggagctgatggagatgggaacacgcggatcatcctgtccgggcgcgcgcctgcctggatggccaccgccggttcgggcgatgtgttggccggcgtgttgggcgcgttgctggcgcagcaggacgacatgctgtccgacgatccggctttggttccggaggtcgccgcggccgccgcgtatatgcatgggcttgccggcgcgatggccagcgggtcggagcagcgcggatggcatcgtccgcatctgtatgggcatgcgggcaagactccggcgagcgcgatcgggcatccgattgttgccggtgatgtcgtcgcggctgttccccgggcttttggcgagctgctccgctgaccgtttcgtggagggtcattccactgatttcaatgcttcgagcatgtccaccgtttcgagctggcggtatacgatccagccgagcacggctagtaccacggccacgacgatggccggggccgccaatgcgatccagctgatggcggggtcgaacatgacttcgtcgggtggcacttcggtgatgatgtatcggtgcagccattctccgaagccgtatccggcgagtatgcccagcagtgacagcaggatcgtttcgcggtagatgtacatcgtggtctcgctggtgtggaagccgagcactttgatcgtggatagctcgcgtatgcgttccgacacgttgaggttggtcaggtcgtagaggatcaccacggccagcagcacggccacgagaatcagcacttccatgatctggttgagcgatcccacgattgtggacaccatgttcttctgcgtcgtgttctgcacgacgccgcgcacggcggccagtttcatgaatttggcgccttggcgttccgtgttggcgttgctgtggtctttcagtctgaccatgtatgcgtttgtgctgtactggtcgccgaacacgtgttcgtagcattgcgcgttcatgaatatgaaatggccgatgtacatttcgctgatgccggcgactttgatggtgcgttgcgcgccgttttcgtcgtttaccgtgaaggtgtcgccgaccgagacgttgagcatttcggcgagccgttcggagattaccgcgccattgttgaccagtatctgtggttggtgtgttttgcggtcgcgtaatgtcaggtattcgttgaagttgtatgcgtcgtcggtggccagcagggtgatcgactgcttatcgttctccttgcctgcggttttcgacagttcctcgtagcgcaccgctgtcgaggattggacggttttgcccttcagcgtcgtggcgatttcctcgcgttgcgcgctgttggtgtcggattcctcggcgacgatcaggtcgtagtggatgagttcctcgaactgtcggtttcctatctgtccgatcgaggattggacggcgaggccggccgtcagcagggataccgctccgcatacgccgaagatcgtcatgaacatgcgtgttttatatcggaagatgttacgggcggtcactttgtgtgtgaaattcagacggttccatagtggtgggaaatgttccaaaagaattttcgagcctttggccggcggcttgggcagcagtaggctcgccggtttttcgcgcagttccttggacgcggccagccatgccggcacgacggcgcttatccatgcaagtgcgaatgcggccatggtgatccaggggtggaatttgagcatgatgtccggcatggtgaatcccgcgctgtatgcgtgggcgacgataagcggcagcagcgtgtggccggcgagcacgccgatgcatgtgcccagggtggatgcggcgaatccgtatacggtgaatttgagcatcacatccgcgttgccgtagccgagcgccttcaacgttccggaattggtgcgttcctcgtccaccatgcgtcccatggtgctgaaggtgacgagcgccgcgacgaagtagaggaagatcgggaagatgtccgccagtttcgccacgatgccttcgatgaccatgtacacgcggtagccttgcgaggtcaggccttcgcggcggccgctgacggaataggccgggacggtgagattgtcgatcttctcctcggcgagggttatctgccgttcggcttcggatatcttgcgttcggcttcgggcttctgcgcgttgaattcggcgagtttgctctggtattccgtttcggccttgtcgatgtccctctggccttggataagctgcgtgacgccgtctgcgacttgcttgccggcctgcgacaccgctttgccgagctcgttttgtttttcggctatctgtttggatgcctgtgcgagattgtccgcattgctccgatacgcctgcgagccttggtcgagccgcgctacggcgttctggtattgttgcagtcccgcattgtaggcgttcagctgtctgttgtattcggcgcaggcttcgttgtactggttgatcgccatgtcgtatttgccgcgtatttgttcgtagagtttgccggtgatgccggtctgttcccatttgccgagcgtcgcgccgactttgtcgagcacggttttgcttgtttcgagttgttctcgcgccgcgtccagctgcgttttgccgttcgccagccggttccatgaatcggagagctggttctgtccttgagccagttgcgtctgtgccgcctgcagttgcgtctgtccggaggcgaccgacgcgttggccgaggccagttgcgcttgcgccgtggccagctgggccgcggccgccgacccttcctccactgcctcggcgctgccttcgctcaactggtccttggcgttgtcgatctgctgtttggcatcgtccagctgccgttgcgcgtcggcaagctgctgtttggatgttttgactttgtccttggcctcgtcgattttcttgcgctgttggctgcgtatcgtcgcttcgcgggcttttggctggttcgcgagcaacgtcacgagctgatccttatgcttctgcacggcatcgcggtattcggcgctccagtagtccaatccctcggtgtcttcgtaggtcgcccgggcgatcatcttcacgtcggaatcgaactctcccggaacggccacggcatagcctttgagctcgccgccgccggccgcggattgtcccatgttgaggcaggacagagtctcgctggcccggacgaaaccgacgacggtgaatttgtggtggcgtagcacggtgccgcctgcgatgtccgttttctcggtgacgttcaaggtgctgccgacggcgaatctgtcgcgttctttcatgtccaacgcgatttcgccggtccgcttcggcagtcgtccttccgtcacgtcataggtggagacggcatcgggtttggaatagatgcgcatgctcctgtcggtgccggagatgaccacgtccttgaagtacccgtattcgacttccttgatgccgtcggccttgccgatgatcctctcgtcgtctttggagatgccgtagttggagaccacggtgatgtcggcgaggttgttacgcccgtaggaagtcggcggcgatcgcctgcatgtccggcccggtgaccttcagtcccaccagcgcgaatgagccaagcgccatgaggcacacgatggacacgacccggcctttcgacttggacagtgtttgccggatgtccttccacagcatgcgtttcaccattccagctcctcgatgtccattggatgctcgttggtttcgattgatttgacgcgggcgtcgtgcatgcggatccccctgtccgcgatgggggcgatcgcggagttgtgcgtcacgatcaccaccgtcgccccgcgtttgcggctcatgtcctgcaggatgcggagcacctgcttgccggtatggtagtcgagcgcgccggtcggttcgtcgcatagcaggatcttcgggttcttcgccacggctctcgcgatggccacgcgctgctgctcgccgccggaaagctgcgcggggaaattgtcgatgcggtcgccaagtcccacatcgaccagcgtctgcactggatcggccgcgttcttgacgagttcggaggcgagttccacgttctccttggcggtgaggttggccaccagattgtagaactggaatacgaatccgatgttgttgcgccggtaatcggtcagttgcttcgcgttgaagtccgagatgtcgacgccgtcgatgatgaccttgccttcggaattcgtgtccatgccgctcaggatgttgagcaccgtcgatttgccggctccggatgatcccagaatgatcgcaagctcgccgcgttcgatgtcgaaactcacatcgttgttggcggtgattatgatgtcgcccatatggtagcgcttgaagctgtgcaccatttcgatatatgccatcgtcggccccttcctaatgctttccactaggacacccgtctattcagacaacatgttgatttaatttcggattgattgtatgttcgaaatggtcggcatgacaatcatcgcaatcgccgaaaacgtctagattagcctttttcaaaacccaagcgagcctttccgccccaatgactttcaggaaacgccgcacgcgaagacgaaaacgtccttcacgaacatgggtacggtacactggcggaagacagacgcacgctacaagaagggtttcccgatgaccgttgcagttccgaccatcaccgacgtcgttttcgatttctgcggagtgttgctggattggcggacacgggcatgccttgaaggcagattcgacgacgcgaccgtcgaccgcatctgcgccgacgacgacccctgcggcttcttcggatacgaggaccgtatggacgccggggaggacttcgattcgatatggcccgatgtggtggccgagcagggagaacgcgtcgccgggatcttccgttattacatcgcgcattacgacgacgcgctgccacgcatgctgcccggcatggagcggctgctgcgcgatctgaaggcggccggctatggcgtgtggggattgacgaattggtcccatgagacgttccatttcgcattcgagaagttcccgcagcttgccgaactgctgcagggcaccatcgtctccggcgtggagaagatgcacaagccgaacgccgacatctacgaactggcgatgagccgtttcggcctaagccccgagagcagcgtgttcctcgacgacaccgcgaagaacgtcgccggggcgcggtcggccggcatgcacgccttccgtttcgtcgacgccgaccaggcgcgcagggacctggaatccttgggcgtgcgcgtgtgagcgcggcggacgtacgcctgcgtcccgcggaacgggcctcggccatgcgcccatatcatcgtccgctgtaggccgcgcatccaccgaccgcgtgtccactatgcaaaacgaagcgctataaatcgtcgtttcgtaaagcgacgctggtataaatgggcgttatgaccctccttcagctgaaatacatcgtcaaaatagtggaatgcggctccatgaacgaggcctcgcacgagctgtacgtatcccagcccgcgttgagctcctcggtgaaggagcttgagaacgagctcggcatcgagatcttcacccgttcctcccaaggcatcgcgttgaccgtggacggcgcggaattcctcacctacgcgcgtcaggtcctcgatcaggcgtcgctgctggaggaacggtacaagaacgcgaaaccccgcaaacagctgtgctccgtgtccacgcagcattacatgttcgccgtggaggcgttcgtggagatgatcgactccaccaagtccgacgaatacgagttcaccatccgcgagacccgcacgaaggacatcatcaaccaggtggcgaacatgctttcggagatcggcatcatctacctgtccgacttcaacaaggacgtgatcggcaagctgctgcgcgagaagcatctcgagttccatccgctgttccgcgcgccgttgcacgtgttcatctcgcgcgacaatccgctggccggcaagaagaaggtcaccatggacgatctgaagccgttcccgttcatccaatacgagcagggcgaggaaggcagcttcttcttcgcggaggaggccgtctggccggagtactcccccaagcagatcaacgtgaccgaccgcgccacgattctgaacttcatcatcggcctgaacggctacacggtgtgcaccggcatcgacaacggcgatctcaacaacgagaagatcgtcaccgtgccgctcgacaccgatgagacgatgcttgtcggatggatcaccaatgagcgcgcgaagctgtccaaggccgccgaaacgtacttggagaagctcaagtcggtggtcgccagctacggctacacgctcatcgactgaccccggaacagaggaaccacaacgaaaaggcactgtactgcccgaaagcagcacagtgcctttctgtcatatccgagactatgacagccgatgagcgcggttcagcgcgaacgccgcagtcaggcgccgtactgttccaggtacgcgtcggcggcggccttgatctccggtgtgacgtacggggtgccgtcggcgttctggatgtgctggccggcttcgaagatctccttcacgttggcgatggcgaacaccgggaagccgaattcggcttcgacggccttcaccgcggacgtgtcggaatccttggtcttctccatgcggtccacgctcagtaccaggccgatgacctcgacgttcgcctcggccttgagcttcgggatgacctcgcgcacagcggtgccggcggtcatcacgtcgtcgacgagcaggaccttcatgccgtccgcaagctgcgtgccgaccatcatgccgccgtcgccatggtccttcttctccttgcggtcgaaggtgtagccgacctccatgccatgggcggacgtcagcgcgatggcggtggacacgcccagcgggatgcccttgtaggcagggccgaacacggtgtcgatgtccttgggcaggttgcccgcctcgatctcctcgacaatcttctcggcgtagaacgcgccgagacgggcgatcttgcgtccgtcgttgaatgcgccggcgttgatgaagtacggcgacttgcggccggacttcaatgtgaactcgccgaatttcaacgcctgcgattccagcaggaactcggtgaaacgatggtcgagcgatgcggtcatttgcttgttctccttacattgatcgattacgaaatttcagcgccaggtctcgcctttggcgagcttgtcggcgagttcgggacgttcgtcgagcagatcgtcgagttcgcgggccacgcgcagcggcgcggtcggctcgaacaatgcggccgcgccgacttcgacggcgttggcgccggcatacaggtattcgagcgcggtctcgccggagtcgatgcctccgatgccgatgatcggtatttctggcaatgcggcgcgcacgcgccataccgcggccagtccgaccggcaggacggccgggccggacacgccgccggtgacgtgcgtgatgaccggctcgccggtgcggatgttgatgcgcatgccgagcagcgtgttgatcaggctcaatgcgtcggctccgctttccaccgcggctcgtgccggcacggtgatgtcggtgacgttcggggtgagtttgacgatcatcttcttgtcggtgagcttgcgcagtctggtgatgaggcggctcaaagccaccgggtcggtgccgacgctcatgccgcctgcggacacgttcggacagctcacgttgatttccagcatgtcggccggggaatcgtcgagtttggacacgacttccgcgtagtcgtcgtcgcagtgtccggcgacgttggcgatgacggtggcgttgatggccttgagtttcggcagatcgtcctcaaggtaatggtccacgccgggattctgcaggccgacggcgttgatgttgctggaggggccttccgcagtacggatgccaggattgccttcccatggcaccggagacacgcctttggtggtgacggcgcccagctggctcacgtcatagaaccagcgcacggcagcatattggaacgtgccggaagcggtcgccaccggattcttccacgggataccagccacctgggtgggatgcttccattcgtgctgttcgtacaggttcgcatgttgttctgcggtcatgctcactccccccatcccaattgttcgcgggtgaacacaggtccgtccgagcagaccttcaatcgtccttcggcggtgtcgacggtgcacagcacgcatgtgccgtatccgcagcccatgcgctgttccaagctcagctgtgcctcgatgccgcgtttcgccgcccatgcggcgacggccttcatcatcggcaacggcccgcatgagaggatgaccggcttcagctcgccgttcaccagttcattttcaatacggtcaaggagcgttacgacattgccttcggattcgtcgatgctgtatgtcttgtccgcgtaccggccgacgtatccgtctccgaaacgcacgttgcggtatccgaacaccgcggtgctcgtcgacccctccgattcggcgatggcctgcgcggcgcgcaccagcggcggcacgccgagaccgccggccaccagcacgtagttcgcgttctccttggtgttgaaggagttgccgagaggacccatcacccgaatggtgtcgcccgcacgcaattcggagaattcggcggtgcctttgccgacgacggcgaagataaggctcacctcatcgccatccacttcggccacgccgaacgggcggggcatcagtctgctcggattgttggaatacacgtcgacgaactgcgccggcttggcatgtcccgcgatgaattcgtcgcggaatgtcaatcggtacacgccatcggccagcatgcggttgtcgacgatttcgaccgtgtgcctgctggggaagaatcccgcttccctcgcctggccgacggtcggcatgaacgttgctgcggcggtcatgactccctttcctgtgtttcgttcgattgttctggtagcttacggcagtaccgcgcgcagattgtcgcgcatgtccttcgcggcctcgcgcgccgattcggcgaccaagtcgagcgcatcgtctgcgctcatggattcgctgtatttgccggacttcttccaggctccgatgatgccacgcgacgaattgacgagcgcgcccatgccgtctttgtcgaacatgccggccacgccttgggcggtaccgccctgcgcgccgtaaccggggaccaggaagaacgtgtgcggcatgcgcgcccgcaacgccttgccttcctcgggatgggtggctccgaccaccgcgccgacacgggaatacccgttcgcgccgatggtttcggctccccagccttccacgaggccggcgatatgctcgtacacgcgctcgcctgaggcgagttcgagttcctgcagttcgctgctggatggattggaggtgcgtaccagtacgaagatgtccttgtcggcaccagtggcggcttcgacgaacggggtgatgccgtcggtgccgaggtaggggttcacggtgaccgcgtcctcatgccacgggtcgaaagcgcgctcccccgcgttcacaccgctcagatggtgggcgtaggcggctgcggtggagccgatgtcgccgcgcttgacgtcgccgaggacgtacagtccctgctgtttggcgtattcgcaggtcatgctgtaggcgtcgatgccggctggtccgagcgcctcatacatggcgatctgcggtttgacggccgggacgatgtcggctactgcgtcgatgatggcgcggttgaattcgaagaaggcgacggacagttgggctgccggcgcttccgtcggatcctccacctgttcggcgatttcctcggcgaagctggccacgacctgcttcggcaccagcgcttcggtggggtcgagtcccacgacgcttggattctgcttgtcttcgatggcttcgatcagacggtccatcagtcctccttgtcgatgcggctgaaggccagcttcgagccgatgatggtggcgagcggccggccggtgacctgccatccgccgaatggggtgttacgtgccgaggagtggaacttctccgggtcgacggtccattcctctccggtgttcagcaccacgagatccacctggtcgctttcgggcacgcggcccagatcaagcacgcgcttggtgtcgtcgtctcccggcacggcgtcggcgtagtcgtcgagcaccgccgtgatgtccgttttgtcgtggcccatgagttcggccggaccggtggacatgagttcgatgagacgttcgtcggaaatgaatccgccgtcgacaagtaccttgtggcagacgccgtatgcgcattccagcccgatgatgccgttgggcgcgtcgaggaagccgagttccttctcttccatggtgtggggcgcatggtcggtggccaacaaatcgaccgtgccgtcggcgacggctgcgatggtggcctggcggtccgcttcggagcgcagcggcgggttcattttggccaaagtgccgtacttaagcagcgcctcgtcgttcaatgcgatgtaatgcggcgcggtctcgcaggtgatcggaagtccttcggccttggctttgcggatggcgtcgaaggagatcgcggtgctgacgtgctggaagtgcacgtgcacgccggttttgcgggacatgtcaatgtcgcgttcgacgattttgagttccgtgtcctccggaatgcctggaacgccaagcttgcgggacaccggaccgtcattgaccgcgccggtgtcgtggtgttcgcaatgctcgatgaggtacagtcccgactccttgacgttttcgaacacctgttcgagaatgctgggggtcaccgcggaaccgtcatcgctgatggcggtcaccggatgcgccagctggtaggcgtccttatgctcgtcgccatgttcgggcaggtagccgatccagtcggccacttcggtggcctcatggccggcacgcccctttgaggcgcatacgcataggtcgtagcgcaccggcagtttcacgccatgagcggcctcgtaatgctgcaggtaatcgatgaccgtgtcgtattcggcgtcgagcacttcggaggcgcccggctggccggcctccaccttcacgccatccatggccggcacggtgtttggcatgatgagcacgttcgtgtatccgccggatgccgccgccgcgcagccggagatcatggactccttgtaggtctgtccgggatcgcggaaatgcacgtgcgggtcttcgaatccgggggcgatggtcatcgccgaggcgtccacggacgcgtccgtgtcggaggggacgacgaggtcaatgacttcgccggtgttccagaccttgatgtcgtgaagggtgagggtcatgatttcagaacttcgcttcctcgtcgcagtagtcgcaacggtattcctgacggtcggaatgcaccagatggaacatctgcaccgcaggctcggtggtggtgacgcagcgcgggttcacgcatttgatgatgttgacgacatgttccggcagggtcggcttcttcttttcgacgattttgccgccgcggacgatgccgacggtcgcggtgcgcgccacgaggccgagcacgtcgaggtcgatggattcggtctcatcctcgattttgatgatgtccttcgtgccgtacatgtggctgtcggtgttcatgatcaacgcgagcttggttttggacgggtcgatcttcagatactcaagtaccttgagcgcggttccggcgggcacgtgatcgatgatgatgccgttctgaatgctggtgacttccatcaggcttcaacctccttggctgcgagcggttcgtatcccggcagttcgtcaccgaccaccgagctttccaatgccatgcgcatgagcataccgttcttgacctgttcgaagtaggctgcacgcggatcgtcgtcgacttccacggcgatttcgttgacgcgcggcagcgggtgcagcacggccatgtccttcttggcgtacgccatcttggcttcgtcgaggatgtaggtgtcacgcagacgcagataatcgtcctcgttgaagaaacgttctttctgcacgcgggtcatgtacagcacgtcaagatcgccgatgacggagaccagatccttgacttcggtgtaggagcaggattcggtggcgttgatgcggtcaagcacgtactgcggggtcttgagctcgtcggggctgatgagcacgaagttgacgttgccgaagcggcacagtgtttcgatcagggagtgcacggtgcggccgaaggtcagatcgccgcacaggccgacggtcaggttggtgacacggccgaagcgcgattgaagcgtggccaggtcggcgagcgtctgcgtcggatgcatgtgtccgccgtcgcccgcgttgatgaccggcacggaggcggcgcgggatgcgaccagcgcggcgccttccttcggatggcggatggccaccacgtcgacgtagttggacaccgtcttcaacgtgtcggcgatcgtctcgcccttggtgacggaggcgagctgggcgccggcgaaaccgatcaccttgccgccgaggcgcagcatggcggtttcgaaactcagacgcgtgcgcgtgctcggctcataaaacaaagtggcaagcaccctgccttcgcaggtgtgtgccacttctttacgatgggaatcgatgtactgcgctttgtgcagcatttcctgaatctgacgaatggaaagatcatcgagagtgatgacgctttttccgaccatcggcgtttcgaccgccggttcgagtactgaggacaacggctcacctttcatgcaacttgtggttgaaggtggccactgaaagtgacctagccaactatagcccgaaacactgacccggagcgttcaccgcgtgttcaccgagcgcccgctcgaatcgtttcatgaaaggccgtagaacagacgttccgtcacgtcgcgcgccttgcgcattacggcaagcagatcgttttcgaaatgctgtccgcgattcgcgtcgtatccgagatagacggcgagtcctcccagcgaatacgtgtcatccggcaggatatccgcctggttgacgcgcccgctccacaggtagctgccgttgcgcgcggccgtgcacatccaccatgcgcgtcgcaatacgacggcgtcgccggcggaaaccagcttgcgccgctccaactcgtccaacgcctgcatcgtgccgttgactcgcaggttcgcgttgtcgccggcatgctgcaactgcagcagctgaatcgtccattccacgtcggacagaccacctttgcccagcttcaggtgacggtccctacgcacgccgcgcggcaatcgctcggcttccatacgcgccttgagcttgcgtatttcggcgacctgcgcctccgtcaaatcgatcttcggatagcgcagcgggtcggcgacgttcatcaggaaatcctcggcgagcgccgcgtcgcctgccgcgtaacgcgcacgcaggagcgcctggtgctcccatgtgctcgcccaggaacggtagtattcctcgcaggacgcgtaggagcgcacgaggggtccgtttttgccttcgggccgcaggtccatgtcgagttcgattttgggttcgagcgtggtcggtccttgcaggatggcgcggaggtcttcctgcactttgcgtgcgaagaggttggcttggttgtcgtcggcgttatcggacggccggtagatgatgatgacgtcggcgtcggagctgaagttcacttccctgccgccgtagcgtcccatgccgatgacggcgattgccgccggcgcttcgtcgagtcccatttcctgcgtttggtggcggatggcccaggtgagcgatgcgtagatggccgcgtcgtatacgtcggtcatacctgcgagcgacgccttgtcgtcgatgacgccgctcatccaccctagtccgatgcgttcgatttcgtggcgtcgcatggcgcggatggagttggcgaagtcgttgatgctgcctgcgttgcgttcgagtgaggcgtgtgtctgcacgtcgaggctttcgcgtgagcgtggctgcaggtcgttgtcgctgccgagccaggtgacggattcgacggatttgttgagcgcgtcgcccaggaaccgcgaattggacaggatgtggcacaggcgttgcgcggcggacggcgagtcgcgcaggaagccgaggtattcgctgtccgtgccaaagtgttcttcgagtttgcgccagttgagcagtcccatgtcggggttctgcccttcgccgagccattggagggcggcgggcaggaggatgcggttgattttcgcggcacgggagatgccggcggtcagtgcggtgacgtggcgcatggcggcgtcggggtcggcgaatccgatggaggcgaagcgttcctgcatggcgttggcggacagttccacttgttcgtcgtcgaggccggcgttgatgggcagcatgggccggtagtagatgtccatgtgcaggtggcgcacttcacgtcgggtttcgtcgtatttgtcgacgagttcctcggggtgcatgtggaaggcccgggcgagtctgcgcagttcgaggttgtggttgagttcgtcgtcgttggtgtcgcgtttgcgttcgatgccgccgagactggctttgccgaggtccgggaacaggtgggtgcgtttgagcgcccacatttgctggcggtgttccatgacgcgttcgaagcggtagtcccaggagagcttcttggcttgtctgcgtgagacgtatccgccttcggcgaggcgttgcagcgattcgagggtggagctggtgcgcagggtctcgtcggcgcggccgtggacgagttggagcatctgcacggtgaattccacgtctcgtaggcctccgcggccgagtttgatttcacggtccttcaggggcgcggggatgaggtcttcgactcgtttgcgcatctgctggcagtcgtagacgaagttgtcgcgtttggatgcggcccatacgaacggtcgggtcatgtccatgtacgcttggccgaggtcggggtcaccggccacggggcgggccttgagcagggcttggaattcccagttttccgcccactgttcgtagtaggcttcgtgcgattcgagtttgcgtacgagcgggccgtccttgccttcggggcgcagtccgccatcgatctgccacaatgtaggttcggcgacgcccatgatgacggattggcatacgcgctgcagggtggtggccattttggtgccgacacggttgagggtcatgccgttggtgtccgcgtccgccggttccaccacgtagatgaggtccacgtcggatacgtagttgagttcgcgtgcgccgagcttgcccatgccgatgatggcgaagcgcacgtgttcgctgccgtccacttcgttgcgggcgatggcgagcgcgccttccagggccgcgtcggcaagatcggacagttcctggctgattctcggctggatttcgatgggatcttccgcggtggtgtcctgcgccatgatggcggcgagctgttttctgtaggtctgtcgcaaggcagtcgccgcctccgcaaggggtttcgaggctttcggcgtgcggctgtcgacagggtcggcaccgaccgcttcgagcacatgtgcgcgccgctgggcgtggttgtacaggtggctttcgcatgagtcgctggctgcggccatgacgagttcggggcggaagcgcatgagcttgcccatttcgtcggacacgccgagcacggtgacgagtcgtacgagtccggcgtcgtcggtgatgacctggtggaagtcgcggccttggctttgcaacgctttgatgatgtcgacgaggttgcgtagcgcgatgtcgggctcgcaggtctgttccaatgttttcatcagcaggcatagccggtcgtcgtcgatgccgtcggcgcgcaactcgtcaagcagcgtgcgtgccgtgtccagatcctgcaatcctgcccgaatcagatcgagcaccccaaactgatgcgtagaagaagccatggttcccatagtaatcgtttatatccgtaagtatggcgaaagggatggtttccgacagctgccggaaaccatccctttcgtgtttgttgcatcgtccggaatcagacgaagaatggtttgacgttggaccagatgcgccggctgacgcatggatggttcatcgtgtacaggtgcacgccgtcgacgccgcgtgccgccaagtcgcagatctgttcggacgcgtaggcgatacccgcctctttaagcagcgcggtgtcgctcccccacttgtcaagcaggacggcaagtttttcaggaacacgcgattcgcacatcttcgacatgcgcagcaccgacttcgcgttcatcaccggcatgatgccggcttcgatcggaacgtcgatgccggcggcacgagccttgtccacgaatcgaaggaaatcctcgttgtcgtagaacagctgggagatgaggtggcttacgcccgcgtcgaccttcttcttgagattgtcgatatcctcctcaagcgtggccgcctgcgggtgcttttccggatagcaggcgccgtagatcttgagattaggacgcttctcgcggatgtaggccgccagatcgctcgcatggtcgaacactcccgccggttcggctccttccacacggtcgcctcgcaaagcgagcacgccggagactttggcttggtcgaacaggtcgagcgcctcgtccacgtcgtctttgtcaaggtattgcgcggtcaggtgcgccacggccggaatgccgtattcgttcaccgtatgcgcgatgcgtgcggtcaacgtgcggtcggacgatttgccggtgccgtaggtgacggagatgaagtcggggtccagcccctgcaggccatccaacgtatcgtagatggtacctacagggctggtgcgcttgggagggaacacctccagcgagaagattggcgaatgcatgtgattccttggaaatcttgcctgttattgccgatgccggttacttggcgagtttggcgcgcacggccttggccgctgtgacgaggttctccaggctcggccaggtttcggcgttgccacgggtcttcaggccgcagtccgggttgatccacaccttttcgacgtccatcttcttcaggatctcgtagatgcggtccttgatctcctgttcggacggaatgcgcggagagtggatgtcgtacacgcccgggccggcttcggtttcgaagttggcgtcgtggatggcgtcgagcaccacaaggtcgccgcgggaggcttcgaaggagatcacgtcggcgtccatcgcgtcgatgtccttgatgatgtcgttgaactccgaatagcacatgtgcgtgtggatctgcgtggtcggcttgacggcggaatgcaccagacggaacgccggaatggcccagtcgaggtacttcttgtgccagtcggtcttcctcagcggcagcttctcgcgcagtgcggcctcgtcgatctggatgaccttgatgccggccttctccaaatcgagcacttcgtcgcggatggcgagcgcgagctgctgggtctgctgctcgtgggtgatgtcctcgcgcggccaggaccagttgaggatggtgaccggaccggtgagcatgcccttcatcacatggtcggtgcgggactgcgcgtaggcgctccattccacggtgatcgggttggcgcgggatacgtcgccccacacgatcggaggcttgacgcaacgtgtgccgtaggactgcacccacgcgttcttggtgaacaggaagccgttgaggttctggccgaagtattcgaccatgtcgttgcgttcgaattcgccgtggacgagcacgtcgaggccgatttcctcctgatgcttgatgcaggcgtcgatctggtccttcatgaattcgtcgtattcggccttggtgatctcgcccttgcgcagcttggcgcgttcggcgcgcacttccttggtttgcgggaaggagccgatggtggtagtgggcagcagcggcaggttcagcgcctcacgctgctccttctggcgttcggcacgtgccggctgacgtacgaagtcggcgtcggtaaggcttgcgattcgcttggcgaccgcaggatcggcggcgacgcgggtgccgtcgaacagcgcctggttggctgcgagttcggcggatgccttcttctcgtcgtcggaagcgtcggcaagcacggcgacttcgtgcagttcgtcgagcttctggactgcgaaggcgaagtgcttgcgcacgtcgtcggcgagaccatcctcgccttcggtgctgaacggcacgtgcagcagggagctggcggtggagacggccacgttggcggtgacctgcttcagcgcgtcgaccaggccgaggctcacggcgtagttgttgcgccagatgttgcggccgttgatcacgccggcgaagatggtggtgttttctgccacgccgtacttttcgacggcggcgaggttttcgtccttgccttcgttcaggtccaggccgataccgtcgaagccgagcaggttgacggtttcgtacacgtcggcgatatgtccgaagtaggtgttgagcagcaccttgaccttgccttcgcgggcgggcaggatcttggcgtacaggctcttgaacagttcgacatcgcccggctccttgtcgagcacgaggtacggttcgtcgatctggatccactgcgcgcccagttcggcgaacttggcgacgacttcggcgtacaccgcggcgaccgcgttgacgaggcccttgtcgtagtcgagctcctcggcctgcggattgcgggcgagcttgaggaaggtgtacgggccgatgagcaccggcttggtggcgatgccgagcgccttcgcctcgttgaattcgtcgaacggcttggtgctgttgagcttgatgtcggtggcggagtcgatttccggcacgaggtagtggtagttggtggtgaaccacttcttcatcggcagggcggtcacgtcgcccttctcgccctgatagccgcggcccattgcgaagagggtctcttccgggttctcgaaggcgagacgctggtagcgctgcggaatgacgttgagcaggatggcagtgtcgagcatctggtcgtaatagctgaagtcgttgctcggaatcaggtcgatggcggcggcctgctgcagcttccaatgcttggcgcgcagttccttggcggtggaacgcatctcgtcgagggtggtgttgcccttccaatacgcttcgatgattttcttcagctcacggttctggccgatgcgcgggaaaccggagacggaagtaagagcggacatgaatcctccatctgatatgaacaatgcaacccgctcaagctatcacaaaaccgccagctataagacatcaagaaaatttgagtgtcgttataaactgtccttataacgcagtccgtatgccgtctatattcacacatttatgtttatggatcaataatgcagaacagcccggcaagcggatttaacgcaatgtcccgtatgcgtcggggtccacgggttccagccattcattcgtcgcgtcgcccgtgccatccgcaatcatgaacgccaaatggctgaaagcttcgtgaggggcggcgccgtgccaatgcttaacgtccggcggaatacggacggcctgtcccggttcaagctccttcggctcttcgccctcaagctggtagtagccacgccctccgaccgcaatgagaatctgggccgcgtgatggtggatatgccagtggttccggcatccaggttcgaacgtcacattgtggattgacacttcaggcgcgtcaagtaccggcgcaagccagctctgtccgtcgaaatactgggcgaaaccgtcatttggttccccaagagggaacgcactgggattgttcatatgggctttcctatccatcattctgaacatcggttcagaaagcaccatacaaccttgaagccgcttgaagtcaaatcacagcactctgcggaatgctcatcgttccgaatcagcccggaacacgcaagccctactcgaagtctttggcggtaagcagcgcgatgagttcgccgctgtgcagctgccactggttgaatggctcgttcgagccgaatacggcgatcgaggccggggacatgccgagattcagcaggtcaagcaacgtcggatcggattcggtgctggccagccattggcaggcgatcgaaatggtcggttcgtggccaagcacgagcagcgtgcgatgcttttccttggtttgcgcgagctcgtcgaacacggattgcacgccgccttcgtacaggctttgccggtagtcgactttcggatcgtcgccgaacaccttgagcatgcgatcgcaggtctgacgggcgcgggtggcgctggagcatgcgatgcgagtgggcaccattttgaacgccgccaatcctttggccacggctttggcctgcttacgtcctttgtcggtgagctcacgtcccacgtcgctgccgttgccgccgaacggctcggttttggcgtggcgcatcgccagcagcacatacttgtattccttggtctttttggcgaccttcttcaggctcgttcccataatcgcacgctccgatccggttccagcgccgcatttcaaatatctaatatccattgtctcagattttccgctgggacatggcatgaaacgctctaaatctactcctttatggcttcgacctgcgcgtcgaggtcacgcagcaccttgcgcagcttgcgatcggaaatgtcacgcaattccagatcctcaagctgttcggcacgctcctcgagcgtcaacgaatcgatgtcggtcgtcgtgtccttcgtggcacggtcgcgtttacgcaacgcctgaaagcccggagccatcgcgcgagaaaccatgaggaaaccggtgtgtccaatcatctggtgatcgggacggatggccagtccttgcgccttccaattacgttccaaagtctcctgaatgtccggctcggtccagcaaccggcctcgcgcaacgcttcggcaagacggctcaactgcgtggtggtggtgacgtacgcgacgagcacgccgccaggcgcgatcacgcgatacgcctgttcaagacggttccacgggtcaagcatgtcaagcatgatgcggtcgaaggagtgttccggcaaaccagccgcgaccgaatcgaaatcgccggtcctcaaatcccaccatgcgggacgttcgccaaagtaaaccgtcgcgttggcttcggcgacgcgcgcgaattccgaacgcatctcgatggtggtgaggcttccgccctcccccacggcatccagcagattgatgctcatcgcgcccgaaccggctccggattccagcacgttcataccggaacgaatatcaccgagctgaatgacctgcgcgatgtccttcggatacatgatctgcgcgccacgcggcatggacagcacatagtcagccaagcgcggacgcatgacggcgaactcccaaccaccgatggcacgcgtccccttccacggcttgttcgcgtcgcgttccggatgcgtctggttgacctgagcctcacgtttcgcactcaccgtcacgacaacggatccttccgtctggccaatcacatcatcatgcaggatgatgccatgcgaagtctgcgtcacaccacccggcaccagctgatcggtgattttattcgacctgcggtccgtaaactgcactttttcaccggcggcaagcggccctcgacgcatggttcacgctccttcgtacgttcgttcagtatacgatttcacgactatggcttacgattgcagaccgcattattccacggacagcaacgaacctatgctaccgtatccgccgtcataccggcagacggcacgaagcgacggcaatgtgacggcaacgtcaacatcacaccgcgtacgcgttccaacgaccattcgcatgcgtgaccttcaaatccaaaccaaacacctggctcaaccgttcagaagtaaaaccatgctccaaatcacccgtatacacgatagtgcccggcgccggatcgttgccggccacattatccgcatacgcgtccgcctcgttgccggtgatacgtcccatgatcgccacatggtcgaagccttgcggaatctcctcaagacggtgcgtcaccagaatcacggcgcggtcagactgctccgcaccaacacgactcaacgcacgcaaagcaatctcacgcccacccaaatcaagacccgtggtcggctcgtcaagaatcagcaaatcgggatccgccatcaacgcacggcagataagcacgcgagtgcgttcgccttcggaaagcttgaacatcatcttgccttccaggtattcgatgccgaattcacgcatcaatgagcgggctttggcgtaatcctcgtcagtataggtgtcgcgccaacggccggtggttgcggtcagcgccgtcacgatggcgtcaagaggatcttcctgcggtgggaacgcacgtccgagttcggccgagctcaaaccgatgcggttgcggtaggagaacacgttcactttgcccagacggtttccaagaatgtcgactgtgccttcggatgggaatccacgggtgctcatcatctgcaccaacgtggatttgccgatgccgttgggaccgaacagcacccatttctcgccttttttgacttccagattgactttggtgagaattacgcgcctgcggcgacggaattccacatcgtccagtttcaacgcgatgctctgttcgttcatggtcccctccattttcacaaaccacttggatgcgatgatgcctcctgccagcatagtgcgtcggcaggaggcatttcaggaatattctggctatcgatcagccggatcggttatccgcgatcagacaggttcggttctacttccgttcggcaagcacgtcctcgtagactttgacggtcttgtctgcgatggactcccagctgaagtggtcgcgggcacgctcgtaaccggcctgtcccatccgcttcgccttttcagggtcagccatgatgcggttgatggcgtcggccatatcgtgcacgaatttgtcagggttggtgggggtgccagtgccgtcatgcagttggtcgaccggcaccagatatccggtctcgccgtcgacgacgacttccggaatgccaccggtcgcagaggcgaccaccggcagaccgcatgccatggcttccagattcacgatgccgagcggctcgtagatggatgggcagatgaatgcgtcacagccatgttcgagtgcgttgagttccggcttcggcagcatctcctcaatccagatgatgttgccgcgttcctcgtcgagcttggcgaaggcggtcttgacctcttccatgatttccggcgtgtcgggagcgccggcgcacagaacgacctggatgttcgggtccacgaagtgcagtgcctgaagcaggtacggcagacccttttgacgggtgatgcgtccgacgaacagcaaggtcggtttgctgcggtcgatgttgtaacgttcgaacaccttccagcccggatcgtcatccgccggggtttcaaactggttcatggtgatgccgttatgcactacgaccaccttgtccgggtcaaggttcggataggcggtgaggatatcctcacgcatgcccgcggatacggcgatcacgcggtcggcatgctcgtaggcgtctttctcagcccaggagctcagattgtagccgccgcccaactgctcacgtttccatggacggaacggttcaagcgagtgcgcggtgatgaccaatggggtgtcatgcagcattttggcgagatagccggcaaggcatgcgtaccatgtatgcgcatggatgatgtcggcatcaacgtcgttggcgatttgcaaatcgacgccaaacgtcttcagcgcaccgttcgcatcctcaagctccttcggcacgtcgtagccgacgaccgtgagcgaccctttcgggtcggttccgggaatcgcgggaatgtcggcggccgcgcgcggcccgtcgaatgcgcggaccgtcacatcgacacgttccgccagcaccttggaaagctcttcggcatgcacccccgcgccgccatacaccttgggcgggtattcacgcgatagaatgtcaaccttcatgtctgtaatctcctcctcgagtcttccagcgtttcctgttctactgtaaaacatcagacacgaaaaacacttattgttttcatcgtttttcagaaagttccattctttttctgaaaaacgatgaaacagcattctcgcataccctttacggttagtcgaagtcaagtagcgcatacctaaaatccgatagaaaaagcggtgagacaaatgcttctggttgtctcaccgctttccatcgtttttgtgatcagacggctgttccgttttggtcgagattcggattgtgcttcgggttgccggccgtgaagaacaggctcagcacaccgactgcgaagacgatggcgactgtggagatgagccacatcggatgcgacggcagccacatgaccacgaggaaggcgatggccgacagcgcaatcagcacccagctggccacacggaaccattggcggacggaatggggtgccttgaacatcttcggattcttgtaatcaggattggtgttcaacacgttttccgtttccgtgatcgtactggcactcggcttccatggcccatcagtgccgtcctgcagacgacgtgacttttcctgcagctgatactcgtccaacatgccggaacgtgcgcggccttgggtttggtcgtattgctgtggcactcccctgcgattgcgcttggcttgggcacgtcgttctgcgcgatttggcattagtcactcctttgttgcatggtgctgggattactttaccgcattttgggtgaaaaacaggtagcccggctcactattcgcgagccgggctacctcgttcatacccttacaacagtgttgtctatcgcggcagcatcatcggacgcttggaagcgacgatcggtgccggcagttcggtggagccggtaaggtactcgtcgaccgcggcagcgcaggagcgaccttcggagatggcccacacgacaaggctctggccacgtccggcgtcaccgcaggcgaagacgccgtcctgggaggtggcgaacttgtcgttacgcgccacattgcctcgaccgtcaaggtcgaccggcagctgatccaccagcgtggtggtgtcagggtgcaggaagcccacggagataagcaccagatcggcgggaatcactcgttcggtgcctggctggcgggtgaacggcccgttctctcctggagcgacgttgacgaccttcagaccggtgacatgtccgttctcgtcggcgacgaagccttcggtggcggtgaagttctccaccttcaccttggccttgtcctcgtcggagccctcgaagttgaccgagtcggtgttgtacacgtattcggcgcgctgcgtttcgaaaccttccttcatggaggaggtttccttgtacaggcgggcgaaggtcggccatggctggttggccggacgctcctttggttcctgcggcatgatctgcagcacggtgacgtccttagcgccttgacgcagggacgtgccgaggcagtcggaaccggtgtcgccgccgccgatgatcaccacatgcttgccttcggcggtgatgtcgttgaccggcttgacaccgtacacgcgacgtgtggcgtccggcaggaactccatggcgaaatggatacccttgagatcacggcctggaatcttcatgtcacgcggcacggtggagccgatggcaaccaccactgcgtcgtagcgggaacgcaggtcatcccaggagatgtccttgccgatttccacgccggtgcggaacacggtgccttcggcttccatctgctcgactcggcggtcgatgaggcgcttgtcgagtttgaagttcggaatgccgtaacgcatcagaccaccgatggcgtcatcacgctcgtatacgaccacggtgtggccggcacgggtgagctgctgggcgcaggcgagaccggatgggccggaaccgaccacggcaacggtctggtcggtcagacgctgcggcggcagaggcttgacgtagtcaaggctccatgcctgatcgatgatggtgcgttcgtcgttctgaatcatcgtggccggctggtggatgccaagcacgcaggcggcttcgcacaatgccgggcagatgcgaccggtcacttcggggaagttgttggtctcggacagacggttgtacgcgtcctcccacttctcctgacggaccagatcgttgaactccggaatgatgttgccgagcgggcatccgctcatgcagaacggagtgccgcaatccatgcagcgggccgcctgctcggtggtccaggactgcaggccggattcggtgtgaacgtcgaaccagtccttgattcgctcttcaacggggcgttcggccagttcgcgacgggtacggaccttcaggaatccacgaggatctcccatgtcagcgcgctccttccataacctgctcgtacacctgttcccagacgccgggcgtattgaaatcgatgttcttctcctcggcttccttcatcgccttctgcatggcgaggaagtgcttcggaacgatgtgggtgaatcgcttggcgctgttttcccagtcgtcaagcagagccttcgcgaaggcggagccggtctcttcggcatgctgcttgacgagaccgtgcaccagcttgtcggcatcggtgtcaagcggctcgaacatcagcgcgccgttggtggcggccgccgggttgacctgcttcatgtcgaggtcgagcacgtacacgttgccgccggagaagcccgcgccgaggttacggccggtggagccgagaatcacgaccgtaccgccggtcatgtattcgcagccgtggtcgcccacgccttccaccacgaaggtggcgccgccgttacgtacggcgaaacgttcgcctgcgcggccggccacgaacatttggccggaagtcgcgccgaagccggtgacattgcctgcgatcacgttctcgtgcggatcgaaggtgatgccgtcctctggacggaccaccatgcggccgccggacaggcccttgcccgcgtagtcgttgacttcgccgtagacgcggatggtttcgccacgcggaatgaacgcgccgatggactggccgccggcaccatggaacgtcatgtcgatggtgtcgtccggcagaccttcctcgccgtagcgcttggtgatctcatagccgagcatggtgccgagcgtacggtacacgttgcggatcggcatttcgatacgcacgggctccttcttgtcaagggctggctgggcaagctcgatgagcttgttgtcgagcgccttgtcgagctcatggttctgatcgatcgtcttgtgcaggatggttcccggaaccggacccggctgcatgagcacgttgctcaggtcgatgccgtcggacttccaacgcttgatggcttcgtcctggtcgaggcattcgacatggccgacggcctcttccagcgtgcggaagccgagctgcgcgagcagttcgcggacttcctcggcgatgaacatgaagaagttgacgacatgttccggcttgcccttgaagcgtgctcggagctccggatcctgggtggcgatgccctgcgggcaggtgttcttctggcaggcacgcatcatgacgcagccttcgacgatcagcgcggcggtggcgaagccgaattcctcggcgccaagcagcgcggcaatcaccacgtcgcgaccggtcttgagctcaccgtcgcactgcacggtgatgcgggaacgcaggccgttcagaaccagcgtttgctgggtttcggacaggccgatctcccacggggtgccggcatgcttgatggcgttgagcggagccgcgccggtgccgccgtcatagccggaaatcagcaccacatcggcatggcacttggccacgccggcagcgatggtgccgacgccgaattcggagacgagcttgacgtggatgcgggccttcggattggccatcttcgcatcgttgatcagctgtttcaaatcctcaatggagtagatgtcgtggtgcggcggtggggagatgagctccacgcccggggtggcgtgacgtaccttggcgatccacggcggaaccttggctcccggcaggtggccaccttcgccaggcttcgcgccctgggcgagcttgatctgcaggtcggtggcatgcaccagatagtcgctggtcacaccgaagcgggccgaagcaatctgcttgatcttgctgtagcgcagcggatcgttgatacgatcctcggattcgccgccttcaccggagttggagcgtgcaccgatcgtgttcatggcgatggcgagcgtctcatgcgcctcctgggagatggagccgtagctcatggcgccggtggagaaacgcttgacgatttcgctggccggctcgacttcggaaatgtcgatcggcttgcgggtggacttgaacttcatcaggccacgcagcgtcatcagacggttggaggtgtcgttgatgtggttcgagtacttcttgaacaggttgtagtcgccgcgctgggtggactgctgcagcaggaagatggcttccggatcgttcagatggtcctcgccggtacgacgccacttgtagtcgccgccggtacgcaggttgcggtgcgggcgggcggtccattgggtcggataggccacgcgatggcggctggcgacttcctcggcgagctcgtcgaggccgacgccgcccacacgggacgtggtgccggtgaagtactcgtcgatgacgtccttgttgagaccgaccgcttcgaacagctgcgcgccacggtagctcatgatggtggagacacccatcttggccatgatcttgagcacgccggtggacagtgcgcgggtcaggttcttcacggcggtttccgcgtcgaccttgaggtagcccttgcgggagaggtcttcgacggattcgaatgccagatacgggttcaccgcggcagcgccataggcgatcagcagtgccacatggtggatttcgcgcacatcgccggcttcgaccaccatggagatctgcgtacgcgtgtggcggcgcagcagatggtgctgcactgcggaagtgagcagcaacgatggaatcggaccccacgcatagttggaatcgcggtcggacagcaccaggaagttggcgccgttctcaatcgcctcgtcgatctcctggaagatctcgtcaagacggtccttcagtgcctgtccgccgccggccacctggtaaaggcccttgacgatgaatggcttgtaatagccaccgagaatcttggcgcggtggaggcgcttgagctgtgccatctcgtcggagttgagcaccggcagcgggatgaggatcttcttggcgtgcagttcggaatcggccagcaggttcggctcgggaccgatggcggattcgaggctggtcacgatcttctcacgttcccagtcgagcggcgggttggtgacttgcgcgaacttctgggtgaagtaatcgaacagcatgcggctgtgcttggacagcgcggcgagcggcgtatcgttgcccatggagccgagcggctccttgccggtgttggccattggggcgagcagcagcttcagatcttcctcggtgtagccgaaggcgcgctgacgacgctgcacggactgaccggagtggttgacgtgctcgcgcttgggcagctgactcaattccacggagttgccttccacccacttgcggtaggggtgctggctggcaagagtcttcttgatttcctcgtcggggatgatgcgaccctcgtcggtgtcgacgaggaacatcttgcccggttccagacggcccttggtgacgatatgctcctcggcgacttccggcagcacaccggtttcggacgcgagtacgacataaccattgtcggtgacctgccaacgtcccgggcggaagccgttacggtcaagcagagcaccaacctgggtgccgtcggtgaagatgatgtgcgccgggccatcccatggttcgatcagcgtgttgttgtattcgtagaaagccttgacgtccggatcgagctggtcgttgttctcccatgccggcggcagcatcatggagatggcgtgcggcatggaacggccggcgaggtgcagcagttcgaggcattcgtcgaaagtgccggaatcggaatagccgggggtggcgatcggcagcagcggcttgaattcgccgagcagttcggaactcagtcggccttcacgtgcggacagccagttgcggttgccttggatggtgttgatctcgccgttgtgcgccagctggcggaacggctgtgccagcggccagcttgggaacgtgttggtggagaagcgggaatggacgatggcgattttcgccttcatgcgttcgtcggacaggtcaaggaagaagggcttgagctgcatggtggtgagcatgcccttgtaggtgatggtgcgggcggacagggacgcgaagtagatgcctacctcgtgttccacgcgcttacggatgcggaaggtcttgcggtcgagttcgatgccaccgagcttgccttccggatcggccacgatcagcgtcttgaacgccggcatgctggccagggcctgcaggccgagtccgtccggattggtgggtacgacgcgccatgcgagcacttcgaggccctcttcgcgcacgatcttggaaatggcctgctcctgctggccggaagtggcgatgtcgcgatccaagaaggcgatgcccgcggcgtaatgaccttcttcaggaagctccacaccggccgtggcacgcatgaattcgtcgggcatactcatgagaatgcctgcgccgtcgcccgtgttctcctcggcgcccacggcgccacgatggttcagattgaccagcacctcgatggcgtcatcgacgatcttgcgttccggacgcttgttgagggtggtgaccatacccacgccgcaagcatcatgctcggctccaggatcgtacataccttgggaatcatggatcgtcagatctaacggggcgtggaaagtcaccgaaaccaccttcaatgtttttgggcaagaaaagtcttgcggttctttaatgcgtggtttagaataccgcgccagtatgtcagcaacgttgcacgtgtccatataacgaatggctatttttgtcaatgcctcgcagaggatttagcccatgaacgcatacttcgcatgtcatgctcatgcgcacgcacttcacttatgctcattaacccggtcagtccagtgtttccaacagctccgtgatgatggtgtcgttgagcagtcggcctcgcaaagtgggtatggcgcggccatcaagcattgtgatcagcccgtcgtgttcaagctcaatccatttttgttcaggaatcaagtggctgaattgtctggtgtcgagtccttcacgaatgcgcaggcccaacatgatggtctcttcgatgtcctcggcggcagtgatgcgttcactgccggcccatggcacattgccctcattgatggcggtgccccacaatcgcggatgcgcgatatcccaggagcgcaatcctttgccgtcttcgcaatcgccataatgcgaatgcgcaccgggaccgagaccggcccaatcgacgttcctccaatagccaaggttgtgttgcgactcgtatccgggacgagcccaattgctaatctcataccattcgaggccggcttcggtgaacatcgtgtcggcgatttcgtatttgttcgcttcgtcgtcatcgtccggtctcgacaacgtgcccgccgcgatctgtcgtcccattttcgtattcggcgcgatggtgagcgcatatgcggaaatatggttgacacccaaatcgatggcggtgcggacggatgtgcgccaatcgtcaaggctctcccccggcgcgccgtagatcagatcgacgctggaacgcatgcctgctgcattggccgctgcgattccggcggcgacgttttccggcgtatgcgtacggtcgagcgttgcaagcacatgcggtaccgcggattgcatgccgaaggaaatacgattgaaaccgccgtctgcgagttctttcacatagtcggcattcaccgtgtcgggattcgcttcggtggtgatttccgcgtcatcggcgatgccccatgtggcgcgtaccgcatccagcatggcgaccaaatcgcttgccttgagtgtggtcggcgtaccgccgccgaagaagacggttgccaccttcggctcgttgataccgtgcgttgtctgccaatcgcggacaatcgccatttcgcggataaccatgttcgcgtagttgccgcgtgacgcgcccgcgcccatgtccacggccgtgtaggtgttgaagtcgcaatagccgcagcgacgtaagcaaaacggaacatgaatgtagatttcgaacgtcacgaaaggctcaaccttcggacttctgcgcggcgcgaatcttgtccttggtgtcgcggtcgttgcccgctccgccggtggacagggctgcgatgaacgcctcctgcggcacttccacatggccgagcatcttcatacgcttcttgccggccttctgcttttcgagcagcttacgcttacgggagatgtcgccgccgtaacacttggcgagcacgtccttacgcagggcgcggatggtttcgcgtgcgatgattcgagaaccgatggcagcctggatgggaatctcgaactgctggcgcggaatgagctcacgcagcttcttggtcatcatcacgccatagctgtacgccttgtcacggtgcacgatggcgctgaacgcatcgactttctcgccttgaataaggatgtcgaccttcaccagatcggcggactgttcgccatcctcgtggtagtcgagcgacgcataccccttggtacggctcttcagctggtcgaagaagtcgaagacgatttcggcgagtggaatacggtaatgcatttccacacggtcggcggaaatgtattccatggtgcccatctggccacggtggtcttggcacaggtccatcaccgcaccgatgaaatccttcggcgtgatgatgtcggcggcaaccatcggttcgacgatcttcttgatcttgccttcggggaattcgctcggattggtgacgcgatgcacggaattgtcttccgcggtgacctcgtacggcacgttcggcgcggtggagatcaggtcaaggtcgaattcgcggctcaaacgttcggtgacgatctccatgtgcagtaagcccaggaagccgcaacggaagccgaagcccaacgccacggaggtttccggttcgtagatgagggccgcgtcgttgagcttgagcttgtcaagcgcctcgcgcagttccggatattgcgcgttgtcgattgggaacaggccggcgtagaccattggttgcggatcacggtagccttcgagcggctcggtagccggatttatggcggaggtgatggtgtcgcccaccttggactggctgacgtccttcgctccggtgatcacatagccgacctctcctgcgccaagcgccttggtgggcatcatgtcggggctgatcacgccgatttcgatggggtcatgcgtcatgccgatacccatcatgtgcagtttctcgcgcgatttcagttcaccgtcgaccatacgaatgtaagtgacgatgccacgataggagtcgtatacggagtcgaaaatgagcgcgcgggcaggcgcgtccgggttgcccgccggcgcgggcacttcggcgacgatacggtcgagcagttcggcgacgccttctccggttttgccggagacgcgcaacacgtcggacgggtcacaaccaatcaggccggcgatttcctcggcatgcttgtcgggttcggcgctgggcaggtcgattttgttgagcacggggatgatggccagatcatggtcgatggccatatacaggttggacagcgtctgcgcttcaatgccctgcgtggcgtcgacaagcagcaccgcaccctcgcatgcggccaacgctcgggacacctcgtatgtgaagtccacatggccgggggtatcaatcatgccgagtgtgtattcggtgccgtcaaccgtccacggcacgcgcacggcctgcgatttgatggtgatgccgcgttcctgctcgatatccatgcggtcgaggaagcgatcgcgcatctcgcgctccggcacgatgccactcaactgcagaatacggtccgccaccgttgatttgccgtgatcgatatgcgcgatgatgcaaaagttgcggatcaacgactgatcggtgtacccgggctgattatgctgttggcccacgccatcctcctctggaaatattcgacgcaaacgattctaactggtagtgtcggcatgtccttccgcgacactcttatacgcattggcgatttatccgcgtgccatgttatcatcatcgtttgtatgtccttatagcaaacgtcgtttggagaaatagtggcaaacatcaagtcgcagaagaagcgcgttctcaccaacgagaaggcgcacaagcgtaacgtggccgtgaagtccagcctgaagactgccgttcgcgccacccgcgaagccatcgccgctggcgataaggccgccgccgaagccgcctacaaggtcgcagcccagaagctcgacaaggccgccggcgctggcgtgatccacaagaaccaggctgccaaccgcaagtccggtctcgctgtggccatcaacgctctctgagttttcgtaactcacagcttgtaagaagccccgcaggaaaacctgcggggcttcttcttttttacatttcgtactctgttgaaaatgctcacttacgcttgatatcgtcatcattccgatcgggatggatgaccggacgtttgagatatttggcttcgctcggcaggtaggtgttatgcctggccaaagcccccggcaattgaatgtcgaaaaacacggagataagccgcatggccaccatcagcaccacaatcagcacatcaagcaagacttcggcgggaaaactgacgattccctcgttcactcctttacatacgagtaccgtcaatacgcatccaacggctgaaggcaccgcgtaccaatgcttgtcgcggatcaccatgggcacctcgttgatgagcatgtcacggatgagtccgccgccaagtgccgtgaacatgcccaggaacactgccgtggtgccggacatgtggtacatcatggctttggatgtgccgttgacggcgtaaaggcccaatgccagcgcgtccaatgacagcatggaccatttgagcttgtcgacttcgggataaatgatggctacggccacagctgcgagcagtgcggtgatcaccagccctttgtcggagacgcctgcgggaggaagcgctccgagcagcacatcacgaatgatgccaccacccaatgcggtgagccatgtggtgacgagaatcgcaaaaatatcatagcctttgcgtacggcggcgagcccgccgaccatgccgcagcagaaggtcgccagatattcgatacctatgaagaagccgttgctttccagcgccacttccatggccactccccttccctcacatattttcttttccaaccagctgttaaaaatagcacaatatggggcaagagctgcaataaaagagccggagggcggcacgtacattgtcagaccatgtgaattggcctgaagcacgcgccaccctccggcggccattacagctatatgtcagctaataatcgctaacgggaaaatcagcagaccttccacatccagttgtgtgggtcttcgatctcgccaagctggatgccgagcagctggttgcgcagtgcgagggtgaactcgccggaaccgccgtcggcgacggtcacatcgaacttctcggacttgaagcgaccgatcggggtgatgatggcggcggtaccgcaggcgaacacctcggtgacttcgccggacttgatgtcctcaagcagctggtccagagcgatcatggtctcgaccacgtcgtggccgttgtcctggatgagctggatcagggagcggcgggtcacgcccggcaggatgttgccggtcagggacggggtttccacgtggccgtccttgtgcacgaccatcatgttcatgccgccaagctcctcaaggtaggtcttggtggcggcgtcgacgaagcacacctgctggcagccgtggtcgatgccggtgtactcaccaagcagggatgcggcgtagttgccaccgcacttggcgaaaccagtgccgccagggccggtgcggaaccacttgtcttcaacccagatgctgaccggcttcacaccgcccgggaagtacggtccggacggggaggcaatcacgcaataatccacttcctgcggagcgcgcacgccaaggaacggctcggaagcgaacatgaacggacgcatgtacagcgtgtattcgcgacgggacggaacccaattcacatcgcgcttgacgagggcggcgacagagccgatgaagtcgtcgatcggcagctccggcaggtacagacgcttggcggagttctggaaacgctcggcgttcgcatccggacggaacagccaagtggagccgtcggcgtgacgataggccttcagaccttcgaagcattcctgggcgtaatgcagaacagatgcgcccggatccatcttcagcggcgcgtacggctcgatgcggcggtccgaccagccttcacccttggtccaggtcatgtgggccatgttgtcggagaagacctgaccgaaagccggcttgtcgatgagttcggcgcgcttggcgtcggatgccgggttgtcgttcgggagcacggtgaacttctcggcgagcttgtcaagctccgccgaatcgtgatgattctgttcagtcattctttacttcttctagttgcatcagccacccaaaggcggccagcggttattggtctccggcgcttgtggcgccgggttctggtatgtactctctcacaccataaacgctttcgataaccggcgttcgcgatatgagataacgatcctcataaagcaggaaggggcccatacggaccccttcctcaccggctacctcatgcttgtggagcagccagtatagacaacgatacggctcactcagcgtcagcagccggagcggcctcaaccggtgcggcatcttccggcacctcgacggtgacgacggattcttccggatcctcgacatcgagtacgacgccttccggcagcacgacgtccttggcgaagaccttggaaccatcggtcaggccatcaacgttgaccacgatcttctccggcaggttggcgacatcggcgcggaccttgagctcctggatgtcgacgaatgcgacagcagcgcccttcggggtgccttcgacgaacaccggcacctcgacgtcgatcttctcgccggccttgacctcgtagaaatcgacgtgctcgacgatgcgcttcaccgggttgcgctggacgtccttgacgacggccatcttggtctcgtcaccatacttgatggtgaacagggcgttggtgtgacgcagagccagagtggtctccttcatcggcagctgcacgaaggtcggatcctcgccgccggcgtaaacggtggccgggatgaggttcgcgacgcgcatgcggcgggcagcacccttgccgaactcggtacgagcagcaccttcaagagtgatggtggtagccataatcaatatctccttgatacatcgttcttatgtttcggcgcaccgacgagccgcataaaaaacccaaggagtttcatatcatacgccaagtcgataacggaggcggaacctccctcgccaagacaacagttatctagtatacatggtgcgctgacatttccctgcaatcagaggagcaaggtgcataaaacgcggactatgcgcaaacccacgtacaatcgtagtcagacaagcaccaaccagtggtaaggaatcagaaaatggcaacgacgcatgaccattccgcgctcatccgcaacattcagctcgcgactggcgtcacgaccgtcgcagcgacgggattgttcgcggcgtcagcacatatgctgttccgctttgccatcgacacgcagtggaagcattccattttccatcaggcgctgatcgctccggatcgcgagggaaagatgaaccaaggcgaggccaaagaggccgagcaatggttttccgaaacgaaacagccggtatccatcaccagccgcgatgggcttaagctgcatggctggctcttcgatccggattgcatcgacccgacgccgcatatatatgccatctgcgtgcatggctataccggagcccctgaagaacaagccaaatgggcacaccgctatgcccgcatgggcttcaccgtcctcgcaccatcccaacgggcccaggatctgagcgaaggacgatatgtaggcatgggatggttggagcgcaatgatctgcttgattggatacggctgattgtggatagcgacgatcaagcacgcattctcctattcggaggatccatgggagccacgacggtgatgatgacgaccggcacgccggaactgccacgcaatgtcatcgcggcaatcgccgaaagcggatacacttccgcccgcatggaattcatagacagcgcgcgaggcatgttccacatgccaaagcttctcgcctcggcatgtgtggacgcggcgggtctgatctgcaagcgccgtgccggctatgatttcaccgaagcgtcctgcataccgtcattgcggcatacggtcattccgatgctgttcatccatggaggaaaggaccgcatggtcagcccacgtttcctcgacatgaactacaacgcctgctccagcatcgaccgcgaacgtctgctggttccggacgccgatcatatggaaagctccgccgtggatccgaaacgctactgggacaccgtatacggattcatccgtcgttcattcaagatctgacagccgaaccccaaaaaatataagcggtaatggaaacgcctccggcgaaagatggcgcccctcaccgcccgaagttctcaagacatgcccgatgcccgttccgtcagtgccgttctcccggattgcatatctgcatggcgacgccatcctccataatatggaatccatgcttctcatagaacgtggcattcttgctttcctcaggcataacctcgatatacaggtaatcgtggtaccgctgcttgaccatgccgacaagatgtccggcaatgccgcgcccttggtattcaggatcgaccagcacatagtgcatgtatgccaccatctccgtgtcatcaagcactcgcaccagacccaccagacgttcgccatcccatgcgctgaatacggtggatgaccccatcaacgccttatgcaaccgttcaggatattgaccggacacccagccgactgaaagaaacagtcgctgggtctgttccttggtgaatttcttttcatccgtatatgtgataaccatatggcaagcatagaattgccggtatgaaaccgtctccttctatctttgcatacgaaacacaagtgtctcggccactcccctcatgtatcgaagtgcgcggagcccacgtacataatctgaaagacgtcgacatcgacatcccgctcaacagcatggtcggcatagccggaatctcaggctcaggaaaaagctccctcgcgcttggcgtgctgtacgcggagggatcacgacgctatctggaagcgctatcgacctatacaagaagacgtatgacccaggcaagccgcgcaaccgtcgacgaggtgcgtcatattccggcggcattggcactgcatcagcgtccatcagtgcctggagtccgttccacgttcggcacaatgagcgaactgctcaacagtctgcgcctcctgttctcccggatcggatcgcacgtgtgcgaacactgcggagcacgcaaccaacccacgatgaacgttgccgccgagcttccgatgcattgcacgttctgcggcggactcatgcatccgccatcagcggaggatctcgcattcaacgccgcgggcgcgtgtccgacatgctcaggcaccggaatcatgagggaagtcgaccgttccgccttggtaccggatgagtcgaaaagcattgacgagggagccgtgctgccgtggggatcgttgatgtgggatttgatgaagcaagtatgcggggccatgggagtacgtaccaacgtaccgttcaaccaactcaccgaacaagaacgagatatcgtgttcgccggcccagccatcaagaagcacatcctatacaagccgaaaaaaggcgacgatttcgccgaactcgacttcacgtactacaacgccgtatacaccgtggagaacgccctcaccaaagccaaggacgaaaaagggcttaaacgtgttgcgaggttcctcaaagagcgtccctgcagcgattgcggagggaccagactttccgaacgcgcccgccagccacgtatcagagacatcaatctggctcaggcaaccgcgatgtctctggacgcactcgtttcctgggtagggtccgtgccggaatcgctggaaccacatatgcacaccatggcgagcgccatctgtgaatcgttcctcaatacgtcacggcgtttattggaactcggtctcgggtatctgtccttggaccgcgccggagccacgctgtccaccggcgagcgccaacgcgtgcagcttgcccgcgccgtgcgcaatcgcaccacaggcgtgttatatgtgctggatgagccgtcgattgggttgcatcccgcgaatgtcgacggactgctcggtgtcatgcgtgacctggtggctgatggcaattccgtggtagtggtcgatcatgacactcgggtgctggccgaaaccgattatctcatcgagatggggccaggtgccggcgcaaagggcggtcaggtgattgcgcagggaacggtgccgcaggtgattgatacccgcgaatcgcgcatcgcgccgttccttgcccagggtggcaacgttcatgaccgtgtgcgtgacaacattgacgcccatgaaatcttctccgcaggacgaattcatatggaaaccgaccgtctgcataccgtcggcccgttatcggtagatattccccgtggacggctgaccgccgtaacaggggtatccggttccggcaagacgacgatggtactggagatgttgatgcccgctttgcagtcgcggatcgacaggtcgccgcagccgacgcaggtgcggctcctcgaggcggacggtgtgtccaaggcacatcttatcgatgccacgcctatcggcgcgaacatacgttccaccgtcgctacatattgcggcgtccatgacgatcttcgacgcgcgttcgcaaaaacagatgctgcgcggaccatcggtctgaaagcgggggcattctcctataacactggcaagctgcgttgcgcgacgtgcgacggcacgggatcgatttcgctcgacgtgcagttcctgcctgacgtcgatatcgaatgcccggcatgccatggctcgcggtattccgatgcaatcgccgagctgaagctcccctgcaccgacggagtggcgtattcgatgccgcagttaatgacaatgaccgtcgacgatgccatgcctgtcttacgagatgtcaaaccgatccaaacgaagcttgccacgttgcatgaattgggtttgggctatcttgcgttgggcgagccaactcccgcgctgtcgggcggtgaggcccagcgtttgaaattggccagcgagatggggcggaaacagcatgatgcggtattcgtgttcgatgagccgacaatcggcttgcatccgcttgatgttcgcgtgctgctgcacgtgtttgatgaacttgtagcgaatggcgcgacggtggtcgtcatcgaacatgatttggacgtgattgccaatgcggactatgtggtggatatgggaccgggcggcggtgaagcaggcggacgcgtagtatgcgagggagcgccttctcggatcgccgcatgtccggaaagcgtcactggacgatacctacaatcgtcgcaatgctgatattgtcccatcttcgggcatctgcagtcagtctgatgatgggacaggcagttcccgccatgcttgaagatgatgcagcgcacgtacgatgttgcattgatcaagtaacgtcccttcagcggcgcacatggtgggataccacatgcgatggcggagcgtggcttgtttgccagtacctttgatgagttcgccttcatcagaggcatattgaaaatgcagatgactgagcagtcccccgtgtctgagcacggagcgttcaggcatgggctccatcgcgatgagtacggcgaagggatcggaggcaccggcatcgctagcgtggaacacatagcagggtttgccttccagccccttgtcgtgcacatgatcgagccgatattcatgtgttgtgatgggggtgcgtttttcgtccagccaagtcaggttaaagcctgcgacagcatcatcgtcgccaactgcggacggctgctcgatatgccatccaccaatgcggaatcgccactccttgcccgaggttttgcaggcttttgcccagaagcgtcgcgcatcgccgagcatcatgatcgcgaacagcggcttggatcgcatggctttcgtcgaatccttccaagcccggtcaaggttcgggtcatgattgttgatcaaatgttcgaagctaatccagtctcccagccaatcgttcacattgaagtccatgccagacgatcctcttcttctccctgttcgttatgcagttcgtcttccagcgctatgatgcggtcgcaccatagcgctgcaagctcataatcatgtgttacgaccaacaccgctttgccacggtccgcgagctttcgcagaagtccgccgacttgggtcatatgcaaccggtccagtccgctggtcggttcgtccaaaacaatgaatcgcttatcgctcatcaaagcgcaggctatagccagcctctgcttttgaccgccggataaactcatcgggtggcgctgcacggaatccaataggtcgaggtctcgtagcacagcatcgcatcggtcacgcacagcgtcatccatcccatcaagtcccagtaatgcctcttcccgaacactatcggagaagagctggtaattgacgtcctgcatgacgagaaatccggcacgagtcaaagcgccgcggctcgctttcgtcccattcaatagcaccatgccgttcaacggagcggcaagaccgcataacgtacgtgccaaagtgcttttgccaaccccgttcgaccccataaggccaagaatctcaccctcgtgaatgtcgaaatcgggaatatcacgtgcgaatacgggtgtcttgcggcctagaagtccccgctttgtatggcctacactcaggccgcgcacaccaatgacgacctgtcgcttgtcctcgtcgggcgcaatgcctccatgttggagtttacgatgcacggcaagcctgtatggtctgtcatcgagggcgcgcaatcctaatgccgcgacgcgctgttcggacatcgccagaaaatcggacgcctcatattcaccgagaatcgtaccgtgatcgaacactatgaaacggtccgctaaatccgcgcaccatgcaagacggtgttcggcaatgacgatggtcattccatcagctctcaatcgggagaccatgtcatgcagcctgcgaatcgccaccatatctaaattacttgtcggctcatccataacgatgagtccaggagccagcatggtcgatgccgcgacagcaagctgttgcttctggccacctgaaagcgtcatgatcctacgacctaatagatgcctgatgtgaaactgctccgcgacatcatgcacgcgttgccgaatccgcgcgggagacatgcccgtattctcgcaggggaatgccagctcatcggtggaatcagcattgaaatactgcgtcttcggattctggaatacgctgcccacctgtcccacatagctttccacaggagccaatccggcgcggattccgcacgtcatatggatgccctgcaaatcgccggaatagaaaccaggtatcagaccattgagcaaacgtgtgtacgtggttttgccacagccgctttgtccacataagatggcaatctcgccttgcggtatggcacagctgatgtcattcagcgcatcgacctcagcagcttcatcagcatgatatgcgaatgagcaccgttgcgtccatgcgactatccgattgatatcacttccgatactcaccatgctcctccaatgcccaatgccagaggaaccgtgcagatgaccatccatgcccaatcaatgccatgcatgcggatttcggtatgacatgtatgaggcccgcgaatgccgattcctttggtcagtgcggctacggacaaatcctgggcgacccccgtagcgttcatcaacaacggcatcaggatgtattccaaagactgagccggatgacggagcagggcgaatgtcccctgggcgatgccacgtaatgccatcgcgtcacgaatctgatggtaatcgtcatggattgtcgggaagaaccggatgcacaccacacatggaatcacaatcgtctccggaatgcgcatgcgccgcagggcacacacgaattgactggccgtagtcgtggtgaatgcgtatatgccggcaatcagacaaggcatcatcatccggatgccgacacaaagcaaaccaagcatatgcaaccagctgccgccatcgtcaagcgtcgatgcccaagtccccactagtagcaatacatagatgcaaccgaagcgtaccgcagccgcccatcgtcccgcgccgagcagtggcagaagaagcagcaatactgtaagcgactccacaaccacgtcgacatggaagaacagcaacaggttggccaatgccactaggtacagtttggttcttgggtccagggccatcagatgatgccggtcttcgcaaaatgcttcttcagcatacgctgcccaaaccagcctccgagcaacgcacataccagtaccactatcatggcaatgaaaaacgtgccggtattgacatgtgcgaacacaccatcgatataggacgagtccttgccacgggcctgcagactggccacataggcatccttcatgaaccacaacggcagaatcggaccggtcagcccatagcagaacacgacataactcgccaggatacctgtcttgctccgatagtccccggcgcgagcgatggcatcagcgatgaccggaaacacgatgctcgcagcaagggaaaggatgaaatgtccggatacgaacaagaacaatccgacgacgatgcccatcacgctaatcgcgccgaattttccgaccttggcaaccaggagcatatatacgcaaccacagatcaatgcggcgaccgcaggcagaagaatcatgccgaatcccatcaaagccacggaactgaacagcgtggccacggcgaccagcacgaaatacaaggcagtgaacacacctatcgtgatgagatcgggaatggtcagatgcctcgacttggtcgacatgccctgctgcgtcatggtcagtcctttcgattgtcatgggcggccagccaccaatgtatcgaggaaacacggaaaagacaatagtttttcctcgttttcatggaaaactatccaatccgcgtcgcggtaatccataaaccatccatacccagagacaatgaaacgacgccccgagtcaacgtcctcgctccagtctcagacgacaaggcaatatcccaatgccgcggccatcacaggaaccaccaccgacgtcagcacatatcccacgaacacggtgatccgcccaccgcgcaacaacgtcacggattcgttcatcatggtggagaatgtggagaatccaccaaggaagccggtcgccaacatcacatgcgcgggatccgacagaaaccggcgtgagtacagacctgcaatcacgcctgccaggaatccggcaatactgttgatcacaaaggtcgacaaaggaaatgccttatgccaagaagctttgataacggaatcacaaacataccttgcggcggcgccgagaccaccacacaggcacaccgatacggcgatgaccgcattattcatcagtccgcctccttgcccatggcatggcgatcaccatcgttatgctcagtaccggcaaaccgcagcccgacatgcgcgccaacgtatgccagcagacagcccacgatgaaggtcgtgcaacaatacgccgcacaatccatggctttgccgtcatgcagcatagtgaattcctcgagggcgagagtggacatggtggacaatcctccacacatgcccatgccacatccacggttcacatattccttcgcgcgtcccacggttctgcgggttcctcccagccatgccgaaagcgccgcgtatacgaagcaggcggccatattcgccgcgaatgtgccgatatggaatgcgccgcagtcgggaatgaccgaacaagcgtagcgtaatgcggttccgatgcatcccccaaggaacaccacgcatatgagatcgactcgaatgatatgttgtcgtgccatgtatcttctttccagcgaggtgccgaaccaatatgacagacatggaagaatggcgatgccacaaccgctgaaagccataaggtacagcacaccctatgtcgtaggaaccatcagcgggtttgcggttcgaagcctgtaacggcttcaggcgagtcccatcaccgcagtccagtatatccggcacgcgaggccgtccgtaccatcattcacgatgcggacaacttccccggactaccgcaacgtacgatccataaccgtcgccaatagcgcggcgacccccaaaaccgcaactgtgatgccaatgccgtggagccctccatcagtgaccgtctcaccgaagaacacgccactcaatgaggacgcaccgatagacccgatatagatggacgtgcgcagcagaccagacgacgtgccaatatgctcggatgccgctcggcgatatagcacggtctgactggtcgacatgctgagtcccaacaccagtcccgcgacagcggaggcggtcaacggcaatacgaccatgccagcggatgacgtgcaagccaacaacatgcccaccgccaccatcgccgaacagcacaccatcaacggcaggcgcactatcggcttcttcgcgatggataacgaagccactgtcgccaccacccccatcggaatgatgaacatgccggaaacaccggcgttcatatggcaggcatcctccaaccactggggcaaggcgtacatgaccacataagcgccaagcatggtgagcatcgcacgcagaaaattcaacgtcatcgcattatccgccgcgagtgaacgcacatcgacgaaaggcgttgccgcatgcaactcccacgcgacaaaagccaacaaagcgatgacagtgacgcaaccggacaccttgtcgaaagtaggcaaactcataagaacaatcagcagcgcgctgattgtgatggagaatagcaacagacccatgacatcgagatgcgcgatgaagaaggatacggtcatgcgatgttcatgcttcgcatcgggctcgatgcttgccaatcccagcacaatcgtgatgatgccgaccaacacgttgacgaagaaggtggagcgccatcccaaaaaggtgaccaacaggccgcccaacggtggaccgacagcgatgagcaccagtcccaccatagcgagaatggaaaggaccaacgaaggcggttccgccaatcccatgcgatcagcccgtctgcgaaccagcagcatggcagcaggatagccacaggatgtgcccgcaccaataagcacacgcgacgtcagcagcacgccgagattcggggcgaaaccacccagtagtcctccaatcatgaccaatgccgcaccggccatgaacaccgagcgaggaccaatgatctcagaaagcttacccgccgtcggctgcgcgatggcacatgtcaggtacagcgcagatatcagcagggtcgcccttccggcatcaatccgcaaatcatgtgaaatcggtgcgagcgccgtcgagataagcgtgctgttgacagggttgagaccgaccccaaatatcatcgccatgatgaaggtcttgggaaacgcgggagtttctcttgtcttatcagccgtcttcatcgcgtgtcgcctcccgtcggcagcgattccgtggcggcgatgcgttcgatcaatgtggtcgcagcggcgaggtccccgcgctcgccgtcatccaatgcatattcgatggcatgcgccagccaagttgtttggctagcggttacgtgggcgaggaacgcatgtccttcatcggtcaagccgaccagtcgacgacgacgatctttcgaatcggcatgctgtgtgacataccctgtggacctcagtagttcaagacgctgggtgatggcctgttgcgatacgtgttcgtacgcggccaaagtcgatactgacagttctccctcggtatccagccgcttcaacatggcaagctgcgaagcggtgatgccccgttccgcgatgccggcctcatgcttcatccgagcttgcagcctgctgaccgcaatcgccaattccatggcgacatccgatgtcgaatattcgtctttcgtatccatttcgattgcctccagctggccaccatagcacttacacaagctacttgtgcaatctgcttgcggatttcctcgcatgacgccactcgccgcaaggcttcaaaccgttatcgccctgaacaacaaaaagggccatcccacttttgcaggatggccctccatataagaacaacagacctcaggcaagtttgccgtaggcttcgacatccaccggctcgagccattcgttgctcatggatgccggatcgcccgcagggaccatgaaggctagatgcgagcatgattcgccgggggcggcgccatgccagtgcttcgtatccgcggggatgcagacggcctgcccggccttgagctcctttggctcctgtccctcgatctggcagtagccgcaaccgccgaccgcgatgagtacctgcgccgcgttgtgatggatgtgccagttgttgcggcaacccggctcgaaggtcacgttatggatggcaatctgcggagtctcgagcaccggagcaaggtagctctgtcccacgaagtactgcgcgaagccgtcgttcggttctcccatcgggaatgcgctcggattttccattgtcgacccgtcctttcatttatgctctgtaccgttccctattcaacgcccggcgaaaaagaatgtccaatgtgagtatggtatatcgttccatgcgtcgattgcatatcaaaccattcatgcgaggtattggttctgccaatcgaaacgggatatgctgaccttccgaacatcaacggcagaagagcttcagtatgactgacatgagctacgccccactgggatggtccggcatccaagtttccaaggtctgccttggcggtatgagtttcggcaagacctccccgtaattccatcagtggaccatcgatgccgacgccaccgaacagccgtcagtacaacatggcgctcaccccatactccccatggcgtccggccatctgacccatccgtcctgggattccgattccaaacgcggcaccaccgacggcaccatgcgcaacaagtacgatcaggcacgtgcgcaggatatgccgatcatcgaacgcgtgcacgggctcgcggaacggctcggcgtgccgatggcgcggatcgccctcgcctggcattgggccaaggacgtcacggcaccgatcgtcggctgctcgaagacggagcgcgtggatgatgtcatcgaagcacttggagtaaaactcagcgaatccgacatcgcctatcttgaggagccgtacacggcgcatgaactggtcggcccattggccaggccgggcgagcgcgcgctggccggcacccttgcgccgactctgaaggagaaagccaagtagcgccacacgtcgccggaaagtggctagcgcaccgggatgcagatctcggtcacgaactgggcgggatccgatgtcaacccttcatcgatcaacgcgatctcacgtgagaacccggtgatgtcgagaccctgctctgcggtgtaccatatcagctcgcgataccggtcgggggcatcgccatgactcccccggaaccggatgcgcacgcaatcggtctccggcaatgccacggtgtcgccctcatattcgtcctcgtcgtcaagcaataggaacaccaacccgtaatcggcatatccgccctgttccaacgattccttgtcaatgccgacgccgaccttgccgaggaagaccagcgaatccttctgatgctgctccagcttgcggatcgaatattccaggccgagatacgagtcgaccttcggtgaatccctgatccagacgatcctgcaggcgggttgccgcacaacacgtatcacgtcgaattcggactgctcagcgtcccgcagccgctccaagcgatggtcgatcttccgctggaccatttccagctcatgctgtttgcgctcgatcagggctttctgtgcaacaagcttgtcctcgatgacatgcacgtcgcgattgtgcaggaactcggctatctgcgtcaacggcatatccagcacacgcaggtaccggattgtgttcagcacctcgaactgcttggcaccgtaataccggtacccggtgcgcgggtcgatatattcgggttccagcaagccgcaacgctcataatgccgaagcgtgcccagcgacacattgaacatatctgcaaccttgcctatacggaacagtctgccgtcacccggcaaagcgtcgcgccctccacttcgctcactcgccgtcatgcacgcgccttctccgaaattacgccgtgacgcttgagccacgcgtagaagccaagacagatcagcacggaaagcagcgatccggcgggcgcggcgacgcccatggggaacaaggtgttcgggaacagcttggatgccagatacgccccgggcacacggaccagggtgatggccacgatattgtggatgaatccgatataggagcgcccgcatgcggcgaagaagccgctgaagcagaagtggatgcccgcgaagatgctgtcgacgatgtagctgcggatgtactgtgttcccagcaggattaccgtcgcatcggtggtgaacaggccgacgatggagcccgccgtcagttccaccacaatcgatatgacgatgccgtagacgacggtgatcgcggtggcgtatcgcagtgtcttcgtcgctcgctccatcctgccggcaccgatgttctgcgccgagacggcggataccgtggccagcatggacgacggtaccaggaacaacgcgctgatcaccttttcgacgacgccgacagctgccgcatcgttcaggccacggtagttggcgatgaccgtgatgatgatgaaggcgatctggatgcagccgtcctgaaccgccgtcggcactccgatgccgagaatgccgcggagcatggccctatcggggcgaagatcgccgaacttcagtctgatgcccgtacgccggcggcgaatcgccaccaatgtcacggtcacactgatggcctgcgccagtgtggtgcccaatgccgcgcccgagggaccaagacgcagccagcccataaacaggtagtcgaacacgatgttgcagaagcatgcaaccgcaatgaaatacatggggcttttcgaatcgcccatcccacggaacaccgagctgataatgttgtacgcgacgatgaacgggatgccgatatagcagatggtcagatactgcgcggttccctcgacggcttcgactggcacgccgatcagcgagatgatgttgtgcacgttcaacagcagaacgaccgtcagcgccaacgcgattcctgcgaacagcgtgatgacgttgccgatggccttggccgcacggtcgagcctgttcgcgccgaccgcacggccgatggtgacggtcgcgcccatggcaagacccacgatgaccacggtgagcatgtacagcacctggctgccgttcgccaccgcggtgatgccgtcgatgccgatgaactgtccggcgatgaacagatcggccatgccgtacagcgtctgcaggaaatacgacagcagatacggcaacgcgaaggtgacgatcgttctgaacacgcttcccgttgtcaggttctttcccatgggttgtctcttatcctcccgtttcggcctatgtcttccagcaggaaggctaaaccttacaatggttgtagagtcaatcccaaagcattgtcatgtccaatatgcggaaaaccgtctttcaccccatgaccggagcggtggcttcgtcttccccgtccggctcgtcggcgagacccatgagctctcccatcttgtccgcgtacacgcccgtctcatgcatgagcagggcccgcactgcccgaagcgattcgcgatcccgaggaagacggtacaaggcgatggtcgcggccatttcgccaagcttttcatagttgtccaacatgcgtttgcgatccttgtgcgaagcgagcatcgcatccatgcgatcctccggttcggcgaaaaagatatatccggcaagggtaagcagcagaccagccttcctcacattgcgtgcctggctgtcaagttctttgacaccattctcgaacatggttcgatcacgcagtctgaagccttcctggagaagacccgaagccgacggccccataagggagatggcaaggtcatgcagatagagcgggtctttccatatatcctccacttcatatacgccattgtcctcgatctcggccagtagttgggcgacgggcttagtgttctcatcccacagattccgatatgcctccacaatgtgttcggcgtcatacagatatctggcatcgaggcaagccggatattccaatgagctggtgacgctcagatccacagaacaggcatattccagatccgccttgatccgcatatcctgcaactgggcgcatacatgcctgtatcggaaatcgggatcacatcccaattcgaccactttcggatcatcgcggagcatacacatacccaatcccccataagcgagaaccatcagcgccgcatcagcggccctaggctcgccccctccccatcgcaacagagtgtatgcggccagacggtaggtctgtcgcaggtattccatcatgcattcgagccgtttcctccttccgcctccgctcttcttccccttggtctttttccttcggaacacctcacgtgtatcgaacagaccaagctggaacggcatcctgttgctcggccgatgcgtcgccaccgcgacggaagcatcattaatcatttcatacagccatgcgctcatgccgtatttacgaaccacattgcggcatccggtcaagaattcggcatcatagcctatttggaaccgatccaatatgatcatatccatgtcgaggttcaccggccatgacgtgccgccgaacaagtcatccgcaagctcgtgcaccacgtcatcgaacagggaaagcggaccttccatatcgtgttcgagacgtatccgatcaaggtccgcgaaacaacgccccgagctgtaccggtcgaagcgctcgatcagccgatccatcgtttgcaggaaagcctgttcgtccatattgaatggcgtggccacggcaactgtcatatgcaactccttcgtcgtagagatgcacctactgtcgcatatccgtccacctctccgtcacaatcctttgaaaaaagtgaataagtggacaatttccacctattcacacccccatacctgtctgtggacaacttgcgcaataacaaaaggcccttcctccaaaaagaggaagggcctgatcttcgcgtaggcgacgagccggtccgtcagttgatgagttccttgaccgctgcgatgacggcctgcagactcgccttggcgtcaccaaacagcatctgcgtgttgtcttcgaagtacagctcgttctggatgccggcataaccggtgccacggccacgcttcatgaccaccacgttctgcgccttgtcgacgtcgagaatcggcatgccggaaaccggggtgcccggcttgcgggcggccggattggtcacgtcgttggcgccgaccaccagagccacgttggcctgcgggaactgcggattgatgtcatccaggtcgacgagctcctcatacgggacgttggcctcggcgagtagcacgttcatatggccaggcatacggcctgccaccggatggatggcgtaggagacttcgacaccatggtccttgagcagggtgccaaggtcagcgagctcacgctgggcctgggcctgggccagaccgaagcccggcacgaagatgaccttctctgcgtagacgagctggacggccagatcgtcggcggaggtttccttcatggtgccctccagcccctctccggcgcccgccgcagaattggagccgccgaagccaccagccaagacggacagcagcggacggttcatagccttggacatggcgatggacagggtcacgcccgccgcaccgacgagcgcgccggccacgatcagggcgatgttgttgatggccagaccggacatggccactgcggtgccggtgcaggcgttcaacacggagatgacgaccggcatatcagcgccgccgatcgggatgacgaacacgaggccgtagcacagggcgaacacggtggtcaggatcgaccagagcagacgctggttcggctgcacgcacaacatcacgaaggacacgatggtgagcacgacgaacaggatgttccagaaacccttgcccggcaggctcagcttcttgacccacttgatgccctgcagcttgccggctgcgatcagcgagccggagaaggtgacggagccgatcatgatgcccagacccgcggtgatgagcaccacgatggatggggtttcggcggaggtcaggatgtcgttcaatgccacgagcgcggcggcgccaccgcccacggtgttgaacacggagaccagctgcggcatgtcggtcatcttgaccttcttggcggagaccacgcccgccacggcgccgatgacgatgccgacaatcagcacgatgactgcgacgccatgcttgaaaccgttggaggcctcacctgcgaacagcacgatgaaggccatggccacggcgaacaccatgccgatggcggagaccatgttgcccttgcgggcggtcttcggggagttcatcaggtgcaggccgatgacgaacatcactgcggccagcagatagacgaaccattcgatgacgccgagcggcgtgctcagcatttcggccagggtacccatttacttggcctcctcttccttcttcttgcccttgtcggacttgaacatctccagcatgcggtcggtgacgacgtagccgccgacgacgttcatcgtgcccagcacggcggccaggaagatgaacacccaggcgagcggactggtggcgtgcgcggcgacgatgacgacgcccgcgatgacgatgccgtggatggagttggcgcccgacatcagcggggtgtgcagggtggcgggcaccttgccgatgacctcgacgccgatgagcagcgcgaggacgaacagtgtgatcgcaacgacgatatccattgctttactcctcttccttcttggcttcctcgccgcggccggccacgaccatggcgttgtcgagctcttcgttcaggtcgatggcgagcttgccgtcacgcacgaaatgcgccagcacgtcggccacgttgcggctcagcaggttggatgcggtggtggacacgccgctggccagatacggggcgccgatgatggtcacgccgttgtcggtgacctgggtgccgacggaggagccttcgacgttgccgccaaggtcgcttgccgcgcaatcgacgatgacggcgccacgatgcagaccggccacaccggccttggtcagaaggaccggaggcttgcgtcccggcactttggcggtggtgatgacgatgtcgaagccggcggccttctgatcgaccgctgcctgttgctgggcctgctcttcggcgctcagcgcgcgtgcgtagccgccttcgccctggcccttggagaagtcaagaccaaggtcgaggaacttggcgcccaaggattcgacttcgcccttggatgccggacgcacgtcgtacgcggtgacgacggcgccgagacgcttggcggtgccgatggcctgcaggccggcgataccggcgcccagaataagcaccttggccgggcggatggtgccagcggcggtggtcatcatcggcaggaaggaaccgtacgcgttggctgccacgatggcggccttgtagcccatcacggagttctgcgacgtcatttcgtccatggactgcgcggagctcagctgacgcggcagcttttccatggcgacgccgaccagaccggccttctcgatcgcggcgacgtaatcggcatcggtgaacgatcccaacatgccaatgatccatgtgccctgcttgacgcgggcgagcagctcattgcttggacgatccacaaaacccagcgcgtcggcgcgtgcgatcacatcgtcggcggagacgacctgcgcgcccgccttcgtataatcttcatcaacgtagtgcgatgcgacgcccgcaccggactcaatcagacatgtaacacctgatttacgcaacctcgttacgatatccggtgtcagagcaacacgggactcgtgttcggaagtctcgttgagaactccgaagaccacggtggcttcagctttttcagccataggtgccctttcttcctcgttaaagaaatctaatgaacagatacagcgcccaagtgtaacgtacacggcaacatcgcggccgcaatcgttcatctttcgaatcacgggctgtatccggcatgcgccgcccgtttccctgatggcctgtcaccttacgctaccgtaaggtgacgtgtcgcgcgcgacgggctatcattccttctttagataccgtttatatacgtaggagagtcacgtgtccatcatcacctcgttgaacaagcaggccactaatctcgcaaggaaggcgttgcgcttgggcaacgatttcgtgcacccggtcagcgacgattccggcaatacaccggattacaacgacccgaacagcatcctctcccccgatggccatatcgagctgccgcacaccgctgaatggggaccgggatacccgtccaccacgttccttgaccctgaaaccggactgttgaccacgaagacagagggcaatccgccgctagacgaaggcacctccatctacgatatctacgccgaccgcgccgctcgtatgggcgacgaaccagtgtacacgttcaagcaagatggcgattggcacaccaagaccgcaaatgagacgctcgccgacatccgcgccgtcgcgaagggcttgctgcattatggtttgaagaagggcgatggcgtggctttcatgtgccgcacctcctacgattgggatgtgttcgacgcggccgtcatggcctgcggcggcgtgctcgccacgatttacgataccgattccgccgagcagatccgcaatatcgtcaacaattccgatgcgcgtctgctggtcgtggaaaccactgatatgaaggcgaaggcggacggggccgaaaccgaatgcccgactttggagcacatcgtctgcttcgagaccggtggtcttgacgagatcaaggcgtatggctccggtgtgagcgatgaggcgctcgatgcgcgaatcgattccgtgcagaagaccgatctgtgctccattgtgtacacgtccggttcgaccgccgcgccgaagggcgtggagatgacgcatgagcattattgcgccaccgcgttcaatctgcccgattatatgccggaactgctgcatgacaagaagaacaccgtcctgctgttcctgcctcaggcgcattccttcgcccgtgccatcaactacatctgcgtagcaagcaatctgcatatttatatcgcgcagggcatcaagacattgaccgccgatttgcaggtggccaagccgaccatcatgatcgttgttccgcgtgtgctggagaaggtgtacaacgctgcttcccagaaggccggtcatggcgccaagggcgttgctttcgccgcagccgtggtcgccgcgcagaattatatgaaggaagtcagcaccaaggggaagaccggaacgcttaccaaggcacgtcgcgcggcgttcgatccggtggtctatgcctcgctgcgtgaggtgctcggcggacgcgccaagtggatcgtcgcgggcggtgcgccgcttgatccggagttgttggcgttcttccgtggtgccggcgtgccggtctacgaaggctacggattgaccgaaaccaccgcgccgtgcgcgttcaacgtgcttggcgtgccgtatcatcagggttccgtcggcatcgcgttccctggtttcgagctgcgtatcgccgaggatggggagattcaggtcaagggcgcttcggtgttcccgaagtaccataagaacggcgaggccaccgaggattcctttaccgaggatggctggtacaagaccggcgacttgggccgcattgacgacgatggcttcctgtacatcatcggacgcaagaaggatctcatcatcaccgccggcggcaagaacgtctcccctggcccgatcgaggatgtcatcaagcgttgcgaattcgtctctcaggcgttggtgcttggcgacaagcgtccgttcatctccgcgctgatcacgcttgacgaggaagcgttgcgtccatggctggaaagcaagggtctcaaccgagatatgtcgatggaggaggcctccagcaacgcggccgtccgcgccgaagtccagaagtgggtcgatcaggccaatgagggcgtgtcccgtgccgaatccgtgcgtaagttcatcatcctgccggaggagttcacacaggagaacggtttgatgaccgcttccatgaaggtcatccgtccgaaggtgatcaagcgttacgccaccctgctgaacacgcaaatgtacaccaagaagaagtgaccatccagcaccaacaagcttagagcataagaaagcctgccgcataaacagcggcaggctttattgttcccacccggaaaaaatcagaagcccagcttctcaagctgcttggctgagccgtcaaacgggcagcccagtgggctgaccgtaggcgaagtgagcagcttcgccgcgaagcggatcctaagcggcttagaagcccagcttctcaagctgcttaggatccgactgccatcccttggccaccttgacatgcaggtcgagcttggccttctgcccgacgatgcggttgaccgcggtgcgcagcttcttcttgacgcgtaccagatgctccgcgttatgtccgatgatgatcggcttctgcgaatcacgttccacgtagatcgacacaatcacctgcgccttgcccgcgtaggattcgccgctgtcgttgtcttccggatattcgatggaatccaccaccacggcgagcgaatgcggcagctcgtcatccaattcctccaggaacgcgcctcgaatcagttcggcgatggtgtcttccggacgttcttcggtgatttgctcggccggatacatctgcggtccttcgggcatgttctccaccagcacgttgcgtacttcggcgagattgtcgtgctcgagggcgctcaccggcacaatgtcggtgaagtcggcgaactcgttgatttcgatgagcttgtcgatcaaagcgcttcggtccaattcgtcgattttggtgacgatggcgatcagcggcaccttccatttgaatgtgccgtcgtcgcgtttgacggcgaaatcagaacgcagcctgctcagaatgcgtttgtcgccggggccgatttcctggtcggcgggcagcaggaaggcgatcgcgtcgacatcggatagcgattcgtcgacgacatcgttcagccgctgtccgagcagcgtacgcggacggtggataccgggggtatcgaccagcacgatctgcgcgttgtctgtggtcagaatgccgcggatggccttacgtgtagtctccggacgggatgaggcgatggcgatctgcgtgccgataagcgcgttgatcagcgtcgatttgccgacgttcggacgtccgaccaccgcgacgaagccggaacgatatggaacgggggcttcggcgtcggaatgctgggaagccggttcggtcacatctgcgtcagtcatgcttgtccttggaatccttgtcgtcatgggatgcctcttcggcaccgttcgtatggtcttcgtgttgttcagtttcgtccacgccctcgacgtgggccggttccaccacgatggtggacactttcttgcggcgtcccgcggagtcgaccgcggtcaggcgcaggcccctggtgacggccgtcgaaccgacgatcggcacgcggccaagcagcttggtgagcagaccgtataccgtgtcgacgtcgtcctcgtcgatgtcgatttcgaagatctcctccaagtcggcgatgggcgtgcgtgccggcatgctccatttgttctcgccgatttgttccggatcggcatgctgggtacggtcgtgctcgtcctccagttcgccgacgatctgttcgatggtgtcttcgatggtgaccaggccggcgatgccgccgtattcatccacgacgatagccacatgctggcgggtgcgctgcatctggtggaacaggtcgtcgaccggcttggattcgggcaccagcatcgggtcacggacgatggattcgacatcgcgggatatcgccgcgggattgaacgccgtggcgcgcacggcatccttcaggtatgccacgccgaccagatcatccacatcatcgccgatgaccggtatacgggagaatccggaacgggagcacaatttcagcatgttctccagcgtctccccgcgttcgatgcaaatcatatcagtgcgcggcaccatgatctcacgcgtcaacgtttcggacaacgtcaatacgttgcgcagcatttcggaaacctcagggtcgaaatcattcgcctcgaccagacgatctatggtggcgcgcccttgttcgagttggattttttcaagctcctcatcgtccgacagatcattcgaatgacgtttcgcatccttctgtccgccgattttagcgaatggcgtcaaagccaccgcgaccgacgccgcatcggcatgcttcagcatcagatcgaccggtttggaggcgcccgcgctacgtggacggaccagcagcgaaatcaccgcgaccaccagcgcgaacacgaagccgacaagcagtcccgcccataacggcgcatcgcacaacgacgcgatcgcggcgaccaacacaccgtcaagcacattgcaggtgatgcggaagaacgcgcatgaaccggcggtcgcgtagcggtcggcgatcagccgctgcaccttgtggatgcgtttgatcttcttgtcgcgtatgaattgcgacgcctccgtatccgtctgaatctcaagaatgaggttgttcagacttgccctcgtgacacgtcccaccgcgccttccgtcgcggccatcgacagcgacagccagaccagcagcaatgcgatgacgacgagaatcgcaatcatcgtgatagtcgttgtttccatggttcgtcaacccccactttcgaaaccgtcggatgatgcatcatgccgtcatttggccgttttgccgccggccccgtgttcgcggtcccattcggcgagcgcatccggcgtgccggcgggaagcgtcgcccgcgcgccggctccctgtcgaagcgcgaagaacgtcaatagcagctggcgttgcaagccgaacatctgccgttcctgttcgggtgtgacatggtcgtatccgagcaggtggaggatgccgtggatggtcagcagcatcatttcctccatggtgctgtggccggccgcgagcgcctgctgggcggccacccacgggcatagcacgatgtcgcccagcacgccttccatttcggttccgccgtctccggggcgcagttcgtccattgggaagctcatgacgtcggtggggccttcgaggttcatccaacgcatgtgcagttgggcgatgggatccgggtccacgaacatgatggtcaggtcggattgtgtgctgaccctcatctggctcatgacccatacgccgaggtcggaaaagattttgccgtcgatctgccaggcggtttcgttcgtcacttcaacgctcatttatgcgttttccttgttcttgtcgtcgaatggttgcgatgatgcggcacgcgcgcttctgctgtggtctcccgctatggccgtgtgcctgtcgtaggcggcgacgattttgcccacgagcgcgtggcggaccacgtcttcgggcttcaggtgggcgaaggcgatgtcgtcgatgccgtcgaggatgcgttcgatggtggccagacctgatttcggcacggtcagatccacttgggtcacgtcgccggtgatgaccattttggtgttgaatcccagtcgggtcaggaacatcttcatctgctgttcggtggtgttctgggcctcgtcgaggatcacgaacgcgtcgttgagcgtgcggccgcgcatgtaggcgagcggcgccacttcgatggtgccgtcgtccatgtatcgcttgagctggtccgctccgagcatgtcggacagcgcgtcgtacagcggtcgcaggtacgggtcgaccttttcgttgagcgtgcccggcaggaagccgaggttctcccctgcttcgacggcgggacgggtcagtatgatgcgccggacctgcctgtcttggaaagcacgtaccgctttggctacggcaagataggttttgccggtgcctgccggtccgatggcgaaggtgatggtgtgcgattcgatggcgttgacgtaggctatctgtccggcggttttggcacggaccggtttgccgagcgcgaaggtgatgacgcccggcacgtgaggacgccgcctgtctgcggtttcctcacgatgggacgcgtgcgactgttgcctgccggccatgcgcaattcctccaccacgcggccgtggccgggatgtgtggcgcggaccggatttttaagcacgttctggtcgagcatgcgacggacggtatcggcgtccatcggcgcggtataggcggcttggatgatatcggcaaccacctgttcggcttgggcggcttgggattcggatttgctggaatgcgacatgatggcgatgcggttgccccgtacgatgatggtcagatcggggaacgcacgttcgacttcccgaagcacctcgtccacagggccaagcacggtcaccggatcaagctgttggggtatcgcgatggtgcgtgtagtggtgggcacagaacctcttccgatgtcggtattggcggtatgtggactattcgtcgagcttttcgccggtaagcacgtgggcgtgcacgtggaacacggtctgtccggcgtcgattccggtgttgaagatcagacggaaggcgccatggaactcctggtcggcgattttctgcgccacttcggccatgtgggcgagctgtgccggatcctctttggcgagttcggcgacgttcgcgtagtgcttgcgcggcacgatcagtacgtgcaccttggctttcggattgatgtccttgaaggcgtaggtggcatcgtcctcgtacaccttctcgctgggaatctcacctgcgataatcttgcagaacaggcaatccttgtcgctcataacgctccttatcggtattggaaaaaccttcgctaccatgctacaccagcaggaaacggggcgattccggcaatttcacgcaatggagccgggatcagacgaaacgtcccaatgctcgcgcgagcaatgacagcgcgaccggaccggcggtggacgcacgtaggatgttgcttcccagcacgcacacttcggcgccggctttcgtgaacgcctcgacttcggcgtcgctgatgccgccttccggaccgacgagcacatatatggtgcgcggacgtccgtccttcagacacgtatcggacagtttggcgataccggtttccagttgttcccaggtcttcgtggcatcttgatgcagcacgatcaccatgtcgccatgcacgcatgcgcgcttgcagatggcgaccacctgcttgctggtcacgcaatcgtccagctggggcgtccacgatctgcgcgactgttcggtggcggattccagcacctgcctccactttttgtcagtacgtcctgccttccatttggcgatggaacggtcggcctgccagggaatcacctgatcgacgccgatctgcgtggccatatcgatcgcctgctcgtcatggccggttttggcgagagcctgcaccagcgcgagcctggtgaccggctgcggctccttgccgaatcgcagcacttccgcgattccctgctgcgcgtcgcgcagtacggcgtggatgcgcaatcccctgccgtcggaaagctgcagttcgtcgccgtccttcaatcgcatggcctggatggcgtgcctgcgtacggatgagggaagcgtcagcctccatccggcgttgagctcgtcgctgttcaccggtacgtcgtcatggtccgtatcaagcagaaaaagggcatcagtcatagcttccgagcctatcaggaaccccacataacccatatcggacctatcgcgacacgccaggatttgcatcatggatttcaactgctatagttttcattcgttgccgctgagcaacgcacctgtccgggtggcggaatggtagacgcgctagcttgaggtgctagtgcctattttatacaggcgtgcgggttcaagtcccgctccggacaccggaataaaccccttggagacaaggggttttcttgtatctgacgaaagattggcggaatacgggcaatgcggttcattcatcttgactccatcgacgacgagcgtgtggcggcttatgtgaatctcacggaaatccagctgcgcaacaggctggagcccagcaagggattgttcatcgccgaatcgcccaaagtgatagaccgtgccctggccgctggacgcgagccgatttccctgctggtcgaggagtcgtggatcgacggcatgagcggcatgttcgatgtcatcgagaaacgttggggcgatggcattcccgtgtatgtcgcttcgcctgagcagctcaaacgtctaaccggctaccggctgcatcgcggagcccttgccgcgatgaaacgctggtccctgcccagcgtcgaagaggtctgccgtggcgctcgccgggtcgcggtcatggagaatatcgtcgaccacacgaatgtgggcgctctcatgcgttcggctgcggcgctcgacgtggatgcggtgctcgtcactccgtcctgtggcgacccgttgtaccggcgcgcggcacgcgtgtccatgggcacggtgttccaagtgccgtggacgcgcatcggaggggacgacaagcattattggccgttcaccggcatgcgggaactgcatggtctggggttcaccaccgtagcgatggcgcttgaggatgattccatttctttggccgaattggtccgccgtctcaacaacaccgagactgaaagcgaccatattgacaagctcgcgttgattttcggtaccgaaggagatggactgtcgcaccacaccatctcccgcgccgaccttacggtgaagattcccatgagccacggcgtggacagtctcaatgtcgccgcatcaagcgcggtcgccttctatgcgacgcgtcgagtggaccatcatgcgtgagacgcgcatgaacgcatggtgaaacgttgctgaaacgaactggaaattttcaagactcgcgctgcaaactccttgcgatttgctgaatttatgcaatcatagtgtgcgtaagcggtttcgtgatgaagcggaccgaccgtgcgtacggtgtcgcaagacgctctcagagaggagttcccatggcgaagaacccaaagattctttccatcgtgctggcaggcggtgagggcacccgtctgatgccattgaccagggacagggccaagcctgccgtcccattcggcggcgtgttccgtctgattgattttccgctgagcaatctggtgaattccggctacatgcagacggtcgtgcttacccagtacaagtcccattcgcttgaccgccatatctccactgtatggcgtttctcgccgctgttgggcaactacgtctcccctgtgccggcgcagcagcgtctcggcaagcattggtatctcggctcggccgacgccatctaccagaccatcaacatcattgaggacgtgcagcccgacatcgtggtgattgtcggcgccgaccatgtctatcgcatggatttccagcagatggtgcagcagcacatcgaatccggcgcggaattcaccgttgccggcatccgtcagcccatcagccagtccaaccagttcggtgtgatcgaggtcgatcccgatcatccgaatatgatcaagagcttccaggagaagccgcagaccaccacgggactgccggacgacccgaattccatcctggcctccatgggcaactatgtggccaacaccgatgccttgttcgcggcgctttcgttggatgagaaggccgaggatacgaagcatgatatgggcggcgacatcgcgccgtatttcgcggcacgcaacgaggccggcgtctacgatttcaattccaacgagattccgggagccacaccgaccgaccacgcctactggcgtgacgtgggcacgctgaagcagttctacgatgcgcatatggatctgatctcctatgtgccggagttcaacctgtacaacaccgaatggcctatctacacgctgtccggcaacctgccgccggcgaagttcgtgcatgccggccgcgaccgcctgggccatgccaccgattcgatcgtctcccccggcgtcatcgtttccggcggcgaggtgcaccattccgtcctgtcgccgaacgtgcgcatccattcgtggtctcaggtcgtcgattcgattctgttcgacggtgtggtcgtcaaccgtcgcgcgcgggtctacaaggcgattctcgacaagaacgtcgtgttgacggagaattcaaccgttggcatcgataccgagcatgatttggcgcgtggcttcaccgtcacgccggaaggcatcaccgtggtgccgaagggtaccgtagtcgacgactgacatacgtcgtaatacgaaaggcgcgcttccccgttcgggagacgcgcctttcgtatgttgttccgcttttcttacgtttggcggccgcggttcactgcacggcaaccgcagcaaacgtcagtatttcggcagattgtcgaaattgaagccgagcgcggcgagctggtcacggccttccggcgtgatcttgtccatcgtccaacgaggttgccaggtccagtcgatgcggaattcttcgacgagaccggcgagggtgctggcgcattcgtcttcgatcaggtcggtcagcgggcaggccggcgtggtgagcgtcatcgtgatgatggctcggcccagttcgtcgatttcgatgccgtaaaccagaccaaggtcgatgacgtcgatgccgagttccgggtcgatgacctggtgcagggcttctttcacgtcagctgccgtggcacgtccgatatcgtcgacggctttcagcggaatgtcgtcatcctgcggttgggagcatccgcacgcgtcggcatgattaccgcagccgcaagtgtcctgcccgtcttttttagattccttgttcaccggcttgccgtccttgaaccctttggccaggttcggattgagcatgacgcgacgggccgcgtcctcatcgttgcccaaggccttggtcacggaatcgaagatcgacgcctgcggttcgggtaccagggtgtcgctcattgtctctccaaactgttgatggacgttgcttgtatctgttgagcaagaatagcgcgtcgcttggggtttgtcactagtgtttttccaaacgccgagttgaaggctcaggctttcgcggccagagccttggccacggcgtccttcatgccctcccagccgagcagcgcgcatttgatgcgcatcggatactgggagaccccttggaagacgatgccgtcctccaaggattcctcggcctgttcgtcattcagtcctttgccgcgtgactccataagcttatggaaggtttcggcgagtttcatggcctcgtccacggttttgccttcgacgagatcgaccatgacggacaggctggcttgggagatggagcatccgtggccatcccatacgagccgttcgatggtgtatggcccggcatcggagacttcggcatggatggtggcctcgtcaccacaggtcgggttgaattggtgcgattctcccggcgtgcagtattcgtggctggcctgcaccgtggtttcggcggcatgcgaggcgttttccgaagcgaggtcaggtgcgaaatgctccttgccgtgcgggttcttcgcggcttcgaggatgacttcctggtacatctgctcaaggtcgcttccggacatctcaaaatcactcatatttcgttactcaactccaaagaacggacgaactttgccgagcgcctcgatgagggcctgtgcgtcttcgaccgaattgtagatgccgctggacgcgcggttggaggcatacacgccgaagtggcggtgcaccggctgcgcgcagtggtgtccgacgcggatggcgatgccctgcgcgtcgatgaactggccgacgtcgtgcgggtgcacgccttcgacttcgaacgcgacggtaccgatgcgctccttgttggagcggggtccgaggattcggatgccgtcgatatcgcccattttgagcagttcgtcggtgatggtgcgttcgtgcgcctcgagcttttccatgccgatgttcatcagccattcggcggcgacaccggcggcgacgacctgtgccaccggctgcgtgcccgcttcgaatcgtgcgggaggctccatgtactgggcttcctggtccatccaggcaagctccaccatggatccgccgaaattggccggaggcaatgcctcaagcatttcacgcttgccatagaggaatccgacgccggtcgggccatacattttgtgggcgctccatgcggcgaagtcgacgtccaaagcgtggaaatccactttgaggtgcggcacggactggcatgcgtcaagcacgaacacggcacccacctcgtgggcgcggcggataatcggcgcgatgtcggtaatcgctcctgtggtattgcccacatgcgtgacggcaacgatcttcgtgcggtcggtgattacttcgtccgcggtgtcggaacgcacacggccttcctcgtccaagtcgaaccatttgagcgtggcgccggtgcgcagcgcaagttcctggaacggcagcagcacggaatggtgttccgccttggtgacgacgatctcatcgcccggtttcaacgcgaaacgcttggcggtctctcccccgcgtccaagcgacgcgttgccgaatgcggtggccaacaggttcagtcctgcggtggcgccggcggtgacgacgatctcctcttcgccttccgccgaattggcgccaaccagcttggccactttggcgcgcgcatcctcgaacgccatggtgctacgcgcggcaagctcatgcgcgcctcggtgcactccggcgttgatggtgcggtagaagtccgattccgcgtcgatcacgcactgcggcttctgcgatgtcgcggcggaatcgaggtataccagcggatggccgtggatttcctggtcgagaatcggaaattggctgcggatcgctgcgaaatcggtcatgccaatgcgctttccgaatcggagccttccggcaggtatgcgtcgtagccggtctcctcaagctcgtcggcgagttccggaccgccggtcttgatgaagtggccgtcggtgaacacgtgcacgatgtccggcttgatgtaacgcaggatgcgggtgtagtgggtgaccatgaggatgccgaactggttggcttccttggcacggttcacaccttcggaaacgatgcgcagcgcgtcgacgtcgaggccggagtcggtttcgtcgaggatggcgaacttcggcttgagcagttcgagctgcagcacttccgcgcgcttcttctcaccgccggagaagccttcgttcacggaacgggtggcgaacttcgggtccatcttgagccgcttcatggcttcggacagttccttcgtccatgtacggatggccggcgccttgccgtccacttcggttttggcggtgcgcaggaagttggtcatggacacgcccggcacttcgaccgggtactgcatggccaggaagatgcccgccttggctcgctcgtccggggtcatcttgaggatgtcctcgccgtcgagcagcacctggccggagtcgacgatgtacttcgggtggccggccagcgtgtatgccagggtggatttgccggaaccgttggggcccatgatggcatgggtttcaccggagttgacggtcaggttcacgcctttgagaatcggcttgatgccgtccttggtttcgacgtgcgcgtacagatctttgatttcaagggttgacatggtttctcctgacgattatttctcttccaatacctgtgcgatcgcgtcgctttcgccgcgggccaggcgcttgtcgatgacgttcataagatgctcggaaatcgccggaatgccgatttcctcgacgagctcgccgaagaagccacgcaccacgagcttgcgtgcctcgttttccgagatgccgcgcgattcgaggtagaacagctcttcgtcgtcgaatcgtccgacggatgaggcgtggccggcaccgatgatgttgccgttttcgatttccagattcggctcggaatcggcgatggcacctggggtgagcaccagattgcggttgagctcgtaggagtcggtgcccggcgcggtaggctcgatcagcgcgttgccgacccatgtggagtgcgctcccttgccgtcgagcgcgcccttgtagaccacgcggctcttgcattcgggatggttatgcaccaccatcgtgcggtgttcgatatgctcgcccgggtccacgaagtagatgccgagcatgttgaggtcgccctgttcgccgccgaagtcctggtccatgcgaatgcgcacgacatcaccaccgagggtgaccacggaatggcgcaggaacgcctcctcgcccacgtggatgcgctggttgccgacgtgtttggagtccttgttccattcctggatgaaggtggtggaaatgtgggagtccttgcctgtggtgatttccacgccttcggcgagacgtgcgtcgccgtcatgttcgacgaccacgtcggcatgggcgcggtcggctgcgatgatcgacaggtggaacgcgtcgaggtccctgccggtgccatgcattttgacgagcaccggctggtcgatctcaccgtcgatggtcagtattccagcgcgtttgccggaattccattcgactgcggacacacggtcgttcggcttggagacgatgcctgtgccggtgtcccccaccgtgccttcggcatacgtgacgccttcggcaagcggcgacccgtcgatcatggaaacggtgacctgcgtttcattggatggttcgaacacatcgaagaactcctcgatgcgctctatcggcgtgtagcgccagtcctcctgtttgcggtccggcttggcgaacgcttcgatgtcgaatgagcgtggagcgcggtccgcggacgacggcatggccgccgggttcgcgtacggatcggacggatccgcgacggggatattgatttcctgagtttgtgccatggtgatcagcccaccgacccttccatctgcaattccaccaaacggttcaattcgagcgcgtattccatcggcagctcgcgactgatcggttcgacgaagccgcgcacgatcatgcccatggcctcgtcttcggacaggccgcggctcatcagatagaacagctggtcttcagagaccttggaaacggtggcctcatgcgccatggagacgttgtcctcacgcacatccacatgcgggtacgtgtcggaacggctgaattcgtcgacgagcaaagcgtcgcagaccgtcgaattggaggacccttccgcgcccttgacgattttgacgaggccacggtatgcggaacgtccgccgccacgggaaatcgacttcgccacgatggtggagctggtatgcggggcgaggtgaatcatcttcgcgcccgtgtcctgatattggcccttgcctgcgaaacccaacgacatggtgctggccttcgcgtacggctcggcgaggatgcatgccggatacttcatggtggctttcgagccgatgttgccgtcgacccattccatggtgccgccctcacgcacgtaggcgcgctgcgtcaccagattgtacacgttgttcgaccagttctgcacagtggtgtaacgcacacgggcatgcggttcgacaaagatctccacaacaccggaatgcagcgagtcggtggagtagatcggcgcggtgcagccttccacgtaatgcacgtaggagccttcatcagcgatgatcagcgtgcgctcgaactggcccatattcggcgtgttgatgcggaagtaggcctgcagcgggatgtccacgtgcacacccttcggcacgtatacgaacgagccgcccgaccatgcggcggtgttcaatgccgagaatttgttgtcgttgctcggaatgcatttgccgaaatacttcttgacgagttccgggtacttttgcacggcggtgtcggtgtcgacgaagatgacgccctgctcctcaaggtccttctggattgaattgtagatgacctcggactcgtactgcgcggcgacgccggagacgagtctgcttttctccgcttccggaatgccgagcttgtcgtacgtggagcggatctcgtcgggcagttcctcccaggtggtggcctgcttgtcgatcggcttgacgtagtacttgaaatcgtcggcgtcgaagtccttcaaatcgacgccccactgcggcattggacggtcgatgaaatcgcgatacccttccaatcgcttttccagcatccattccggctcgtgtttgtcggcggagatggcacgcacgacgttctcgtcgatgcctttcttcgccgcctcgccggcgaagtccgtatcgtgccagccgtagttgtagtcaccgaattgctcgataatctcgtcatcctgcttgatcttgtcttcgttcacgcgcgtgcgatcagccacatactggctcatctccacgtcggccgcggcgttggacgcttggttctctgccaccgtacgctgcctccattcactcattgatacctatgacaacctaacagaacacacagcgaaacactagaccttattcgaaattcgacagtattcgcccgtgatttgccttacaaaaaagcggaagaccatgcagattcggtcttccgctttgcgatgaatcgagcttatgcgctcaaatcgtctcagcgcgcctgctggtggtccagagcggccttgaccagacccgcgaacagcggatgcggcttggttggacgggacttgaattccggatgggcctgggtggccacgtagaacggatgcacctcgcgcggcagttcgacgaattcggtgagttcgccgtcagggctctggccggagatgaccagaccaccttcgcgcagacgatccttgtaggccacgttcacctcgtaacggtggcggtggcgttcggtgacatgcgtggtgccgtacagttcggcgacaatggagccttcctccagttccgccgggtaggagcccagacgcatggtgtgacccatgtcgcccttgccggcgacgatgtccttctgctcttccatggtggcgatgaccgggttggcgcaatccggatcgaattcggaggagttcgcgtcggtgatgccgaggacatcgcgtgcgtattcgatgaccatggactgcagaccgaggcacaggccgagggccggcagcttgtgctcgcgggcgtaacgcagggcgccgatcttgccgtcgatgccacggatgccgaagccgcccggaatcacgatgccgtcgacctggtcgagggccgccgcggcgccttcttcggtggcgcacttgtcggcggccacccacttgacgttgaccttggcccagttggcgaagccgccggccttgatggcctcggtgacggacaggtaggcgtccggcaggtcaatgtacttgccgacgatggccacgttgacctcgtgcttcggatggtgcacgcgttcgagcaggtcctcccactcgtcccagtcgacgtcatggaacggcaggccgagttcacgcaccacgtaggcgtcgaggccttcgtcgaacagggtcttcggcacgtcgtagatgctcggagcgtccacgcagttgacgacgccttcggagtccacgtcgcacatcagggagatcttgtccttgatggactggttgagcggccggtcggaacgcagcacgagcgcgtccggggagatgccgagctggcgcagcatcatgacggaatgctgggtcggcttggtcttgagctcatgcgcggcggcgatgtacggcaccagggagacgtgcacgaacatgcagttttcggcgcccaggtcgcggcgtacttcacgagcggcctccaggaacggctgggattcaatgtcgccgacggtgccgccgatttcggtgatgatcacgtcgacgtcatcggacgcctgcgcgcgcatacgggacttgatttcgttggtgatgtgagggatgacctgcacgcactggccgaggtattcgccggcgcgttccttgcgcagcacctcctgatagatctggccggtggtgacgttggccttctggctcaggtacacgtcgaggaaacgctcgtagtggccgatgtcgagatcggtttccgcgccatcttcggtgacatagacctcaccgtgctggaaaggattcatcgtgcccggatccacgttgatgtacggatcgagcttctgctgcaaaaccttgatgccgcggctacggagcaggcgtccaagggaggaggcggtcaggcctttgccaagggaggacactacgccgccggtgacgaaaatatgcttggtgacgtgttcttgagaattgccatgttgtcttctaaccatggaacttcagtctatcagcggcgcaagacgcggcgtgttccatcgtgatacgaaaaggcgggaccgcattgctccgcggtcccgcctttcggaaattcaggaaatacagtcagacgattgcgattttatcggtcgccggcctccttcctgcggaggacgatcaacacgcccgccgcaacggcgagcaccatgacggccaaggcgattccggcgacgttggagcctgttgccgggctctgcgccgcgtttttctccgcgtcttcctttgtattgtcggccttgccgttgatcttgccattggcattgccattgttcttatcggcggccggggtgacggcctgcttctggacgtgcaccgtgcgggtgaaggtcgtggtcttgccacgggagttggtcacggagtagaccagcttgtagtcaccgaccttattggcgtccacggtgccctcgaccttgatcttgtcggtcagatcgccgtcgatgtcgtcggtggcggagacgcccgccatcggatcgaacttggaaccgacggtgatggtcgtcgactcgttcacaccgctaatcacgggaacgacgtcgtcggcggaggcgaccttgagcacggtggcggacagtgcgccagcggtgtatgcggagcccttgcggacggtgacgctcttgacatcatcgtcgccgtacacggtgccgtttgcggcgagcacctcgtacttgccggcctcgacgccatcgatggcggcggcatcgttgttggcgttgaagatcaccacgtaggtgccgctggagtccttcgcctgataggccacgacaccgttggcggacttgagcatggtcacgctggcgttgatgtcgttgtagctggtctggcggagggcagcgatcctgttgcgcagcttgatcaggcccctgacgtagtcgacggagccggagtactgcgtggtgcgatcccagtcgatggcgttcacctcgtcaccggcgttatagctgttgtcgttgccgcccttggtgcgcaggaactcctggcccagctggatggccgggatgccttcggacaggtagaccacggaatcggcgagcttggcgcgcgcctcggtggtggcctcgtcatccgtgggcacggacttcctgagcttgtcgtacagggtcatgttgtcgtggatctcggcgtagttcaccacctgaccggcatccgcgtagtggtcctgcgcattgccgttccagcaggtggtgatggcgtcggcgtcgtactggcagccgagcacgttgtgggcgatgaggctttcctgatcggccttgccggagacgaaaccggtgtcggtgtcggagaacacggaacccttgaggccgtcgcggatcgagtcgttgaagaacgcgatgccgttgttggtgccgtccgaagcgacctggtaggcgtttggctggatggtcatctcgctcttgtccatcgtggagttcatgtcccagccttcgccgagcacgatgatggacggatcgatcttgtcgagggcagcacgaacctcctgcatcgtcttggtgtcgatcagacccatgaggtcgaatcggaagccgtcgatgttgtagttcttcgcccagtaggtcaccgagtcgacgatgtacttgcgcatcatcgcacgttcggaggcggtgtcgttgccgcaaccggagtcgttgacgagcgaaccgttgtcgtcatagcggaagtagtagcccgggaccgtcttgttgaacgaatggttcgcggcattgtggacgtggttgtacaccacatccatgatgacgcggatgttgttcttgtgcaggcccttgaccatctgcttcatttcggtgacgcgggagctcgggttgctcggatcggaggagtacgagccttccggcacgttgtagttctccgggtcgtagccccagttctgcgcgccatcggcgttgtagctcaggtcgccggtctcgttgacggaaccgtagtcgtacatcggcatgatctgcacgtgggtgacgcccagcgacttgagatagtcgaggccggaggtcgcgcccttggcggtcttcgtgccggattcgaccacgcccaggtacttgccctgcttgtcggcggagatgccggaggccgggttgatggagaagtcgcggatgttcatctcggcgatggaggcgtcggtggtcttgccgaaggccggcatgcgcttgcccgccttgcccatggccttcttggagagcactacggagcgctcgccgttggcgacggccgcggtggcgtacggatcggcggaggtgttcaccgtgccgtcggcgaaggtgagcctgtaggagtacgcggtgccggaggcaagcttcttcaccgtggcgctccacacgcccttgctttcgcttgtcatgtcgatggtctgatcgatctcggcattcgggtcggcggacttgtaggtgatgagctcgaccttggcggcggtcggcgcccacaccttgaagccggtctgcttcttggtgaaggtcgcgcccagatcctcgccgctgtaggcgtacttcttgtcgaaggcgtcggtgcggaccaccgaaccggcgatggcgttctgggagccgaagcccttgatctcgacggtgtacttgccgcgaacgtccagatccttgtcggcggtgatgatcaccttggtgccgtcggccttgagactcttgacatcgacggctttgccgtcggcgtccgtgacggtgaccttgcctttcaggtcatccgtggagaccttcttggaaagcttggcggacagctggttggtgccggagatctcggcggacttcatggtcgcgccgagggacgggcgggaggtatacaccgtggcgtcgccgccgagcagccacacttcggcagaggcgttgccgtcggcgtcgaacacgagcgcgttggacgggatcctgtgatcggcgtcgtccgggtccttggccttccacgcgtccttaccgtaacggcgcagcatgccgatatcggaagcgccgtcgttgttgtagtaggtgtagttggtgaaggagtactccgcgatctcgccccaatcgtcatgggtggtgaaggtggcggcaccgccgttccaattggatgcccaggtccagatatcccactgcggcacagtggtgctggtgtcctcggcgttgtagtacaggccgtcgtctcggttgtagtgcaccttcaccttgacggtgttggccttgcaggcgtaatcggccggtgccgaatcaagcgtctcgacagtggtcgcctcgccctggtccgggtacttggtgccgtcgatccacacctcggcggtgccgtcggcgctcacggtggcgctacggtcagcgccatacttgttccaatcgctggtggtgacgaggaagccgaacttgtcgtacttgccgtcgaaattgagcacggcgaccttgccccagcagtcagtgccggtgaaggcgtggtgcttggcgtccatgttgccgccgttcacatcggtgccccacacgtacacgccgcggttgtccgaggcgctggagggcttgtagtgcacgacgagacgggtcttggcgccgatggattcggggttgccgacggttgcggcctgatcgctcacgcccacatgggtgatgccgacgttggcatggtagttgccgccgcccttcgggttctcccaaccatcggtgtccttgtcgtggaacacgaagtcgatcgccttgcccttggtgttgatggtggcggtgtagtaaccctgcgcgtcgagggtcatgtcggcttccggctgctcccaatcgttgccgaggccgtaatggaccttcggggtcttccactcagagttggcgggcttgtagtagatggtgacgcttctgtcgtcgggcagggcgtcatcctcctcctggctcacgtcgggatcggacggatcggtggcggcggaggctgcggggtgcgaggccttggtagcaccggcatacagggcgatggcggagtgcgccggcaccgtggtctcgaccttgccacccttgacggtcacggtcttggagcagtccatggtggcgtacacgttgcagtattcgccgtcggcgagggatgtcgtgtaggaggcgtccttgtccttcttgccgttgttgatggcgatgaagcccttggctccgcgggagaaggcgatgttgtcgccgccgtcatcctgccaatcggcgaccttggtgccgttgacatagttgcggaaggcgatcatgccgcgggtggaggtccagcgctgctcgcagttccaatcggaatcgttggtggagcatgccttgtccatatccacgtcgggcacggaggtcgcggtcgctccgggtgcaccattgtcgttgacgtcccacttgtagtcggagagcaggcgcggggtgccgtagtcgtaggccagcatgaacgcgttggccagctggtacttggcgccgtccttgtaggtcagcgcaccctcgttgcgggcggtgtcccagttggtgacgaacacgttggcgtcatcggaggagagatccttgctcaggcgatcgctcagccccttgaggttggcgatcttgtccttgaaggtctggttcatctcggatttgaagccgaattcggtcacggtgccgttctgcacgtagttgctcggctggatgcccgcggcctcggaggcgttgccgatgacctcctgaatccagtagatgtcgttggcgttcttgccgattttcttggcgaacttctccttgatggccttcatgctgtcagtgtggatgtgcttgacggcatccatgcggaagccgcgcacgccggcgttccacagcgaggctaggtagtcggactggatgtcctgcaccttctcgctttcggagttgaaatcccacatggagctcaggcggcattcctgaacttccttctgattggtgtagtcggagatgttcttggtgcagctgtggaagtcggcggcggtgatgccgtccgggtactgcttggtggcgaagcccgggtagctgccggtggagccgttgtattcgctgccggccacgcccttctggtctccggcggccacgtcggcgccggtggtctggttgagcaccacgtcggcgatgatgcccacgcctgccgcggagcactgctgaaccatgttcttgaattcggcttccgtgcccagcttggagtcgagcttgtagctcacaggctggtagctggtccaccactgcgtgccttggatggattcctgcggaggcgagacctccacataggccacaccttccggaccataggtgttggtgcattccttggcgatcgtgttccacgtctgctggaacgcaatcacctggacatctttctgttgattggcctgcgttttggattgcgcctgggccacgatcggtgccgcgaccaacgaagcgcacgccatggccgcggtgacgcccatcgccaccacacggcctaatggacggtttgtttgaacgaccatcgttctccgttctcatctgtgaggccggttcaagcgcccatggcaggcgccgcgaccggcaacgtatgcgccatggacatccgcatccacgcggatgattcagaatccactcgacgatgaatatgcatacgtttacactctgaatcagagttaattgtatgtcaatggctgcgcgtggcaatgaaacagcgtgaccctctgctgcacatgcacttcatatatgccgaagtgcaacctgttgctgcaatcaaaatttttttctgcaagtcaagcagaaaacattcagaaatagctgcaaaaaacagcaaacgattgcaatcattgtctcacggtatacggtgtcgcggcgatatggaaggccactgcactaccggcaggaaccgtcagtgtggcatccccgtcgaaacgcacatgcacgctgccggaacagtcggcggaagcgtagacatcgcaatactcccctgccggcaaagccgtgtggtacgtcacagtacgtgtgcgcacggaattgttgatggcgatgaaggcacgtccccctcgaccgaaggcgatcatgttgtcgccgtcatcctgccaatcggagagcggcgcgtcgcctgcgacattatgccagccgaccataccgtgcacgtcaggccagcgttcggtgcagctccagccggagtctttggagcagtcaatatcgggcacgctggtcgcagtggcgcctgaagctcccgagtcggtgtcatggaattcgtatccggagaacacgttgggggcgccatacgggtaggccagcatgaacgcgttcgctagccggtaggcgtcgccgtccttgtaggtgagcgtcatgttgttgcgttcggtatcccaattcgtcacgaatacgctggccttgccactgtcggtgatgttctgcggaatgtctttgatcgacaggcttccgcctgccagcgagttggagaacagggacttaagccgatatgcgtactggaattcgttcacctggccggttttgagatagttcctcggttggatttcggcggcttccgcattgtcgccaatcacttcctgcgtccaccagatgtcgttcatggaacgtccggatttcttcgcaacgagtttcttgatggccagcacgtcttccggaggcatgtgtttgacggcatccacgcggaatccggcgacgccgtagtcgagaagcttcacaaaatagtcagacagcacgtcgcgcacgtgcgggcttgatgtatcaaggtcctgcaaacccgatacctggcagttccacacgctttcggcgtcgcggtacgtccagatagaacagggggcatggaagtccgatggcgtgtatccggcttcagggaaatagcctttattgtcgtaggggcttccggcggtgccggtcccttgtgttttgtcgacgccggtggtgtggttgatgaccgtatccgcgatcacgccgacgcccgcggccttgcattgccggaccatgttcttaaattcagcttcggtgccttctttggagtcaagtttgtagcttaccggctgatagctcgtccaccactgcgtgccttggatgctttcctgcggcggcgagacctgtacgtagccgacgccttcgggtcccagcacttcgccgcattcgcgggcgacggatttccaattggcttggaacatggtcacgatcacgtcgctgcggtatcgcgcaggattgaaacgttccccgccgccttcacgtgtcggcacgtgaagcgtggcgactgagacaccgaccgataccgcgacgcatacgaccgccgtaatgacacgtgtgattcttcttgcgattgcgcccatagtcatcgacctcttcgtcacttcgccatgctcccggtttgcatacgtttgcaatatcactgtataccaatccggggagaccgggatatgcgtcatcctcattggcacgaaaaagccggatgccttaaagacaggcatccggctgaatccatgacggaatgtcgatgtcagcgttcttccaacaagtgcgcaaccgcttcgattgccagcttgtagccatagaatcccatgccggtgatggtgccggtggccaccggagagatcacggaacgcttgcggaactcgtcgcgtgcggacgggttggagatatgcacctccataagcggcagtccctcgtcgatcaccatgtgcgcggcgtccgccaaaccataggagtaatgcgtgaaagccgccggattcatcacgatcggcgttttctcgtccgcggcctgatgcatccaatgaatcatctcggcctcgtcgtcgctttgacgcacttccacgtcaagccccagttcatgaccccattcggtgcacagtttgcgcagggtctcaagatcctgcttgccgtacacgtcgggctggcgcactccgagacggccgaggttcggtccgttgacaaccactactttggtcatattgcttccttttgtgttcgttcttgcgattgcgtcctaccgctggatgcgtcggaacgcctcctcgacggcgtccgccggcggatcctcgaggtggatgggatggccgagcgagccgagtatgacgaaacgcagtttgttgccgcgggccttcttgtctcggtgcatgagcgccagcacatcatcccagctgccattgttccatgatgtcggcaggccgagcgagccgagcagcgaacgatggtagtcgaccagatcctggtcgatgtagccgagcagatgggacagttcggccgcatagacgcaaccgacggcgacggcgttgccgtgcctccagcggaagtgttcgagtttttcgatggcatggccaagcgtatgtccgtagttgaggaattcacgcaatccggcttctttgaggtcggcggacacatggtacgccttcaccgtcacggtacgttcgatgagttcggcgaccacatccttcagatcggagtcaaggaacgtcgaaccgtcgaacgagcgcagctcgtcggcatggtcttcaagcatgcgcagaatctccggatccatgatgaaaccggatttcgccacttcgcccagaccttcgatgaagatgtcgttcggcaacgaggcaagtgctcccatgtcggcgagcacgccggccggcgtatagaacgagccgacgaggttcttgccttgtggagtgttgatgccggttttgccgccggtggaggcgtcgaccatggccagcagcgaggtcgggcagttgacgtagcggatgccacgcatccatgtggcggccacgaaaccggccagatcggtggctgcaccaccgccgagaccgacaatcgcatcagaacgggtgaagccttcctcccccagacgctgccagatgccgttggccacttcgatggtcttgccggcttcagcatcgggaatgacgatgtcgtgcacgtcataaccggactggcgcaacagcgtgcgcgcgcggtcggaatgccgttgcaccgcctgggtgtgaatcaatgccactttggcaggcttgtcccccagcacctgcgcaagctggctcatcacaccttcgcctatgcacacatcgtatggttcgatggtggatccggtgacgtggacgatacgttgatcgatcatttccatcagctttctcgcggccacttgcggggtttgtccgtgggtgcgcacctgcacattggccacgcgtctgaacaccgggtcgcgttccttgtacaacttcttccaacgctcgttggcgtcgccgttgagcatcggacggccgccgccgcggttggcgcgttccatggcttccttcggatcggccatcaaatacacgaccttgccgccgtcggcgatgtattcggcgagcccctgctggatggacggggtcattggagcgcccccgcccaaggagaagatgccgtcgaaatcctccagcatgtcaagcacaacgtcgctttccagcttacggaactccggttcgccgtacctttcgaaatattcgggaatcttcattcccgcatcatgttcgatctcgttgtcggcgtcggcgaacggcagttgcatcatctgcgccgcttccttgccgacgcgggtcttgcccgcgcccatcatgccgatgatgacggcgacgggtctacgcattccagccatcgaatcggtcacctcatgtgctccggccaggacgccacataggattcggcgttgcgcttggtttcggccacgctgtcgccgccgaacttctccagcacgtattgagcgatggtgaggcgcaccatcgcctcggccacgacggccgccgcgggaacggcggtgttgtcggaacgctggttgatggcctgggccgcctcgccggtggtgacgtcgacggtgcgaagcgcctttggaatggatggaatcggcttcatcgcggcacgcaccacaatcggctggccgttggacatgccgccttcgattccgcccgcacgattgctcagacgtgtgatgcggccatcgtcgccaaccaccatttcgtcgtgcgcctgggagccgggacgcatcgcctcaaggaaaccgtccccgatctccacgcccttgatggcctggacgcccatgacggcactggccaatgccgcgtccagcctgcggtccgattcaacgtacgtgccgattccagccggaacgccgtataccacgacctcgatcacgccgcctaaggtatcggcgttctccttggcctcgtcgatgcgtgcgatcatctgctgttcggccgtcttatccaatgtgcgcaccggcgaagcgtccaatgcttcgaggtcctcaggcttcggcagcaccgcattctgcgggtcggtgatgccagcaccaccgattgacagcacatgggagacggtacgtatgcccaacgtctgttcaaggaactgcttggcgacctcacctaaggccacacgcgacgcggtctcacgtgcgctggaacgttccagcactggacgggcgtcgtcgaaaccgtacttgcgcatgccagtcagatcggcatgccccggacggggacgggatagcggcgcgttgcggccttcgcgcggaatgtcatggtcaagcggatcggcgctcatcacctcggtccatttcggccattcggtattggcgatctcgatggcgacgggagagccgatggtctcgccgaaacgcacaccggtgagcatgcggaccttgtcctgttcgaatttcatgcgcgcaccacggccatatccgagacgtcggcgtgccaatgcgccgacgatatcctcagtagtgacgtggatgcccgcaggcagcccctcgatcatggcgacaagcgcttcgccgtgcgattcacctgctgtctgccagcgcaacatgccaacactccttttctgccaaatacgattcgtggactatcttaacggtatgtggtacatgatttgcctgccgagtctgctctgtggaatggccgtcagcgttgaggatatccgggcacgacgcattccacgcatgtggatcgccgtagggtgtttggcgcaggtcattgtggacatcacgtatgcgttgtccgttaattcactgtttctggcattgcaggctctgttgttcgccgcgttatccgccgtgctgcaatgtgcgcttgcgctcatcaagccaggggctttgggattcggcgacgtcaccacgacgttgcttatcggcttggccgtaggcatgttcggcctgtttccagtggtgttctggtggtttgcgattagtgtgctggggctgctgtggcttgcgatttggacacggttcgacccgcagaagcatacgcgattcgccggtaagacgccgttcgccccgaccattgtcgtggccggggcgataagcatcgcgatgcacgcgttgtgttaatgcgtaataccgtcagttggcattcgcgttgttgcttttgtattcgtcgcgaatcttccagaattcgtcttcggtttccacgaacttcgtctcgccggtcttgaggttggtggtgacgaagtacagccatttgccttccggaggattcatcgcggcttggatagcggaatcgccgggattgctgatcggcgtcggaggaagtcctttgttcacgcgagtattgtacgggttgcttccatcctcaagctgctcgtctgtcagcttgctgcctgtggtgttgaacccgtaggcaacggtgctgtccatgcccaacggcatgtcctggtcgattctgttcaggatgaccctcgccaccttaccgtaatcgtcaggattgcatgcctcggattcggcgatggacgcgatgttcatgatacgttcgcgttcgcttccatctggcacgcccaatgtgtccagtttgttgacgcgtgccgtgaccatttccttgaggatgtccttggcggacttgtcctggacgctgtaggatccgggctcaagccatccttcgaatttgccacccgcttcatctggcagaatgcccgcgccgccaccgtcgatgaccgcttggaattcggacacgtccttgcctgacatcttggccgcgttggcgatgacatcggacacccgttcgccggccttgacttcggcgaaaccgccggccttgctttggtcggacaggatcttgacgacatcggccgctttcatatgcgtcttcaacgcgtacgaacccgggtaaagcgtcgcgccggcggccgcgactgcggaggtgaacgccgattcggatttgacgatgtccgccttgaccagatttcgtgcgatttcggctgcgccttgtccggtttccacggtgaacgtcgtgtctttgtctcccgaaccggtgtaatcctcaatctggatttgcgagccgttggcgttcatctgcctgagatgtttaaccatgcgcacaccgaaaaagccgccgacgacgacaagaatgacaacgacggcagccgcgatgattgtgacatagcgacgacgacgttgttgctcacgtcgtttacgcatgtcgcgtcgcgatttcggcggttgcggcggcaacgcggcatcgaatgacgagcccgctgacgtatcatcgacccactgcgcgttatcggagaaaaaatcgttcagattatcggtcaaaggtctctctccccttactctctgcttcggtcgagcgccgtctgcaaaatcaccaccgcagattgctggtcgaccatcggacggtgcttgcgtccgccgatgcgcgcatcgaacaactgatgatgtgcggtcactgtcgtcagacgctcatccaccaattcaatggtgggaacccgcgtcaccgaatatgattcatcctccacggccgcatgcagtcgtttttcaagattgacggaccagcgtctcgcttttttggcgcttttcccctcttcgccgttcagcagcaacggcaggccaatcaccacatggtccaccgactcgtccccaatgacgtcgatgacttcatccaacgcgcggaaagaatccccatacacttgaatattgcctatgggatgtgcgagggtgagctcgggatcggacaacgcaagtccgacccgagcatcacccagatcgataccaagccaaaccatgcttggagaatcagcccttcagagcctgaccggccaatgcctcaagtgcctcgtcgatcttggtggcgtccgcgccgccaccctgtgcgaagtccggcttgccgccgccaccaccgccaagaaccttggaagcgccacggaccagatcaccagccttgatgccttgcttgcgtgccgcttcgttggttgccacggcgaccatgggcttgccgtcctcgttcatgccggcaagagccaccacgaccggagcatcttcgccgagctggccgcgcacgtcgagcacggtcttgcgcagcgcgtcgaaggagccgaaatgtccaacgttcttcttggcgaccttgaccggagccgaggaagctttggcctcagccaccagcgtcggcacagaggccgcaagctgggactcgtacattgcggcaagacgacggtcggattccttgagcttggcaagcagcatgttcacacgctcggcgagttcgtcgggacgggcgttgaccatgtcggaaagctgggaaaccagcgcgtgctcgcgggcgttgaactcatacgcgccctggccgacgaccgcgtccacgcggcgcacgccggaaccgatagacgcctcggacatgatgttgatggcgccgatcttgccgacgtggtcgatatgggtgccaccgcagagctcgcggctccagccgtcctcgccgatggacaccacacgcacgatgtcgccgtacttctcgccgaacagatgcatggcgccaagagcgatggcgtcatcgaacttcatttcctgagtggtgacggcaaggttctcacgaagcttctcgttgacgcgggcttcgacggcgttcatggcgtccttgctgggggcgctggaccattggaaatcgaagcgcagacggttcggagcgtcttcggagccacgctgggtggcctgcggaccaagttcctcacgcagcgccttgtgcaccatgtgggtggcggtgtgggaacgtgcaatggctccacggcgctcgagatcgatgttcgcgttgacttcggcgcccacaaccagcgtgccttcggtcagacggcactggtggacgataaggtccttgatcggcttctgcacgtcgtcgacctcaagcaccgcgccatcgtcggacagaatctcgccctgatcggcgagctggccgccggcctgcgcgtagaacggcgtgcggtcgaggatgacctcgatgttggccgggccggtgacggcgggaacggaacccttgccctcctgcatgatgcccagaaccttggcacgtgcggacatgtcggtgtagccaaggaagtcgatcggctggagcagggtcttcttgaagtcgtcatagacggacaaatccacgttgtggcgcttcttcagcgcgtccgcacgggcacggctcttctgttcggccatcagctcgcggaacttggcttcatccaccttcacgccctggtcggcggccatttcgagcgtgatttcaatcgggaagccgtaagtgtcatgcagcttgaaggcatcctcgccggacacgagatccgaaccgccctgcttggccttcgtcacggccatgtcgaagatctcggtgccggattcgagcgtgcggcggaacgcgtcctcctcaccgtaggcggcttcggacacgtcgtggaaggtgtcgttaagctccggatagctcggttccatcgcggccttggaggtcggcagcaaggtcggcatgaccggctctgtcacgccgagctcgcgcatggccttgacggttcgacgcagcaggcggcgcagcacatagccacggccgttgttggacggacggacgccgtcggacatgatcatcagcgcggaacgcacgtggtcggccacgatacggaaacgcacgtccatggcctcgtcatcgccgtaggtgcggccggaaagcttctgcgcggcttcgatgaccgggaagacctcgtcggtctcatagatgttctgcttgccctgcatcagataggcgagacgttccagaccggcgccggtatcgatgttcttgttctcaagctcgccgacgatatgcaggtcggtcttggacttgacgttgtcgacctcgtagttttcgaacacgagatcccaaatctcaatgtaacggttctcgtcggcgatcgggccgccttcgacaccgtactttggaccacggtctacatagatttcggagcacggaccgccagggccagggccaccggtggtccagaagttatcttccatacccatgatctggatatgttcaggatcgacgccttcgttcttccacatcgagcgggcttcctcgtcgtcggtgaaagtggtcatccacagtttctccggatcgaagccgtagccgcccttatcctgcggggtggtcagcagctcatacgcatagtggatggcctcctccttgaagtaatcaccgaaggagaagttgccaagcatctggaagaacgtgccgtgacgggtggtcttgccgacctcgtcgatgtccagagtacgcacgcacttctggttggaagccatgcggtgcttcggcggggtctgctcacccatgaggtacgggatgaacggaaccatgccagcgatggtgaacagagtggtcggattcggagaaatcaacgatgccgaaggaacgacaagatgatcgtgctgttcgaaatagtcaagaaagcgcttcgcgatttcagaagtgcgcatgtggatttgagctcctttgttgttggaggcctgatgccttccaaacgtgtgattggttgcttgagcgtatctgtcgggcggaaaacgactactcgttccgcgccgcatatttgctgttaagttcagcctcgcgggctcgacgcgtggcattgaactcattgaccagaccttcaagcgtgcgcatggtcacatggtcctggtcgggaccaagcaggaattggcgggcggtgtccggtgtgttggctttaacgtatgcctgcgcttttgtgacagcgacgacaccgatgcccacgccgatggagacccagaaaagacgcttgaacatcactcccccttattgcctgccgcgtgattgacgtctctcttagccaagaaagactgcacagtggacttcaacgcataggtggcggacgcaaccttgatgacgggcttgcccaagaacgatccatatagatcagtcagcgcgccgacattattggccgtagtggacgccgcggcggagatcttgttgacatcctccagggacttgttcacctgctgcaccgtggtcacgctctcgtcaagcgccggaatcgcatggtctccggtgtctttgacggtctgcgcgatctggtcgaacaatttgccgagacggatcagcgggtagatcatgaaaccggcaagcaccgcgaatgcaattgccgcaatcagaccggcgatctctccaacacccatcttgtacctcttttcagctccacggttgcccgcgaacacaatacccgcataagactagtaaaaagccacgactgtggcaaatacgttcactggttgtacgagaccacactcaccgcgcggtccatgggttcgttcgtgtcaaaatcaaggcaggtcaccgaaccgttggccggacgttcgctcaaatcgtatccttccggggcgaatcggtgcataaggctcaacaatgtattgccgtgggagatctgcagcacgtggtcgccgtccttaagccgagggttgtccgcaatcaaagcgaagccgtcctccacacgatgccaatactcgttatcggattcggcgtcatggaacggatcggcttctttgagaaagtcgcgggtggcggcaagcccgtatttgcggacgatgtcgttgtagttcttcgcaccatggggaccaccggcagcggtccatgcgacggacatgtcctgtccctcgaaataaccgtagaactgctcacggaaatgcatgtcgctgaccagtgacggacgaacgtgtcctgcggcttcgttcgcatcgaggatccgttgtgccgtcacctgggcgcgtgtggtgtcggagcagtatgccgcggcgaactcaatgtcccggagtttggcggcggccttgtccgcatcggcaagtcccgcatcggtcaacggggaattcgaccatccctggagtctgttatatcggttgaagaacgtctgtccgtgacggaccagatgaagatgaagcaacatggtttccatggtacctgtggaatcagccaaacgacatgccgccggaaacgccataaaaaacgagaagcctcgcaaccgtaacggctgcgaggctttcgctgtatgtccttaaactgtatgttcttacagtatggtgatccagatcagcgggcgtagaattcgaccacgtactggatgttgacctgcaccgggatctcctcggcttcaggcttgcgggtcagggtggccttcagggaaggcaggttgacgtccaggtagcccggaaccgccggcagcacatcgcggtgcacaccttcggcagcggcctggaacggaaccatggtctggctcttggccttgacctggatggtctggcccggcttgacgcggtaggacggacgatcgacgatgttgccatcgacgaggatgtggcgatggaccacgaactggcgagcctgggcggtggtgcgggcgaagcctgcacgcaggaccagagcgtcgagacgggtctcaagatcggtcagcatggcgttgccggtctggccggcggtgtgggtgcccttctcgtaagcggcgcggagctgcttctcggagatgccgtactgggcgcgaagacgctgcttctcgcgcagacgcactgcgtaatcggattcagtgcggcgacgggtgcggccgtgctcgccaggagcatacggacgcttttcgaagatgcgctgagccttaggggtcagagcgatgccgagggcgcgggaaagacgcacctgacggcgggaacgctgaacgttcgtcattggtttaatcctttgtttgttctgtcgttgtctgaacggaacgtatgccgaagtccgacatacgctgagccagcctctccagtgcttcttcgcgcaatgcgcgaacggcttgacccgcaatgcagaacaccacggatggccgccgacccactgatgggctaagactccagacggcatacgtccttccgggcgcacaccaatcgctaatcatacacatgggggacggacgagatgctccgattcacctacatcggcatgtcttaaaaacgtcaggcccgagtaagcactcccctatccatacgataggtatggtccacataagcaagcgcgtccggatcatgggtaaccataagtaccgaggtaccgtcatccgctacttgccgcagcagccgcatgacgattgcggtgctttcggcatccagatctcctgtcggttcatcggcgatcagcagtttcggcttgttcatcaacgctcgggcgatggagacgcggcgcatctcgccaccagagagctccttcggatagcatgtcgcaagctcgcctacaagcagttgatccaacagatgttgcgcgcgttgcgtcaaatggtcgggctgagatgaagaagccgtctgcgtcgaagctggttggatgacgtcgggaaggccatcgaccacgacggaagacgccgtctgttcctgtgattgtgcgtcattcgtccgttcatcgatttcggtttcataccgagacgggttgcgatgcagcactgcgggaaggaccacattgtcgattgcggtgaggttcggcaatagtgtctggatctgcgtgacgaagccgatggtgcggttgcgcaaaatcgacatctgtttgtcgtttaacgtggtcacctcgttaccggccagcagaatcgaaccggatgtaggtttcagcaatcccgtgacgagattgagcaaagtgcttttgccgtttccggatctgccgacgatcgccatgaattcgcctggatcgagcgtgagattcacatcatccaccgcggggaaaggtttacctcggcgtacgaattcacgggtaaggccacgaacctccaatatgggctgttccggcatcactcccccttcctcagcgtcaggtatgcctgtggggcggaaagacgcaccgctgtggcgagggatgcgaccaggcccgtaagcacggcgaacaggagagcgacgactatcagtaccgccactttaccgacgccaatctgcagatacggcaattgaagttccttagcgatcagaccactgaacggaaacacgaccaacgaggtacaggtcacaccgatcacacctccaatagctccgatggtcgccgattccttgacgataatgcccaccagggtcgcacgatcggcgccgagaatacggtacgcggcgaattcacgcttgcgttcgttcatagccgacgaaaacaccgccaacatcacgaccaatcccatagtccagaacaccgtgatgaacaccgccacatagcggatgatcaccttgagattcgttttcgtcgtagccgtgatgccgcccggatacacatatcccaaacttttgatccccgtggcttttgcgatattcgaggcgacctgttgtgcggaatatccgtccttgactttgacgagcacggcggacaccgctttgccggcgtattcttcaggaatcgcggcatgtccgacctgcgcggaataggaaacgacatccggcaccgtgtccatgttcacgaatatggaattgtccagtgacgttccggtatcggccagttgcgcggccacggggaattcatgaccgtacagtttgaccgtattgttgtccgacacgttgatgctggcgcctgctatgatttggccgcgacggagtgtgccgtcgaattgcgaagccacccaaggagtgatgacgaagtcggtgtcggggttgaagccgatgatctgcaccttttcgtcgcagcaggctgccgcaagcgaggagatgtacgtctgcaccgtgctttcgcccacaccgtccgcttcggcgatttggcttccaatgtcattggtgaagtagaacgtgctcgaagagtttcccgtaagcaacgcctcagcctggtttttcgtgttctgcggcgtgaccatcagatcggcgcccatacgttcccgcatgctgttcaacccattgttcaggttcatggaaagcagtgcgcctccatagaacgccacagtgagcatgacgaccacaatgacaagcgccgaagtgcggaatggtttgcgacgcagattggccagcggtagtttcgcaagggtgatatgcggcacgtcagccacgctttgccggcttgagatcgagatatacggcgactgctgcgagcaccgccagcagcacgcccaatacgataagcgtcggcatcgtcaccatatggcaatgcatcatggagcctctgcatacgcctaccagcatggtcggcaccagaacgacaagcacgcccagcacggcattggcgatatccaatccggccctgacccggcttggcgcgaaaaatccgattattgccagcaatgcgatgacgacacccagtcccagagcgacccgagcggtgtagcggcatgccatgggcatgtctttgacggcacacacatgcgcgaaggtctgcggggcgatgacaatcagcgcgcccagaacaatctgagatatcgcggcgaacagttttcttggcatggttcttcctctcgaaaagcaaacatcgccgattatcgcaacaaatgctccgaaagaaaagacttgttttttcactcaatccgtgttatgagcccacaacggcgccgccacgtgtggcgcctattggaaaagccgtcagagcttttcaataggcgccacacgaagcagcaatcgtttgacgccatccgtgccgaaatcaacggtgatcaccgaattcgcgcccttgtcctgcgtttcgatgacctttcccaaaccgtaatggtcatgggtgattctgtcgcctatctggaaatccgagatgctcaatccgttgttgccgtccaacgaacttgccggagccgatttcgtcagatcctttggcttggcgcggcgcgtggtgaccttaccggatttgccggagggcttgccggaaccgtatgacgaccgggatgagccatacgaaccgtatgaggacgagccagagtgcaatccgccagagaaacggcggcttcccgagccgtaggaggaccgtccggaaccatacgagctgtgcgatccatgagacgacccataagtggaatgcgatccgcgagaaccagaaccatacgatgaggaaccgtatgtcgacgatccgtacatcgattcgccgaaggaagtggatccgaaatcgtcatcatcgtcccacccgccgaactcgtcgtcatctccccagctggcgcgcatgcgctccacaccggcctcacgacgtttccaatcgatgagttcatccggaatctcatccaagaactggctgggcatcatgtcattggcctgcccccattgggcacgcaccgccgcacgggtcacatacagccgacgcttcgcacgggtgatgcccacgtatgccagacgacgctcctcggacagctcgctggtgtcctccatggcacgctggtgcgggaacgtaccctgttccatacccgtaagaaacacatacggatattccaaacctttggccgtatgcaaggtcatcatcgtgaccttgccggaatcctcaccctctcccggcaactgatccgagtcggcgaccaatgccgtggtctccagaaaaccggccaacgtggcatccggcgtgttctgttcgaattcggcggccacggactgcaactgggaaagattgtccacacgcgaagcatcctgcggatcctcggaacgttgcaattcctccagaagaccgcttttatccaatacttcggccaccacttcggatggtttcgaatcatgttccttggcgaaatcggccagctcgtgcatcagatcacggaatgcgcccaacggtttggtggtacggcctgtcatgccttcaatctggtccatatgttcaatggattcgaagaacgtgaggccatgcgcgtccgcgtagccggccaccaatccctccgcgcgtgcgccgagtcctcgtttaggcacattgaggatacgccgcacgttcacattatccgcgggattcacgatggcctgcaaatacgcgatggcgtccttgacttccctacgttcatagaatttggtgccgccgaccagctgatacggcagattggcgttgatcatggcctcttccagcgaacgtgactgcgcgttggctcggtacatgatggcgatgtcacggtaagcgacgtcttcctcggtgtggattcgtgcgatttcgttcgctatccatccggcttcctgctgtgcgttgtcggcggcatagccgacgattttgtcgccttgaccaagcgccgtccacagtttcttcggcttgcggttttcgtttttcgcgatcaccgcgttcgccgcgtcgaggatggtctgcgtcgaacggtagttctgttcgagcatgatggttttggcgttcgggaaatcctgttcgaagtcttggatgttacggatgtccgcacctcggaacgcgtagatggattggtcggaatcacccaccacggtaatccagctcggtcccacacggcccgctcccctcgcctgcgggtcgggctgttcgtccgaatcgatgccggacaattcacgtacgagcacatattgggcatggttggtgtcttgatactcgtccacgaagatgtaacggaacctgtgccgatagtattcgctcacctgcgggcaggtttggagcaattccacggtgcgcatgatcaaatcgtcgaagtcgactgcgttggcgagcgccagacgatgctggtattcggcgtagacgacggcgaccagttcgtcgacgtcgccggcgctcacctggtatccgcgctgtcccgggatgtaatcgcagttcgcttttttcagctggtctttccaggaaaccaacgcgttcttgcagtcggatatcttgcccagcagcatgcgtggcgtataccgcttcgtatcgatgttcaggtcggctgcgatcagtttgaccagtcgctcgctgtccgcggtgtcgtaaatcgagaagcccgatttaaggccgatttccttgccgtcgcggcgtaggatgcgtacgcaggcggagtggaaggtggagatccacatatgttcggcttccggcccgaccaaagtcacgagacgttcacgcatttccgcggccgccttgttggtgaaggtgatggcgaggatgctgcttgcccagaagccatgcgccagcagccatgcgatgcgacgtgtcagcacacgggtcttgcctgagcctgcgccggcgccgatgagcaatgcctggccgtagtatttcaccgcttcttcctgttgggggttgagtccctctatcaggctccgcggatcgcacatcacaggtcccatgctctgttccaccgattcctcttttcttcgcgcacgctcatattcaaacatttgttcgcagcattcatgtttatcacatgagcaggtcaggggtccgactcgcacggtcaattgaggcgcgtatgctgaactcctatatacggctcgccgtatgccatcatctgatgccgctttcgcggccgacaagattaaggggtttcatgaaggaacttgaagagcgcattgcgcaacaaggtaccgtcaagcccggcaatgtgctgaaagtggacgcgttcctcaaccatcagtgcgatgtcgagctgttcgaccatatgggcgccgcctgggccgagcatttcaagggcaagaccatcgataagattctgaccattgaggcttccggcattggcatcgcctgtgtcgtggcccgtcatttcggcaatgtcccggtggtgttcgccaagaaggcgcagtccatcaatcttgacggcgaccagtacacgaccaccgtgtattccttcaccaagcagaaggagttccctgtcatcgtgtccaagcgctatctcaatgaaggcgaccacgtgctgctgatcgacgatttccttgccaacggcaaggcgttaaaaggcctgatcgagctgtgccatgaggccggagccactgtggaaggcatcggcatcgcagtggaaaagggcttccaaggcggtggcgaccagctgcgtgaggaagggtacgacgtcgattccctggcaatcgtcgaatcgatggatccggaaaacggcaccatcgaattccgctcctgattttttcagtacgctcagacgattataagagaggatgtaacagttgagcgaagagaagaacacagagaaaaccgaaaaaaagacaaaggcaaaagacactaaaaaaggcgtgtcttttgaggcgttgagcagtcttgacgcaccggtgtcgttctggaagggcattccgttcggcctgcagcacgtcatggccatgttcgtggcgaatctcgcgcctatcttcctggtggccacggccgccaagatggatgccgcgcagtccgccgccatcattcaggccggcctgctggtcgcaggtctcggcacctgcctgcagctgtacggtgtgtggctgattggttcccgtctgccgatggtcaccggcatttccttcacctacgtcgcggccgccatgtcgatcgcgcagcatcagggttatggcgcagtcgccggcgccgtggtgcttggcggcctgttggaggtcgtgcttggtttgacggccaagtattggcgtcgtttcgtcccgccgatcgtttccgcgattgtcgtcacctcgattggtttttcgctcctgtccgtcggcgccacgagcttcggcggcggttccggcgcgaaggatttcggcagctggcagaatctgacgcttggcctgatttcgctggtggcttgccttgcgttccagctgctcatgaagggcaccgccaagcagctttccgtgctgttcggccttgtcgtgggctatgtggtcgcgattttcatgggaaaggtcgatttctccggtttcgccaatctgcaggtcgtgtcggtgccgcatttcatgccgttcaagcttgagtttgatccgggcgcgattatctccttcgctctgctgtatgtcgtttcctcggttgaggtgttgggcgacacagcggcgcttaccaaggtcggtctcgaccgtcaacccaccgacaaggaaaccgccggagctattgccggcgacggtttgatctcctccgtgtccggtttgttcggctgcctgccattgacttcgttcgcgcagaacatcggtctggtggcgatgaccaaggtggtcaaccgcaaggtgattctttccggcggtctgattttggtgctcgccagcttcgttccggccgttgcagaggtcttcaactccctgccgcaggctgtgcttggcggctgcaccatcatgatgttcggcaatatcatcctgtccggattccagatgatttccgaggccggttacacgcagcgcaacatcaccatcgccgcgttgagcctgaccattggcatcggtttcacccaggtcggcgacattttcgccaacttcccggcgctgttccagtccatcttcgcttccaactgcatcgcggtgtcgttcgtggtggctgtgattctcaacgccgttctgcctagcgaggagcactttctgtccgctcctcagcatcaggaggcctgatttccctaatatcggcatcgtccgcatatgaatgatccccattccgatttccacggaatggggatcattcatatgcgacggcatgtggcggacctcgtatggaagtcgtcaacgcatcaatcagtgcccttgcttgatccaagcggcgattgaatccttgaccgcctgcgcgtagatcgtattggacattcccggatggatgccatctccggcaagttcgtcagcatgctgggaaatggtcccgtcccaatcgaccagtacgacgttgttggaatgcgccgcggcgaattgcttcaacacggcattggtgccgggaacccatgaaacgggagcgtgcgcgttaatgagcaccagcacatgatcggggccgacatcattcagcagatcgtcaagctgattattggtcaccacggagttggtggcaagtcccaccaagacccaggggcgcagatttccttgcgctttcaattgatcgacaagaccctgtcccttcgccatcgaccgtgagacttcggcatccacaatgatgttggggaacgtgtcttgcaatcctttgctggacgccagcatcaccgaatctccgatggcggccatttgcgaaccatccggcatcttatgtcgtggcttccttggcatcggtgttctgcgtcgttccaaagcggcatgattgcgttgctgcaacagcctggaactgatacccaaggattgcgccacactggtttgttccggtgccgtcgccacagcgtatccgcagaagctccatgagcatgccagcaccacgaccgtggatatcagacggccgcaatgctcggcttcgtctccactgatcggacgaatcaacgcgatgaatcccgcacgagcgactggcttctcgaacagtcgccaagatgcgaacgcgaacagcacggtgaggatgaaggtgaaggacagcagcctgtcggcatgccatgcgccccactggggcaacagggatctcagcagcagccataatggccaatgccacagataaatgccatacgaataatggcccaaagcggcaagcggcttgaacacaagcagatcctgcatccaggatccgaatggtatggttcctgcgatcagcaccacagcaagcacggaggcgacgaagataccgccatggaacgccgctgggccttgagtgatatgccgcatcatccacagcaatgccagcaatgagccaaaggcaactatcgggccgaattgaatccatatcttatggaatcgttccattatccgcgattcattggctcgcccatgctcatgtctgagaatcggcagtatccaagccagcgcggcaccgagccataggcccatggcgtgcgtgtcggtgccgaaatacacacgtgtggggtcagcgccagagtggtatagcagtcccatggatgccgcgcttgctccggcaagggctgtcagtatgcataccggagcccatctgatgatgatttttcgcagcagcaaaaccacgaatggagcgatcagataaaactgcatgagcaacgacatgaaccataggtgacggaatatgtcagggttcatctgggagaaatagctggctccgctgctgatggcataccagttgtagcatcccagaagcacggtcatgatctggttccggatgccgacaagcatgtcgcggttcaccagccatgccaacgtcgccgagatcgggataagagcaaacagcgcgggataaatccggcggaaccgtttgaggaagtactcccccagttccaagcctttacctgaatcgatacgattgagcagcgatgagaaaatcaggaaaccggagatggtgaagaacacatccacaccgaaaaacccgccttgaagcgaaagctcatcgcagtgatacagcacaatcgcaataagggctatgcctttaagcccgtccaaaccgacgaaacgtcgtttagcagccacgaataaccaaccgttctctcttacatcattgcacggtacagtgcaacctgtcgtatcgtactaccaagcaatcccttgcgaatcgcggaaaagggggcccaacgcactgcgccgccgtgcctgattgaccgatgatatcgattatcaggcacggcggcgcagattcataccgtttgccgtcacgttcctctaccagccgaaacgtgacacgtcactcacttggagaagacgttgccgtaggagtccttgccttcttctgcgatggcggcggacttgcgggcgatggccagctcctcgttggtcgggatgacgcagatggtgactgcggaatccggggtggagatgatgcgcggttccttggaacgggtcgcgttcttctcctcatccagcttgacgccgaacggagcgagcttgtcgcagaccatcttgcgcacgacgtcatcgttctcgccaacgcctgcggtgaaggtgatcacgtcgacgccacccatctgagcggtgtagttgccgatgtagccgacgatgcggtgcacgtagatgtcgagagccagcttggcgtcctcgttgccctcttcgaccagacgatgcacttcacgcaggtcgccgaagccggtcagacccatcatgccggaacgcttgttgaacagggtgtccagttcgtccacgctcatgtgggcgttgcgaatcaggtggaagacgacggccggatcgatgtcgccggtacggccacccatcacgaggccttccagcggggtcagacccatggaggtctcaaccggcttgccggagatttcggcggaggcggaagcaccgttgccgatgtgcagcacgatctgcttgaggccttcggccggcttgccgatgacggacggcacgacggaggagatgaactcgtgggaggtgccatgggcgccgtaacggcggatgtggtactgctgggcgacttccttgttcagcgcgtaggtgctggaagccttcggcagctggaagaagaaggaggaatcgaacacgaagatctgcggaacatccggcagcagggagcgcatgacctcagcgcccttggcctccggaccgttgtgcagcggggcgagcacggcgaggtccttgacctggccgatggtcttgtcgttgaccagagccggcttcgggaaaatggaaccaccctgcaccacgcgatggccgacggccacgatgcctgcgtcggcgagcttcgggccgaactcgtcgaagaagccgagcacgcgcttcagaccctgctcatggtcgtgaatcggctcttcgagctcatgcttctcgccgttgtactcgtgcttgtaatgaccgtcaaccggctcgccgatcttctcgaccagaccggaagcgataccttcgccggtttcaagatcaaccagctgatacttgatagagctggaaccggaattgatgacaaggacggttttcgccattgtgggcatcctccatgtgttaatcgatgtgccgcttacgcgactttccaaaaccttagattactcgttgcttgctacaaaatgcccgattactgggcttcgatggcggtcagggcgatggtgttgatgatgtcctggaccgtggcgccacggctcagatcgttcaccgggcggttgagaccctgcagcaccggcccgacggcggccgctcccgaggaacgctgtaccgccttgtatgcgatgttgcccgcgcacagatccgggaatacgaacacattgacatggcccgccaccggatcgcccttggctttggtcgcggccacggtcggagaccatgccgcgtcgaactggatcgatccgaccaccgcaaggtcgggagccttgtctttgacgatggtggtggcttcctcgacgaggtcgacgtcgggtccttttccggagcccagcgtggaataggacagcatgcccaccttcggttcaaggccgaacgccttggccgtttcggcggattggatcgcgatttcggcgagctgctcggcattggggttaaggttgatggcacagtcggcgaacacggcgacatggtccttgaaacacatcaggaacgctccggataccaacgatgttcctggcttggtcttgatgacctgcagggccggacgcacggtattggccgtggagttgacggaaccggacacgaggccgtccgccatgcccatcaccacaagcatggtgccgaaatagctgtcatcggccagctgtttgcgcgcctgctcttcggtcatgcctttcttggcgcgcagctcgcacagcttcgccaccatgggttccaacaccgtttcatcatccttggcttggaatttcgccttgccaagcgatttcaatcccaattcctgaccacgggcgagaatggcgttttcgtctccgacgatgatcagatcgacgatgtcgcgttccagcagataatcggcggctttgatgatgcgatcctcgttgccctccggcagcacgatggtcttcttgtccgccttcgccttgcccagcagaccgtattggaaagcatagggtgtggtcggggcgtcgaatggcgattcgagtaccgcggtcagttccgcggcgtcgacgttcgtcgcgaacgcttcgtctgccttgctgatggcgtcatcgtcattgaaatcgacggcaggtagcgtccacaccggcaccgggtagtcgacgaagcatgctttgagcggatccggctgcgtgtcgtcacacccagtaatgaacacgccgacgactttgctcccggcgtcttcgatgaccttggtggatgcctcaaccgtgcttttgacttgttccggtgtgcgttcgatagtgcatacggccagcaggaccggcgattggaggtctgccgcgaagtcagcgttgaaagagaacatcgcgggatcattgactgctgacctgtcggtgccgacaatcaccatggcatccggtcgggctgtttctacggcttgggtgtaggccgcaacgatatccgcccgcgaaccttccttatcgttacgagcgcgcttggggcacacgccgacggactgttcccggctcaaaccggcattggaagcttcgatcagcacgtccgtgaaggtgtcttttctgcagaccgccggacggaacactccggtcttgccggctgcggcaagtgccttggtgactccaagggcgacaacattacggccgttagccgcttcgggactgatgatggtgacgctggtaaaactcacggtgtctcctatgtacttcacattattcgggtgcgataccacatcgttcgcacaatgagcaattgtaatgtgcaaacggtaactgacacgcgctagcggttttgctgttttaagccaagcatatcgcaccgtaatacgaaaaagccccaagggaacaatcccttggggcttttatcaagcaatcaggccaaataagcctaggctcactcgttatcgccagcggttgcggcggtagcggagacagcaccctgcttgttggtgttgacaccggagtagacccagtcggtgtaatccgggtgatcgtagccgttgtcgacagcgaactggaaggcttcctgacggaaggcctcgagctcgttgatcttgtcggcgtacttgtcagcgtcgatcatgcgcagagcttcagcctggagctcgtagcgatcgatgttgttcacgcgaaccatgtcgtacggggtggtggtggagccctgctcctcgtagccgtgaacgttgaagttgtcgtggttcgggcgatcgtagatcagaccacgcacgtcgcgggcataggagtggtaagcgaacaggaccggcttgtcctcggtgaacagctcagcgaactcctcatcggagagggcctcgttgttctccttggcggactgcagcttgaccaggtcaaccacgttgacgaccttgaacttgatgcccatggcgtccagcttgtcggcagcggccatgatttcctgagtcggaacatcaccggtggcggcgagcacgatctgagcctcatcgttggacttcacgttggaagcccacttccactcggcagcacccttctcgagctcggcgcgagcttcgtccagggtcagccaggtggcggccggctgcttgccggcgatgatggcgttgatcttgttggtggacttgtagcacttctcagccacagcgagcagcatgttggaatccaccgggaagtagatgccgatcacgtgatcgttgttgaagcacttgttcagcaggacggaggtgacacccggatcctggtgggagaagccgttgtgatcctgacgccacacgtgggaggagacgagcaggttcatggaggagatcggcttgcgccacggaatctcgcggacggtagcctcgagccacttggcgtgctggttcagcatggagtcgatcacgtgcacgaaggactcataggagctccagatgccgtgacggccggtcagcaggtagccctcgaggaagccttccatctggtgctcggaaagctgctcggtgacctggccggtgacagccatgtgctcgtcgacctgagcggacaggtagccggcgtcccactgcttgttggtgacgtcgtaagcggcctgcagacggttggaagcggtctcatccggtccgaagatacggaaggagtccgggttgttcttgatgatgtcgcgggtgtagacgcccagacgacgggtggcctcgagctggccccagccgtggccgtactcggcgacttccttgacctcgtagtcttccagcttcggcagcttcagctcttcgcggatgcggccaccgttggcgttcgggttctcaccgatgcgcagttcgccggtcggcatgaaggcggtgacttccggcttcacggcgccgttctcgtcgaacagctcttccggcttgtaggactcgagccagttcttgaggacctcgaagtgggcctcggtatcgcgggcggaagccagcggcacctggtgggaacgccaggagccctcggtcttcttgccgtcgatgaacttcgggcaggtccagcccttcggggtacggaagatgatcatcgggtagaacggacgagtcatgtcgtcggtctgagcggcggccttgatgtcgcagatctcgtcgaagacggtctcgaacagctcggcgaaacgacggtggatcgacaggtgatcctcgttgtcgaagccagcgacgaactcgtacggctcatagcccatgccgtggaagaactcgtggagctcttcgtcggagatgcgggacaggatggtcgggttggcgatcttgtagccgttgaggtgcaggatcggcagcacgataccgtcggtgcgcgggttgatgagcttgttggactgccagccggtggccagcgggccggtctcagcttcgccgtcgccgacgatggccgggacgaacaggctcgggttgttcatcacagcgccgtaggcgtgggacagggcgtaacccagctcgccgccttcgtggatggagcccggggtctccggagcgtagtgggacgggatgccgcccgggtaggagaactggcggaagaacttctgcagaccagcctcatccttggtgatgttcgggaagtactcggtgtaggtgccgtccaggtaggactgagcggtaccagccgggccgccgtggcccgggcccatgatgatcacagtgttctgctggtgatcagcaatgagacggttgatgtggccgatgaggaagttcaggcccggggtggtgccccagtgaccgaccagacggtgcttgacgtcttcgcgggtgaaaggctccttcatcagcgggttgctacgcagatagatctggccgatggagaggtagttggctgcgcgccagtacttatccacgccttcgatagcttcctcggaaaccggagcgttcagcttcttccaaggggtgccaataacaggactcgtcatgtgtactcctgtactcctgcactgtgatgtgcgattgtttatttccttaggtcatgagccatgcctaaaaccttgcggttacgcggtatgcctcatttccagtcacttgcacatattacgagcgcggttcgactttttgctgtttttttgcgactgtgtgttcaattgttatttttctgtacgcaaatgtgtgcttttatcgggatttttgtgcgtacttcacactctatcaaaaagattgaaaaacggctcaaaatcaacgtttttagtcggttaacatatgtttcccacgttcgtttccctagatacacacgcggcgtgttgagtaggtgggagtaagcaattgtgagattcgttcattctccgttcacgtgtttccaatgtctccttgcaacgtcacaatagagcagttagtattgtccgtttcttgatacctcatattaaagggagagtgttatggctgcaggtcctgtgctcgttgtcgatttcggagcccagtacgcccagctgatcgcacgtcgcgtgcgtgaggccaatgtttattcggagctcgtgccgcattccatgccggtcgatgagatgctggccaaggatccgcaggccatcatcctgtccggtggccccgcttccgtgttcgaaccgggcgctccgcgcgtcgacaagaagctgttcgacgcgggcgttccggtgctcggcatctgctacggcttccaagccatggcatacgcgttgggcgcggatgtcgacaaggccgccctgggcgaatacggcaaaacggaaaccaccattgacaaggcggagggtctgctcgacggctctcccgcagagcaaagcacgtggatgagccatggcgtggccgtcaagaccgcgccggaaggcttcgaagtgctcgcccacaccgaaggcgcaccggtcgccgccatgcaggacgagtcccgcaaactgtacggcgtgcagtggcatccggaagtcaagcacactccgatgggccagaagctcatcgagaacttcctgcacaaatgcgccggccttggtgacaactggaacgcatccaacatcatcgacgaccaggtgacgaagatccgcgagaaggtcggcgacgcacaggtgatctgtggcctgtccggcggtgtcgattccgccgtcgccgccgcgctggtgcacaaggccatcggcgatcagctgacctgcgtattcgtggaccacggcctgctgcgcaagggcgaggccgagcaggtcaagcatgatttcgtcaaggccaccggcatcaagctcatcgccgtggacgcctccgaagacttcctcaccgcgttgaagggcgtgagcgagccggagaagaagcgcaagatcatcggagagaagttcatccgcacttttgagaaggcgcagcgtcaggtcatcgaagaggccggtgcctccggcaaggaagtcaaattcctcgtgcagggcacgctgtatccggacgtcgtagagtccggctgcggcgatggcgcggccaacatcaaatcgcaccacaatgtgggcggcctgccgaaggacatcaaattccagctcatcgagccgctgcgcaccctgttcaaggatgaggtgcgcgccattggcaccgaactcggtctgccggatgagattgtctggcgtcagccattcccgggtccgggtctcggcatccgcatcatcggcgaaatcaccaaggaacgtcttgacttgctgcgcgaagctgatgccatcgcacgtgaggagctttccaaggccggcctcgaccgcgacatctggcagtgcccggtcgtgctgcttgccgacgtgcattccgtgggcgtgcagggtgacgaacgcacctacggctcgccgatcgtgttgcgtccggtgtcgtccgaagacgccatgaccgccgactggtcgcgtatcccgtacgacgtgctcgccaccatctcgacgcgtattaccaacgaatgccgtcagatcaaccgcgtggtgcttgactgcacttccaagccgccggcaaccatcgaatgggagtgagcccgcaggcttgacgcatagcggaaggggctttccacaaactattcttgtggaaagccccttccgctatgttacggaaacaagtccgctctcgtcagacggaccgaacgtcccccgacgtcacttttgcatatccgtcaaacaagcatgtcattccacagatccacgaaattcggtagggttttcgccgtcgtggcgacgttcttcacttggatgcctttgatgcgtaggccaagcatcgccgcgaatgtggccatacgatgatcggcataagtctccatcacggatggtctaagacgattcgccgacacaggggttatctccaatccatcgggcagttcgtgggcagctcccccaacgcgcgtaatctcgttggccaaagcctccagacggttcgtctcatgccctcgtaaatgaccgatgccgatcatgcgggtaggcttgtccgcaaaaaccagaatcgctgcaagcgacggcgcgatctcacctgccgccgtcaagtcgaaatcacctaggccgctgacatgaccgttgccggtcacttcgcagtaccggacgtcgtcaatcaccgggaagctgatctcggctcccatacgttccaaatatcccggaagcatgcctccgggttgcgtagtggattccggccaatgaggtacgcgcacggttcctccggcgatgagcgctgcgccaaggaacggggcggcattcgacaggtcaggttcgaccgtcacagtttcgggcaactgcacggctcccggctgcacggtccacacgcgagcgtgttcgtctgcgttgacacgcacgccggaaccatgcagatcggccacggtcatgcgaatatgcggcaaactcggcgtcttctcccccgtgtgatgcagttccaaaccgcctggcactcgagagccgatgagcaatagtcctgaaatgaactgcgaggatcccgaagaatcaatgctgaccacgctcggctcagcgcactggctcaccgtttgaggtggagtgattgtaaatggcagtcgaccttcctcgccgtggtattcgatacatgcccccaactgttcaagaccgtccaacaccggcttcatcggacgcgcgtacgcctgctcgtcaccgtcgaaagccacaggaccgtccgcgaacatggcaagaccgggcacaaagcgcatcaccgttcccgcaagaccgcagaacaccttcgtaccaccgtggaaccggccgtcggacggcggcaccactgtaaccgtggtgtcaacctgctcgtcgatttcgcagcgcactcccaacgcgcgcaacgcgtccatcatcaactcggtgtcacgtgaacgcaatagaccgaccaatcgcacgggtcgatgtccgagcgccgcgagaatgagataacggttcgacagtgatttgctgcccggtaccaccacagtggcgttcaacggtttgccggcatacggtgccggccacaggttctcatgaagtgcttccatatggttcatggtaaccaaaccatgtggaaaacgccgcgcccgtctcgcataggtcgtcttcctggcatgttccacaaatacattcctttttcataagacaacgcaatgtaatacgatgctgtcatggagcatttcatttcacgttggttggttttgaccattgcggccggggtcatggtcacactgcttcccggcatgcacgccgttggcgaaccacccattctcggcatcggcgcgttcgcgttgttccttgcgttgatcaacgcgtcgatcaaaccgatcgtgcacaccatcgcattgccattttcgattctctcgttcggactaatcgcgttaatcatcaactggctgttcatggagcttgcgtcttggctggccataagcctgttcgacgtgggagtaaccatcgatggattctggtggtccgtaatcggatcgctgattatggccatcgtctccggcattgtcggcaccgtcattcaggactgatgcgatcgcgtatataactaaatgtcctccgcaatctatccgattgcggaggacattactttcgttgtcgggctgacaggatttgaacctgcgacattctgttatatctggtggtttttaggtttggtttgacagaatgtttggagattgagaaacgttggtatttcaacgcttttgccatcctgtaaattgtgactggttatgactgtatggaacgcaacgtgacggtctttgtatgcggtttgtatgcggaataaagaaaaagcccctcccccagcaattgaactgcgccccggaagttggacgtggtttattaatggtacctgattaggctgtgagggacatgttccggaattcctccggggtgtgtccctccagtcgtatctggcgtcgtctggtgttccagtggatgatgtacgcgtccagttcgttcttgaactcctcgtacgaggcgaactcgcggccggtgtagaactcgtccttgaggtggccgaacacctgctcggtggcggcgttgtcgatgcagttgcccttgcggctcatggactggcggatgcccagttccccgagcctgttccgccaccagtcgtgctggtattgccatcccatgtcgctgtggagtatgggatcggcgccttcgggcagcttctcctcgagcatggcgagcagccgttgctgctgggcgaggtcggggtgccggctgacatcccaggccacaatctccttggatcccatgtcgtatatgggcgcgaggtacgccttgccgcccgctgccctgaactcggtgacgtccgtgcccagcttcacccacggccggtcggccgcgaagtcgcgttccagcaggttcggcggcttcgcgcccgtatcgccttggtatgagctgtatctgcggtatgggttcgggcggcgtatggcgcacttcaatcccatgcggcgcataaccctgagcacgctcttatgactcacacgcacgccgaactcgtatacgaggcacatgcgcacctgccggtggccgcacccgttgggcgtgcgatggaagacctcggcgaccatcggctcgatatccggccgggtgaccggctcgggatgcgaaaggagatagtagtaggtgcttctcgccaatcccgcgattttcaacaggcaccggagcggatggccgagccccgccagcgtcgagacgatcaccgacttctcccggttgtcggcttcgacgccagcagggcgcgggctttttccagatacgcgaccctcgccttgagatacgcgttctcctcctcgaggagctgttcgcgcgtgggagccggtttcggtttggatttcgcgcccttcggcctgcccttgggcttcgggcgcagcgcctccggccctccgcgacgatagtcctggcaccactgtttcagacacgtccggctggcgatgccgtaacgttccatgacctccggcctgctcatcccacgttccagatggtcgagcacagcggcgagcttcgtctcgtaatcgtatttcctgttgccctcgcgttctcccatgagcgccgcctctccgccgattcggtatgacaacaaccattctctcgtggtttccttggacacgccaagccggcgggcgagcgacttggcgccgatcccatcgcgaatcaacccgacgacgattctcatatactcgacatcgtatgaacccctgcgtttccgtgacatagaaaaccgcacctccaaatcatcggacatgaattactccagtccaacaatcggggtgcggttcaaatgctgagagaggggcgcgtgttacatgagggtacgaatcactcacggttaagtgttgggcctgaaacaggtgcaacacttatttttcgttggaactgtccggcttggctgccgtgagctggctcacgccgatgagcgcgccgacgaacaaaccgatcgcgttgatggtcgtaacgagttcgccgcagtgtggcagtccccattgcgggccgaccgctccgacgagccatgcgacggccggcaaagcgatcaacgcgagccacttgagtatgtcgtataccctgcccggcagcaggtaatcgaattgcgggctattggattcatccatttttcacctccttaaacattgcggcaaccgtctccacaacgcttaaagtcgtggagacgggagtttcagcgcaggtactgtccgggatagataacgtatgggctgcggatgccattgcgtgcggcagccgactgccagccggagccgtagatgctccacaggctttcgccggaacggaccacatggcctccgaccacgctcgaagcggtggacacggacgcgccgccataggtgacgatctgtcccggataaatcctgttgatgtcaccgctcggcacacgccaggcggacaccggctggagtccggtcctcgcggcgatcgcactcatggtgtcaccggaacggaccacgacgctacgcgaacccgtggcggccgttccgccggaacctccgccgaggcgactgttgacgatctgcatgaccgccgcgtaattgccacccaacgcctgcctgcgggccggatcattgccgaaatcgccgcggatggtgcgcgtggccaaagcgttcaggtcgaccgccggagcggtcgtgggctgaggtttcggcttgacactcggcagatccgccgcgcccttgtcgtcagggttcgcgtacttgcgccatgccgtgcggtcgccgcggaacttgttcaggtcgaggcgtcctgaccagccgctgagactgccgttggacgtgtactggcgcatgacctcgccgcgggcgccgatattccacggcgcagtctggtagccggtgaccatgttcgtggcgtactgggcgatccagatgccgcagtttagttcggtctccatgccggcgacctgccagtagccggagtccatcgtgtagatgatggggttcacgccggtcagtcgcttgacctcgcgcgcccacctgcgtggccactgcttgtcgccccaggcggcgttgtcctgcgcctcccagtcgaggatcaggacgcttttgcgaatatatcctcgcacgttgtcgacgaagaacctggcctcggtctcggggttgccgccgcacgcgtaatggtagacgccggtctccttgccgctgttgacggcgccggcgagctgacggttcgcgtcggtgttgacgccgttggacaggcaaccaccgtatacgccgccggacccccatgtggtgccgacgatgacgaaatctgccggcacggtcgcggtgtcgatgccgcactgccagttcgagatgtcgtatccgttcatgtcggccatcgcggctggcgcgacagccatggagatggagaccgtgagcgcggtcagtagcttgcgccattgtcggcgtggattcatgtgcttgtgtctcggtttgcctttgttgaggatgttcaattcctctcctttcctttgtccgtaccgtccgccttgtacggacggtgtggaaatcttttgaatctttcaatctgtgttcgcgatatgcgcgtcacgtatgtcttggatcatcgaggttccggttccattgccgcccagaccgtggtaagcggcatatattcgttccgcgctttgcttcaacggaatgctcgcaacaccacctgcatcgaccatctgacggtgcagagcctcgagtttgcagaacaacagttccctgacgccctcatgcagtggatcgtgacgttggtcgaccttgctcagaatccaggtgacgaacacgccgctgcctccgctgccgatgatggcgacaacgattgcgacgatggtttcctggctcattgggaatccttccgaaaggaaaatcccacacgtggctaccgttggaagctgcgataaccacgtgtgggattttggaggttgaaatgttgttgggaacgtttgtggatgaggtctggtggccctcctgcgggaagcttcgcgagtgcacgagggtgggctacgagtcggcctaccgctgccacatccagccgaaatgggctgacgtcgacatggagtcgatcaccgcgaacgacatcgaggagtggctcggctcgttcaatcaggccggcgccgcgcgcaaggcgtgggccgtgctgcgggcgatactccgactcgcctatcgcaagggagtcaccgacaatgacgtgacacgtcgtgaaatcagactgccacacctgcggcggtatgagccgcgcgtgctcgacgccagacaggtaagacggctgctcaaaggcttctacggtcacgcgttggaagcctggttattggtctccgtctgcgcgggactgcgccgatgcgagtccgtcggcattgaatgggccgacttggatttacgccggggaatcgtgaccgtcaaaaggtcagtgcaatgggtcgctggacatgaaacggtcaccgacccgaagaccgaccagagccgacggacggtcgcactaccacggttcgcagtcaaacggctcgcgcaattgcgccacggcagaaccggcaggctggtcggcgatctgaacgccaaccaggtggcagctcattacacgtcatggtgccaacgcatgaaactcccctgcgtgccgccaaggaacctcaggcacaccttcggcactctggcaatcgctgcgggagccgatatctcagtggtcgcacgacaactcggtcacagcgacatcaagacaaccgcccgctactatctccgccccgatttgtccgtgctgagaagtctgcagcgggcatgggaaagactcatcatcggagccgcgtagctttccgtaacccagccatggaaacctccatacacgaacagcagactcactctatgtatcgacaccgcgttgaccgcgtacgagcagcaggtcgaaccactcctcaaaaagtgacgcgatatacattgcgcaatatatgattcccgttcacgctgcgacggcgcacgaccattggccgccaccgccgcagcgtttccgggacaacaaaaatccctatggcattaccccaggccatagggattttcattatatgctgattctgcctacgaatcagccgagtgggtcgaggcctacgagatgggttgtcattgccatcgcaagtctgccgtcagcaacgcacgctatgcgcgccacacatccttgccggcggccttcgcggccgccacatcggcgtcaagctgctcttcggtaccttcgacatcgcccttgatgaattcctccaccaagcggcgagcctcgccatcctcgtgctgcacagccggggacttcatgaagtaggagctcggagccagcaccggaccggccagatggcggtcgagcgcaatcttggccgcgcgcacggcgtcgatcacaataccggcggaattcggggaatcccacacctcgagcttgtattcaaggttcagcggcacatcgccgaacgtggtgccctcaagacgcacgaaggcgaacttgcggtcgtcaagccaagccacgtaatcggaaggtccgatatgcacgttgtgcggatccatctcgtgcggcaccacggaagtgacggcgcgggtcttggagatcttcttggattccaggcgggaacgctgcagcatgttcatgaagtccatgttgccgcccacattgagctggtaggtgcggtccaagcgcacgccacggtcttcgaacagacgggcgagcacacggtgggtgatcgtggcgccgacctgggacttgatgtcgtcgccgacgatcggcacacccgcgtcacggaacttctgcgcccattcgggatcggaggcgatgaacaccggcaagcagttcacaaacgcgcatcccgcatccatggcggcctgagcgtaagccttgtccgccttttcggaaccgaccggcagataggagaccagcacatccaccttcttgtcacgcagcacctgggccacgtccaccggttcggcgtccgactcttcgatcatctggcggtagtattcgcccaagccgtcgttagtcgggccacgcagcacctccacgcccagattcggcacgtccgcgaacttgatggtgttgttctgggaggctccgatcgcctcggacaggtccttgcccaccttcagcgcatccacgtcgaacgcggtgacgaattcgatgtcacgcacgcggtagccaccgaaattgttatgcatcagaccgggaatcttatcctcgtccttggtgtccttgtaatactcaacgccctgcaccagcgacgaggcgcaattgcccacgccggcgatagccactcgaatgctcatctgaaaacgactcctctgttatgcatttcgcaggtataccaatccccaagcatacccacaaccgcattgtaaactgaaaaatcactgaaaaacggccatattacggcagtcgtcaacagattgtcgatttgtaaaaaagctgcgcaaaaacatgtttttccagtcggacagcaccatctacacccttgtttttcaggtcgttcggctacggtggaaaccatggtttcacgaacacgaagtgtcagctcacgctcaaaaagcgcccgcagcggcagcgcaacgtccacgacgccacgggtgggcaccacctacggggtccatggagaagtgctgagcaagccgccccaggggccgaagcacacttcgcatcgcgcacccaaaaagaccagaaaacacaagcatctcgtgctcaaatgggtgctcggcatcttcgcggcgctcatcgcggcaggtatcggcctgttcgcctacatgtacatcaccacggaaatcccgcagccggaaaagttcgcgctggctgaaaagacgaccgtgtattacaacgacggcaccacgccgatcggcagctatgcggagcagaatcgcgaaatcatcagctgcgcagacctgcccgactacgtcggcaacgcgattgtggcttcggaagaccgctccttctataccaataagggcatcgatccgatcggcatcgcacgcgcgttctacaacaacctgaccaccggtagcaggcagggcggttccaccatcacccagcagtatgcggaacgctattatctgggcgaaaccacctcgtacgtgggcaaactgcgtgaggcgttcctggcggtcaaaatcgcccaagcacaggacaagagccaggtgttgtgcaactacatgaacaccatctatctcggccgtggcgcatacggcatccaggcagcggccaaagcgtacttcggcaaggacgcgaaggatctgacgctctccgaagcggccatgcttgccggcatcattcccgcgccgagcgtatggacccccgacgtgaatcccaagcaagctgaaaaacgttacaagcgcgtgctgaacatcatggacgaagacggctacatcacgccggacgagaagaaagccgcgaaattcccgcaaaccatcgaaatccaacagaacaaccagatgtccggaccgaacggatacctgctgacgatggtgcagaacgaactcgtcaacaccaaggcgttcagcaagcaggacctggaaaccggcggctacaaaatcgtcaccaccattgacaaatcgaagcaggacctgatgttctccaccatcagtccctcccaaaacggcatgcaaggcatcgtgcccgacggcatgcagttcggcgcgctgtcggtgaaccccaaggacggttccatcatctcgctgtacgcaggagatgactacctgaccaagcagctcaacaacgtcacccaggcaacgtacgaagtcggctccaccatgaagccgttcgcattgctggccgccgtcaacgaaggcgtcagcctcaacacgtacttcaacggcaactcgtaccggacgttcccgggcatcaccgaaacggtgagcaactacggcggcgagaatctgggatacgtgaacctgtacacggcgacggaacaatcctcgaacaccgtgtacatggatctgcaaaccaagctcggcgcgcagaaaatcgccgaaaccgcacggcaggccggcgttgacgattcgtctttggatggttccaacccgttcaccgtgctcggcaacaacggcctgaccctcaaggacatgacgcagggatacgccacactggccaaccaaggcaacaagccgacgctgcatatcgttgcccaagtgcagacggcgaacggcaccgacctgtacaacgcgccgacctcggcggagcagacgttcgaagcgaacaacgcgaatctcgtgacgaaggcgcttaccggcgtggtccagcgaggcaccgccaccgaggcgcgtgccactgggcacaccattgccggcaagtcaggcaccgcaaacgattccaacgcagcgagcttcatcggctacacgccgtccatgctgacttctgtggcgatgtggtatccggacgacaacggcaacccgcaggagattcccgcattcggcagctggaccggcggcagcgattaccccgtgcatctcttcaccgaatacatgaagcaggcactggccgatacgccgaacgaaacgttccccgacgccaccgataacggcaaggtcggcggaccggacggtacgtggggcaccggcgcgcagaagacctggactagaaagcagcagaccaccgtgactccgcgcaccgaggagaacacccaacagaccacgccgaatcagaccgaggaaacgcagaataccggtcagggcggtggcgacggcggtaatagtggcggtatccccgctaacggcgacggtaaccacaccaacggtggcaatggcggaggaaccagtagcgataattccggtaataacggcgccaatggcgatacatcgcagcaatagcagtcgctgactgcgattgccgtcgcggtcagcgaacacgcaaagggggcttcccggttattccgggaagcccccttggttttgccgcgtgcacacgcgggcgcacggtcgtcaacgtcgttcgtcagaatgcatgcacatgctgggcgagacggtcgtattcggcgcgtgtcagcgaggcgacgccaccatgtttcgtatgcgcggtgaggaagtaatcgtccgcctgcaacggaacccagccctgatcgagatcgcggctgaccatcggacggtatccgatcgacggaatcacgtccacgaacaagtaccattcgtcgtccggtccaccgttgttgtggtggttggcgaacaccgcaggaccttccacgccgccggggttgccgtccggcacgtagcctgcgccaatccggtcctgcaccttggtccagaccgtccccggctcccaccagcgcttcgcgtcggtgcggtccatccagatgccggtgccatgcgcgttgtccttggtgatgcggtacgtgcgtacactgccgtccggcaacggacgttggatcatcgtggtgtcgatggcgtcgccgtggttgtcaatgaatacgccgccatattcgaatgtgtcctgcgtgaaatcggtggtggcgccccacagcacggtgcagtagacgttcttgtcgtcgtgagccttgtccgcatcattgaacacggtgctggaccaatacatgacgaatgcgccgcgcccaccgtgatggccttgcggataatagtccggcacccagaggcattcgcatgcccaggccataccaagctccagatgggagccgtccggcttgcgggacacgtcgagcatgcgcggctcgctccaatggagcagatcgtcggattcccagatgatgagattcgtgctggcgtggtggctccactcgtaccagccgccgccgtcgcctccgaacacacgcagatcggtggcgatgatataccacgtgccggtgtcgggattgcggatgatatgcggatcgcgcacgcctgtggtaccgagatgcgaagccagcacaggctttccatcgttgagcggcacccaacggtgcggattgtcaccgtcggatatatccatgtaaatcttctcggcgtagccgtccggatcctcgatgaagtggacgagcaggtaaccgtagtcgtcggttgtgtcggtcatggtcccaccttgtggttgtgaatgaatgaattggataagtgaattgcgtgttcgataacgtaccgcgtcaatatgcgcggatacgaagaaagccgccgccacgagagcgacagctttcttcgggaaggaggattagccctgatgcgtgcgggcacatgtgcggatcacatcctgctgcgccgcgatggccttgttgcgggccagatagatgaccaaggtgatggaatacagtgcaagaccgatgaggtccatcgtgcccagggagaagaccaccacgattgccagccagatgatcacccaccggctggtggtgccgggagcgagacaccgcatggacatgatgaagctgacgatgccgataatcagcaccagcagcgcgtagatgcccaccaccgtcgaggcgttgtccaccgcggaatagtccgttttcagcaaaccgttatgttccagcagatcgtaggcttggcctttgaaccagctggtgaacatgaacagtgtgatggacgccatgatcacgttgtaggcggcggcgatggtcatcagcactcgttccgccttgcgagccaatggtgccggcggctgcatggtgttgccttgcggattcatatcggtcctttccgtggtgtggcctcatccgatgtgcgatgcgcagctcgggaaagataaaatcacaggcccgtccgtttggggacggacctgtgcattatctcactcggccggtatcagcccttgaggccggaggtgatgttcagggactgcaggaagtacttctgcgcgaacaggaacagcagcagggtcgggatgatggccatgcaggtggccgccatcagggagcccatctggttgtactggcccatctggttgctcagcagctgcagaccagcggtgaccggcatcttgttgatgtcgttgaacaccaaggtcggccacaggaagtcgttccaagcgccggtgaagctgaacaggaagatgacgatcagaatcgggcggatggccggcagcatgatgcgggtgaagatctggaaatcagtggcgccgtcgatttcggccgcctcgtccagttccttcgggatgcccttcatgaagttgcgcaccaggaagatgttcgccacgttgcccaggccagggatgatgcaggcccagtaggtgttgacccagccgagggaggcgatgatgcggtactgcgggatcatgttgaccacggcagggaacatcgagatgagcagcaggacgaagaacagcgtatcgcggtacttgaagttcagacgggaatagccgaagcctgcgagcgcgacgatgcacacggacagcactgcgaacacggtcgagataatcagcgagttgcccagccagttcaggaccgggtagctggcggatgcctcgatcagcgtcatgtagttgtcaagcacccacttcgcgggcaggaagttgaacgcgttggaggtgaattcggccaccgacttgaacgaagtcgtcacggtgtagatcaccggaagcagccagacgactgccagcacgacgagcaccacatagacggcgatcagcgacggggagacctttttggttttgttttcaggaattgccgcgcttgcgacattgactgtggttgcagcggacatcttcagtcctccttattcatgaagatcagctggatcgcggcgatggccatcaggatgatgcccagcagcaatgccattgcggaagccatgccggcggccgcagggccggcggggaacgcgaggttcctgatatccatcagcagcacctgggtctggtagttcggtccgccgttggtcagcatgaccggctggccccacacgttgaaggcgcccgtggtggtcatgatggtggtgtagaacaacggcagcttgatttccggcagggtgatggagaagaagatcctgaccggaccggctccgtcgaccttcgcggcttcgtagaggctctcgtccacgccggagagcgcggaacggtagatgacgaggttgccgccgataccggcccacagcacgagtacgaagatggtgatccatgcgtacgggttcttgccgagccagttgatgtcggtgtggaaggtggtgttcagcagaccgaactgggagttgaagaccatacgccagaccagtgcaccggcggcgatggagatcaaacctgggatgtagaagatcgcctggaacagaccagcgcccttgagtcccttcttgctgagcgccacggcaagcagcagcggcacgatgatggtcagcggcacgctgaccagcacgaagagcagagtgtggccgagatcacgccagaagatcgagtagaaataggtgctggggtcgaagatcttcgcgaagttctgcaggccgacgaacttcggcgcaccgaccatgttccagcgggtgaacgccagtccaatgccgaagataatcgggatgatgccgaagacggcgaagatgatgaagtgcggagcgatgtacggcagcgcgtgccagatggagttcttgcgcttcatggatgattttgcggatccgatcgtagatgtcttgctcatcacgattcctcctgaatctcgatttggccctgggccatgaggtcgagggtcttcagaccttcttcaagaccaacattgccgtagacgatgtcgttgtatgtgccccaaccagcggtcgcatagcctccgtagaggtagttggaggtcttgatgtagtcgcgttccttcttgctgttggtgaaggacgcctggatcagcttctggtactccgggttgttcagatcgcggtatgccggcgagatggaaccgacctcagaccaatccatccagtgctcgtacacgtacttgacgaagtcggcggcggctgcggatttcgccgcggagcggtgcggatccttcaactgcatccagttgcactggtagaagaagttcaccggattgtcggcgccgtactgcagggtgttggcttccgcgatcttgtcggcgcccaaggtgttggacatattgccctgcgcccacgtgccaagctgcgcgaacacggccttgccggaaccgaacgcctgctcgccgtcgacgtccatcggggcgatcacaccggcgtcgtacgcttccttgagcttctccatgggcttgcgccacacgtccttggtcaggtcgtccatatcgttctcaagcgtgccgcccgcgccgtacagcagggacatgaaggcccacggcagattgccgtaagtcagcgcgtaggtgcccttgggcagcttgcccttgaggtccttgatctcgtcgatggtgacgaacccgtcgtcgaggatgtactgcaggttgtacttcttgaccaggtccttgttgtagtagatggccatctggtacagatacagcggaatgccgtaggccttgccattgacggtgacgcccttccaagtggcgggcaggaagctgctctccttgaggtccggggcgaccttctgccaatcgtccatggtgtcgagcagaccttgggactgcagaacggcggtctggaactggtcgccgatgatgatgtcggggatgttcttgccggtctgcatcacggaatagatcttcgtggtcagatcgccgccgttcatcggctggaaaacgaccttgtaatcgctctgggcgttgtattccttgacgatgcgctgcattgcaggaccgtcatcgcccaccagattgttccagaagtaaatggtcttgctttcacccgaagaggcaccacagcctccggcggcaagcacaagtccaagtgacgcacacacggctacggcagccttggcaaagcgccgcaacccggtaagatgcctggatgtagacattgtttccttccttttcctcaacggaccatcgctggaccgctcctcgttgcaatccgaatgggaagaatccttttcgattgagcctccctgctcatttgcaacgttgtaattttgattatacagctattttcatcgttgtacaaacggtaacacgccgacgacaacagccagctttatggatggggttatagacggggtgacccctccggccacgcccctcagtggcctacggccggagttcccgcaagcgggccaccatcagcgggcaacacgtccgtagtggtcggggtccacagattatcaggttccggcacgccgaaatccggaccgtcggcggtccacttgaccacaccgacgcgcgcgtggcgattcgggtcgaacagcggatcgcccttaatttccgtgtagttgcggcagtggtaaatcatcaggtcctcggtgccgtcctcggacttggtgaatgaattgtggcccggaccatactgaccgttctcggcgcaggtcttaaacaccggcaccgggctcttagtccaggaggccttgtccagcagatcgctgccgcgctcggcggtcaacagccccacggcgtacggaactccggtgccggaggcggaatacgtgatgtagatcttgttctcatggaacaggaaggccggtccttcgttgaccaggaaatcgatgcattcccagtcgtattccggcttggtcagcatgacgggctcgctgcccagcgtccacggattggccatcttggcgatatacagattggagttgccttcgatggcgggatccttctgcgcccataccaagtactgcacgccatcgatcacctcggtggtggcgtcaagtgcgaaggagtcgatcggggtgatgatctggcccttctccacccagttgtcggaagttggatcgtcgtcggtgttctccagcacgaacatgcggtgcgtcggcaggccggatgcttcgaaatccgttgcggcgcctgcgaagtagatataccatgcgccattgatgcggtgtagttcgggggcccagatgtagatgcttgccgggccggattcgtgcttgcgccacaccaccgtctccggagccttctgcagatcgttgatgctcgacgcgtgccggatggcgatgcagttgtattccggatcggaggcggtgaaataatactcgccgtcaaccttgagcacccaggggtctgcgcgctgaagcacgatcggattgttgtaaacaaccatgtttagtccttctcaatccgttgttccagtatttacaacgttgaatatatcattcttacatcgttgtaacaacttgggcgcgtcattgccggaagatgcttggatgcggtgccgccgccgggcatgggcgtccatcgtttgcgccattcatgccaatgtcggtgccgccgtcggtcatgggtgctcgacacactcaaggccgttcggccaagcttacggccgagcgcccatgcccggcggcggcaccttgggggaagagccgactcaatgggtacgcacgctgggagaaacttgccggaaggcaagcgaaagctcagaggacgagggaatcgatggggagtttggtggattggcgcacgaccagcgacgatgcgaccttgcggaagaccttctcccccggtttgtcggcattcgggtcacggccgtcgatacgctccttgagcaccttaagcgacagacgggctaccgcctcaagtcccggcgcgatcgacgtcagcgccggcgacaggtactgtgaatcgtcggaattgtcgaaaccaaccacggagatgtcgtcgggaatgtgcaagccgtgcatctgaatcgcgtgcatcacgccggaagccagcatgtcgttcagcgcgacgacgccatcgacttcgacgccggaatccaacaacgcgttcatggccctcacgccgtcactacgatgccacatgcccgattcgacgaccagccgatcgtcgaattcgacgccggcctcctccagtgcctcaagatacccttggtagcgcagcgcggcggaaccgactttctcccccgggtgcacaccgaccacggccacgcggcggcaaccggtcgtcagcagatactgcgtggcccgcttcgcgccttccacgttctcggtggcgatgtgatccacctggtcggtgaagatgcgttcgccaaccagcacaagcggataatcgaccttcagctgctcgacgtcatcctgcccaagctccaatgggctgtagatcaggccgtcgatcatcgtctgctgggacccgtgcagcgcttccaactcgccatcgcgcgaatattgcgtcggctccacgatcacgcgcagaccgactttcttcgcttcttcgatgaccagcgatgacagctgcgcgaaatacggcatctgcagatcgggaatggccaagccgatgatgccggtctgccctcggcgcaggttgcgtgccgacacgttcaccgtgtatcccagttccgcgatggctttgttgaccttgtcgcgcgtgacctgcgagacgaattcgtagtcgttgaccacgttggagacggttttgatcgacacaccggccgccttggccacctcacgcatggtcacgacatgctcgccgtttccccccgttcgcttcggcatatataccccttttgtcattcagcggactcagtcggcatcgaagaaaccaacctccatcgttacaccagcatagtcggggtcgagttcctccgccgtttgcatatccaggatgggcatgccctccttggaccagtgcacgcggcgcacctgggcgtcgcggccaccatagcggccgtgctcgtattcggcgttgtggaacacgtagatgaggttgccgtcctcgtcatgcgaccacatgccgtggccggtgccgagctgccaacgcccgttgtacatgccggacttctgcagcggataatcgagcttcgtccatacgctggcgtcggtgagatcggccccctgtccagccggggcggtgaccaggccggtcgtgtagtcgatgccgaccagcgagcccgagtagatcaggaaaatcgttccgtcatgcacgatggcgttcggtccttcggcgatcatgttgtcccatgcgaattccggcacgacgatctgcttcggcttgctggtgagcctcgccggacgagccgggtcaaagctggcgatccagatgctgccgacctgctgccatgcgtagtaccagcggcccgaatcgcacaacacggtcatgtcaagcgaaatgcgctggatcggattgagcgtctcgccatccgggtcgaggataggctcgggcaccgtccagttctccggctcgcgcggatcaaaatccgtgccgtcggaatgctgcttgagctgcatgatgtggcagctgccggtccacatgtccggtttgccggcacgatcgttgggggtgccgtcgggattgacgcgcggcccatcgaagcagggcatgaacaggaccgacagcttgccgccgatcacatgcagttccggcgcccagaagcagccggtcatcggacgatcttcgctattgagatcgccgcatgcgagcagatcgatctccctggcccgtccacccgcggcgtcggaaagcgcttcgatagagtcggcgatgcgcagcggcatatgggttctaccgtcgttcggatccacgcaattgccgtcggtgtcatcggtggcgatgaacatgaacatcggcttgccattgaaatcccacgcgaacaccgatggatcggcgcgctccaccgcgaacggcaccggatagacgctctggcggatcacaccttcgacggtacgggtctggccggccttgaacgttccctcggaggcctcctggccgatggcctcaagctgggccatgttccaatccaccgcgcgcgtggcctgcgaaccgtcgctgtatgacagttccgcacgggttgcggccaaggccagaaccgcattccgggcatcctcaccatgcaggcccgcatcgattcgctgggcgggcacggacgttccggcattgcggatgcggccgaagcgctcgatcaggcgctcggcctccggctcactgatggcgatgctgttgccgacgacggcgttcggaatgccgcaatccccggtctgacgcaacggctgcgacgacgccgattccacgacatcaagcggcctgcccgaaccggcggcggctacgatatcggccgtccgcgcggtgcgtgccttgccatcgtcaccggtccaggagacgacgtagcacgcgtccgcggcgtcgaaagagacggacgggcgattgaccccaccggtggtgcgcaacagcaccagcccccgctggtcgaacgccgtcagatcatcgctgatggcgagcaggaatgccgaccgttcggaaccatccggctcaccgccgcgggcggtacgggtcgcggcgatggcgaatcgtccgtccgcgagacggaacaggaacggattcttcagcgatttcagcgtgatatccataccgggcatgaccacgccatgggcgacggcgtcggtggcggggcgaggcgcgtcgaaccggtcggcggcgaagcgcgccgcggccgtgcacgcacggcgggattccgcggtcgcggcggcgatcggcacaccggccgcgaagaagatgccatagttttcgttcagcggccgccactcggcgtcatcgccggaacgtagcgccaaatgcatgctgtaggcgatgtcctcgttgttcgcctcttcgcgtccggtggcttcgcgtgtatagcacagcagggaataattggccgacatggaagatccttcagtaagcagatacaggttttacaacgatgtactataccgtgttttacatcgttgtacaacttggtgtggcggcattgcgacacccttcatccgcggagaggaagcatcatggaacgcgcttgtcgcacttgtgagcgggcgcatcgcatggcacatgacaacgacgaggggcttcccggttacccaggaagcccctcgaatcatatccggcgcgtttgctcaacgcgtccgtgcaatcagtgcaatcagcgctcggaacggttgatggccgagatgatggccttcagcgagctggtgacgatggaggtatcgatgccgacgccccacacgatgctcgtgttgtcttcctcgccgatctggcattccacataggaagcggccatggcatcggtgccgacggacatggtgtgctccacgtaatccatcaccgaagcctcgatgccaaagttgctcacggcgttgaggaaggcggcgatcggaccgttgccgatgccggagacctcacgctccaccggctcgtcgacaccaacgtttacgccgcggtcgagaatcctggccttgagcacggtgtcggaaccatcctcgccggaggagacggacaccttcagcagtttcagacggccccactgctcgagggtctcgtccttgctgtcgccgaccacgacaccagccgcggtggcgccggattcctcgaccggcaggtactcgtccttgaacagacgccagatgtcctcgtccttgacttccttcttggtctcgtcggcgtagttctgcacgaccttctcgaactcgacctgcagacgcttcggcagatcaaggttgtggttggtcttgagcaggtaggccatgccgcccttgccggactgggagttcacgcggatgatggcctcgtaggaacggccgatgtccttcgggtcgatcggcaggtacggcacgagccacacgaagctgtccagatcggcaccggcacggtcggcggccacctgacgggcctcaagacccttcttgatggcgtcctggtgggagccggagaacgcggtgaacacgaagttgcccgcatacggatggcgttcggagatcttgatctggttgcagtattcgacggtcttgcggatttccggaacgttggagtagtcgatctgcggatcgatgccctgggtcaggaagttcagaccaagggtgaccaggtcgacgttgccggtacgctcgccgttgcccagcaggcagccttccacgcggtcggcgccggccagcacggccagctcggtggcggccacgcccatgccctcgtcgttgtgcgggtgcagggacagcaccacggcgtcacgcggtacgaggtggttggacacatactcgacctcgtcggcgaagacgttcggcgtggtcatttccacggttgccggcaggttgatgatcatcggatgttccggcgtcggcttgatgacgtcgatcaccgcgttgcacacctcgactgcgtactccggctcggtgccggtgaaggattccggagaatactcgtagtacaggtcgatgcccttggcttcgccctcgagctccttgcacagggtggccgcgtcggtagcgagcttcttgatgccggccttgtccttgcggaacacgacctcgcgctgcagcacggacacggaattgtagaagtgcacgacggcgcgcttggcgcccttcaggcactcgtaagtcttgcgaatcaggtgctcacgggcctgggtgagcacgacgatggtgacgtcatccggaatgagctcgcgctcgatcagcatgcggatgaagtcgtaatcggtttcggaagccgacgggaagccgacctcgatctccttgaagcccatcgacacgagcaggttccagaaacgcagcttgcgctcggaatccatcgggttgacgagagcctggttgccgtcgcgcagatcgacggagcaccaacgcggcgcacgctgcagtcgcttgcccggccacgtacgctccgggaaatcaaacggcacctgcttatcgtatgcgacgtacttgttgtacggcatcttgctgggcttttgcggagctccaatgtaacgcgccggaggcagcagcgggtcgttgttccctccgttggacgccgcggcgactgccgcgagatcaaacactgacgattgatcctgacccatcactcctccttatctgtaaagtcggatcggccttctgccaatccacattgttacgtgcatgttacctacctgcactgccgcccatactagcgacaaccaatcccatattttgccggtattccgcgatatgacggcatggtttgcgattttcgcgcccttatttcaccccatatccagatttgccgcagtacagtgggcatcatgagcttgcgattcaacagcgacggtacgttccgggtgctgcaaatggctgatattcaggatggtccggacgtgcgcgaagacacgattcggctgatcgaagccgctatcaggaaggcacatcccgacctcatcgtgctcaccggcgatcagatccgcggctacgatccggcatatatcgatacgtttctacgccgccgtggcgaacagcccggtacgcacgtgcgcgcggtcaccgaaatcgaagcgaaaatccgcggcatcaaacgtcatccgatcgccaaaacactgaccaaatcgcagccctccgacgaacggtggatgatcgacggcatcggcaccgattcgccgaaactggtgaaaagcgcaggtcgcaacggttctgccagcaagctggaatcgtgggcggaagccatcaatcgcgtcaccgcggcgtcgctgctcgacgagacacggcagaaagtgcgcgacacgttcgccgcgtttttggggccggcgttggaatcgcgcatccccttcgccgcgacgtacggcaaccatgatttccaatgcggcatcctcgccgacgaacaggacgatctttaccgcgagtttgccggctgtatgaatcccgtcgccggctcgtcgccgttggcgctcgaaccgggcacgttcgcgttgccgatcgaagcgtccgacggttcggggcgtatcacaatgagcgtgatgatggtcaattcgggcgattacgccgacacggcagacgcggacgacggcaacggacggcagtcggtcaccgaatacgcgaaatacgcggcgaattcgcgcggctgggatttggccgactccgacggctacggcaccccctcgccggaagccgtcgaatggctgaagcgcgtacaacgcgagttgggcaggcgcaatggcgacgggcaggcggtgccggcgattgccttccagcacattccgccgcaggaattctacgattgcctgcgcgaagtgcccgcctacacgccgaacgccgtggagggcgcgcgcgaattcgcaggacattgctatgtgctcgaccgcgatgtgtgccgacccggttcgcggctgggcgaggcgattggctgcgccgacgtgaacgtgggcgaagtggacgcgttgcgtgaggcgggcggctatttcgcactgttctgcgggcacgaccacaagaattcgttcgtcgggcatgtgcacgacatcgatttggggtacgcgccgacctgtggttttgaatgctacggcccgaaatcgcggttccgtggcatccggctgtttgaattccgcgaagacaatccgatggcgtacgtgacgcgcatgctgacgtggggcgatctggtcggccgttattccagcaacgaattacgcgtgttcttcgaggaccattgcgtgacggacctgatcggcgtgcgcaacgagctgcgcaggccgcaggtcagcgccacactgctgggtgcgggcgcggtggcctgcggcgcgatcggatacgcggtacgggggctgttgcgcaaatcgcagtaatgcgatgctcgtggcaatcgcaatgatcgacagcgactcgacggcagcaccgccgacaacgcgaccttatcgaatatcactcaagatatttcgattggaagaaggcgtcttgctgtgattcgctaccgagattcgtgtcctcggcattcacgataatcggcgtttccagctttgcgggcatgctgtcataccacgcatggctccagccgacgatcgcttcgctgagctgcgaactgtcgtatcccgccggatataccgtgaatgcaccgcagggggcaatgccgtaggggtcggcaaccgtatatttactaccgtttttgatatacgtgtctcctatattgccatcgattttcagcgccgatttgtcgcattgcatcgtatagctgccgtccgcgttcttcttggcatccttgaaacggcctttgaaattcgaaatggtgaccgatccgttcggatagtcatctcccgtaatgcccatgtcggaatcatgatatgttccgctgaacgtgccatcggacgccaccgtcatagtggtgccccaaccgccggaaccggaagcgaaaccgtactttccggcgatggacttcatcaaagaccgagtggcggcatccgattgggaatcagatttcttggtgtctgcgttcttgcttgcatttttgccgttagatttctgactcttggcggacacgcccttgatgttggcgtcttcgagggaatcccagtcgggctggacgtcctccaccagatagtaggcggtttcgccgctgggggcgggcttcattttgacggtgtcatccttggagccgttgtagccgttgtaaggcatgaatggattgaaccagtcccttgtataggttgattccttctcgccgttcttgtactggttcacgtcacgatacatcaagaacggacggtccgtatcgacaggtttttgcttttgggcagccgcgagcgcagacgcgtcaaaatagccagttttctctactgattccacatcagagccgactgggaacaccgcgaacaaatccatcatatggaatttaccgctgccgtccggctcataatcggacgcatccgaagagtcggaatcaatgtcatggacctttccggcaacacaattccgcatatcgccttccccacccaaggcggaatcgccacaccaatacgtttcgaacgctttgtgtgggaacaattcaaatgctccagagtttccagtcaacagatagtcggctttcttgctgctgcaatacggctgttgcaccgcatcgcaggaaatcaaagactcaccggtcatgctgtacttcgtgttcgcagcaccatctttcactttcaggaaaacgatgtctccgctggaataactgtcatcctgtcctagcgtgatgcagtcgccggccttattgcaccactggccagaagcaacgtcactcgtgcccatcagcaacccatctccaccggttccgctgtggtcaatgaacgtctgcttggcacccttggcatccacgccctgatacagggtgatggtctggccttcgttcagctggctgcccggcccaggttcggagccggagaccttgccgatgtactgtttcgatgagagacgtttctccactttcacgtcgtagcctttggattcaaggcttgatttcacgtcggaaatttcctggccgacgatgtccgacggcaggccgtcgtcgcttttcgtggccacgccgatgtagatgcctttcttaccatccttcacgccttggccttgcgcggggtacgtgctgatcacgcttccctcggtggttttgctggtgtccgacacgatcacctgcttgtaatgcaccggcacgcccatctgcgagaacgttgtcaccacgctttcagctttcttgccgaccgtaccttccggcacgccagggccggccgattcgcgcaccgtcaccacactgcccgcccttacgcggccaccggactgaattccctgatagccaaggaacttgccgcttttcacgccggagaattccttgacgcgcttgactttgaggcccttgccttcaagctgcctgaccacgaccttcgcatccggagtcttcgacgagtccttgggagacgccaccgccacgtccggcaacgacttgccaccccacaactccatgttgtatgtcacgatgccggccaccacagcggcgaccagcagcaccgcggccaccgctatgccgatgatgagcttgcgattcggggacgcggcacgcgcagtcccgtcgctttccggctcaagagtttccggcgccgacggaacggattgcgatgcagccgaagtcgcgggctgcgctacgggcagcgtgccgccgcccggcaacgggaccggcggaatcgcgtctgccggctgcgaagcgagctgttctgcagggcgttcctcgtgctgtgccgcagactgttcctcgggttgctccgcagactgcggtgcgagctgcgatgcaggggtttccaccgctgtggaatcgacggaaaaatcatccgaaatccgtgcttgtccggcatcaggctgcaccggaacggagaccaacggattgccgcagttcgtgcagaacttcgactccggagcgttcttcgaaccgcattgcgtacagaacatggcttctcccctgcttcagtttcttctctgaaatcgattatagggagccggcgcggtaggccgaaagactaccggaacaggctcacgcctcgacgggccatgcagtaggcgttacccagccacgtatgacgggaattcggccacaccgcgcccaatcgcggagcattctggctcatccagatactcggtacgcggccgtcagcggaacgcgagcccagcaggttgaaaccgttcttttccagcagccattccggatgctgtgtggcgatcgcaagcccctcttccaaagtcaacggcaatcgctcgtcggaatcgatcagcttgcgtgccacgtccggctcgcggttgatatagcaggtgccggtgtgcggttcgatcaccagatagaacgggccttccggcggttcgaaaccgtcctgcggcaggaagctggcgatatcgcgcggcggcatggtggtgaaccccgccatgcggttgatggaggttcgggcgatcagcgattcaggagacaccagctcgcgcgtaggtaccagaaggatctgcgtgcccaatccagcttcatcgccgcaatcctccaacgcacggataagcggacgcgcaagcgagcggaacgcggctgccgacatatcggccacatccgggtagcccaacgccacgatacgatccagctgcttctgcgcttcttctgatgccttcgacatgtctaccagtgtacgcgagcgcgtttaccgaccagcatacggatagctcggcggacatgacggcatgttttcgtaagattgaacaacgcgtgtggccgcccacgacgtcgttttgggccggctggtcgacctcaagcgtaagcaaaatcaaacttgcaaaacttggaaaaccgttccagcataagcgaaaggttgttatgtccgaaaagattaaggttggcattctcggagctacgggcatggtcggacagcgcttcgtgacgctgctcgaaaaccatccgtggttcgaactggtcacccttgccgcgtccgcgcacagcgccggcaagacctacgaggaggccatcggcagccgctggaagatggaaaccccgatgccggagttcgtcaagcacatggtcgtcaagaacgtggccgacgtcgaggacgtggtcaaggacgtcgacttcgtgttctccgcggtgaacatgccgaaggacgagatccgcgccatcgaagaggaatacgcgaagaccgagaccccggtcgtgtccaacaacagcgcccaccgctggactccggacgtgccgatggtggtgccggagatcaatccggagcactatgaggtcatcgaacatcagaagaagcgcctgggcaccacgcacggtttcattgccgtcaagccgaactgctccatccaggcctatactccggctttggccgcgtggaaggaattcgagccgcacgaggtcatcgtgagcacgtaccaggccatttccggcgcgggcaagacgttcaaggattggccggaaatggtgggcaacatcattccgttcatctccggcgaggaagcgaagtccgagaaggagccgctgaaggtcttcggccatgtggacgaggccaagggcgagattgtgccgttcgacggtccgctgcgcatcacctcgcagtgcatccgcgtgcccgtgctcaacggccacaccgccaccgtgttcatcaacttcggtaagaacccgaccaaggacgagctgatcgaccgtctggtcaactacaccagcaaggccgccgagcttggcctgccgcacgctccgaagcatttcatccagtacctgaccgaggatgaccgtccgcaggtgctcaaggatgtggattacgagggtggtatgggtgtttccatcggccgtctgcgtgaggattccattttcgattggaagttcgtgggattggcgcacaataccctgcgtggcgccgccggtggcgcgctggaaagcgcagaaatgcttaaggcgttgggttacatcaccaagaagtgatgcgacgtttatgcggcttgggtagctaaaccgtaagccgcataaacgagccatagccaagcaaaaggccgactcttcggagccggccttttgcttgtttggggactgcttggcacggtatgcaacgtacggcgtgaatcgtaaaaagcaaacgaaaagggcacggtcgcaaaaccatgccctttaaaaataccgggaaactgaagccagcactatcagcggccggtgccgccgtacaccacggcttccacctggtcggcgtccagaccgtaggcggtgtgcagcgccttgacggcgtcgttgagctgctcgagcggtacaagcgcggcgatgcggatttcggacgtggagatcatcagcacgttcacgcccttgtcgctcagcgcgttgaagaacttcgcggccagaccggaatgggtcttcatgcccacgccgactacggccaccttgccgacgttcgggtcgacgtcgaaggactggaagcccagctcgccctgcttctcctgcagcacttcctggaccttggccgcagcggtgcccggcacggtgaaggagatgtcggcggtgccggtggaggcggaggcctgcacgatcatgtccacgttcacgccggcctcggccagcatggtgaacaccttcgccgccatgcccggctcgttcggcacgcggcgcacggtggccagcgactcggtgctgtcgtgcgcgacgccggagatgatcggcacttccggccccaggtcggggaacaggtcgcccatggactggttgttgttttcgctcatgttcttacctttgtttgtaaagtcttattttcgttttcgcgttgtcttgcaattatttgcgattgcctgcgattacgctgcccggctgccgttcagatgttcggcagggtgcgcggatcgacgccttccggcacgatcagcgtgccgcgacggtgggagaaggagctgcgcacgtgcaacggcatgccgaatcgctgcgcgtattccacgcaacgcaatgccagcaccttggaaccgcaggacgacatttccagcatcgattcgtagtcgatgacgggaatgcgacgggcggtcggcacgatacgcggatcggcggtgaacacgccatcgacgtcggtgtagatttcgcagatgtcggcatccagcgccacggcgagcgcgacggcggaagtatcggaaccgccacggccgagcgtggtggcgtcgccgccttcgttcacgccttggaaaccggccacgatcgccacggaacccttatccaatgcacgacgcacgcgatcgggcttcacggccttgatatgcgcggtgccgaactgcgcgtcggtcatgaaaccagcctgggaaccggtgaacgagtatgcatgagaaccggccgcatgaatcgccatagcgagcaaactcatcgaaatacgctcgcctgcggtcatcagcatgtccatctcgcgcgccggcgggttggaatcgatgctgagcgcctgatcgatcaggtcgtcggtggtgtctcccatggcggagaccacgacggccacgtcattgccggcgttcttcgtttcgatgatgcgtcgggccacgcgcttaatcgattctgggtcggctacggaagagccgccgaacttctgcacgatgagagccacaacttatccaatcttcttcaacgtatcacctgcctgattcggcaagtgaagcctattataggaaacatccattttgtcaagtccaaccgcgcccaacatgcggaacacgttgctggacagcggttgagtatgagctgggcgcgggaccgacggctcgcggaggccatgccagcggagctcatacggcgcgacggccggcgagcgcgcggccgagggtgatctcgtcggcgtattcgaggtcgccgcccacgggtaggccgctggcgagccttgtcaccttgatgtcggtctggctcaacagctgcgagaggaagctggtggtggcctcgccctccacgttcgggttgagcgcgaggatcacctccttgacttcgctgtctttgagccgttcgatgagtttggcgatgttgaggtcgcttggctgcacgttggccatcgggttgatgacgccgcccagcacatggtacatgccccggtattcgcgggtgcgttcgatgctcatcacgtccttcggctcttcgaccacgcagatcacgctgtggtcgcggcgtgggtcggcgcataccgggcatgggctggtttcgcacacgttgccgcagatatcgcagaaccgtactttttccttgacttccgtgatggcgtcgatcagtgtctgcgattcctcgtcgggcgcgttgagcagatagaaggcgatgcgttgcgcgcctttcggcccgatgccgggcaggttggcgaacgcgtcgatgagtcgttggatggcgccgtcataggccaaagccatggttcatacctttcgttgactggttgccgcagccacgttccggacaactgacgtctgatggccagcgcccggtactcgccgtacgataagcgacatgcgacgtgcggtggccggtgtcagtcgtcaagtgttttcttcacctgcatgttgcgcggattatgcggatcgtccgagctgaattcctcgactttcttcacttcgaacaccctgttcaggtcgttcatgtccaaagcgttcgatgcgccgatcgattcgtcgctcatggagtattcgtcgtcttccggggcgacttcaggctccggcggtcccgcctgcaccggcatgggggctccccatgggtcatccgcgaatcctgccggcgatgatgccggctgctgggcctgttgcgattgcatttcgcgggcgctttgccgtgcgctatgtcgttcgctgtgctgttccggctggttttgccgcggctgctccggcccattcggttggccttgctcctggccgtccgtctgcggcgtgggcagtggtgtggcccatgggtcgacgtcatcgctcacatccggcacgtccacatgttttacgtggtgttccggcggctgtacgtcgttggcgttgccttcggcgatgggcgtctgcggaattggggtgttccacggatcgtcgtcttccggctccttggcaaccttcttgccgaggttcgcggtcagcagggtggcggccttcagctgttcctgcaccagctgcgcgttgatcttgctctgctcttccgggctgagcttgctccacggcaccgcggtggaaccgtcggcaagcttcttggccggcgcgagagtgacatcggggccgaacaccttatgcacttcgccgcgcacgatctgcaccacattggtggtgccgtcgactgcttccttggccacggccttggcgaacgcgtatttgctcaacgacttgtcgaatttaatccacagtcggcctttggccccgtccagcagcacgcggggcactttctcgcggtccacgtagcgacggacatcctcaggcaggccggcaacgatcgcgtcccacttctggtcgggagtgcgatcgtccgttgccgcaggctgaggcacggactgagccacggactgggtgggagcggatggttcggcattggatagtttggatggcgcagactgcgtttcaaccggcttggactcggctgaagcggccggctcgctgccttccgacagaggtccacccatcgcctgctggacttccgccaatacggaggccgctccggaaacgacggcatcggccggattcgtgggagccgcggacggttccacggcatgccttctacgtgccgattgcgcggcgtacctacgggaaccggacggacgctgcgattcagacgctgcggcaccgcccgcatgcccagcttccggcatgccggacgatggtgcggcggcttgcgcgaccacgcccgtctcacgaccggcaagcaggcgggcggcgagcagttccaggcgcatgcgcggcgaaatcgcaccggtcatgttggccagcgtggcgttgatcgtatccgccatctgcgtaagcgcggccaatcccagcgaagccgcctggcgatgcagatcgtccatgttctcggtcgcggtgtcgtcagacagcacgctttccgcacgctcaccgcccaaggtgagcaccaacaggtcgcgcacgcgcgccagcaggtcctcaacgaaacgtcgggggtcgaatccgccgaccacgaccttttgaatgacgccatacagcgcctcgccgttcttgtcggcgacggcgtcgattgcctcgccgataagcgcgtccggcgtgaaaccaagcagcgcgaccgcggaatcgtaaggaatcttgccgtcgacggcaccgaccatcagctggtcgagcacggacagcgtgtcacgtacggatccgccgccggcacgcatggccaagcgcagcacacccgcttcggcctcgatatgctcgtcggcgcagatctgctcaagatacgggcccatgacctcctgcggcaccagacggaacggatagtggtgggtgcgggagcgaatggtgccgatcaccttgtccggttcggtggtggcgaagatgaacatgacatgctccggcggctcctccacgattttcaggagcgcgttgaagccctgcggcgtgaccatgtgggcctcgtcgaggatgaagattttatagcgatcgcgggccggggcgaatccggcacgttcgcgcagttcacgggcatcgtccacaccgttatgggaggcggcgtcgatttccaccacgtcgatggagccggggccgccggtggcaaggtcacggcagctggcgcattcaccgcacggatgcgaggtcggacctttggcgcagttgacgcaacgggccagaatacgcgcggaactcgttttaccgcagccgcgcggtccggagaacagataggcgtgcgtgagcttgttctcgtcaagcgcacgcatcagcggaaccgtgacctgatcctgtccgatcacgccatcgaacgtgtcgggacgataccttctatacagtgccagtgccatcgcaaattccttccgccgtagtgttctagagtatcgatgaattacgacacgttcgccaatcgggaagcgccgaagccgaccatctccgcaagtccatcgcgtgtctgtctgatctacaaccggcgcagccggtactctggaaatcagacatgaaccgtgtgatcggcgtaccgtcggtcacgaacgctgactgttgcgcgcctaaaacccgtgcgtcaccaccatgccgcacaaggcgttgccacgcgattgggaggagagagccatgaccgggaaaccggaagcgtccaccagcaccattggagacgcgcgtcgcttgcagatcgtgcaggcggcacgtgagatctgcttggaaaaagggttttcgaagatcacgatcagcgatatcgccgaacgggtcggcatgaccagatcgcttttctaccactatttccaagacaaagaccaggttgcggatgccgtgctcgacgatgtcatcagcgaagtcatcgcccgcctagaagagtggaacgagcatcgcgaggccggcaacatctcgaaggcgcttgacgatgtggtgcggctgacccgttcgctcatcgccgatgaaggcccgttcagccaacgtctcatcgaggatggcaacgctgcactgtatctgaggttcatcgaccgggccgcggaccgcatttccgaatacctgtgcggttccacggtacgtgaattcgaggaaaagcacggcatgccgatccgcaacgagcatgagaccttctacacgctgatcgtcggcttgatctcgctgatcagactgcatcctgacattgacgatgacattgtcaggcaggtggcggcacagacgctgcatttggacgaatatctgtgacggtgctctcacacgcgtcattcccgccggcaagcaacatataacggccgttcaacgtccggaggggcatcgagcggcaccggctggctgacggaaaacgacgtcaggcgaggaatctaccggtaagagggtcacgaccgtcacgtttgatggtttccaacacccgttcctcgctgtcggccgcctgcgcttccgccacggccggcggcaccagcacacgcagcgcacggtccttggctaagaccttcaccggcaaatggcccacgtattcgccatcggccatcaacaccggaggctcatccccttcggtggcgcgggtgatttcgatgtcgcgcacccgcttccatccgaaagcatggctgcccagcagtcggccgtggtaggcgcgtgccaccgcgtccacgcactcccggaaattcggcacatggtcaagccacaccagatcaagcagtccgtccgcgaaccgtgaatacggggacacctcgatgccgccgccgatatggcgggaattggccacggtgagcagtggcgagatgatatcccgctcctccaccgaaccgtcggccagcgtggccttgatgtggtatccgtagcttttcatgtgtgtcagctccacgatgaccgcggcgaaataccgcagcgagccattcggcagatgcgaatgattggcgcggtcgttgatgcttgcgtccaaaccgcacgacagcatgcccgcataatagcggtcgatcggcgagcgcgactgtgaaacatcggttccgtcggtcgaatcgatggcatgaccgtcaggcaacgaagtcaccaagcccatgtccacgtcgatatgcgtgccgcgcacaatcgcaccgacaatgccttcaacggcggtttcgacgcgattgaccggcaaatccagtccgcgtgcgaaatcattgccggagccgatggccacgatgccgagtggtttgccggagcagccgactgcgttggcgcctaacgcgaccatgccgtcgcctccgaccgcgaccagataatcgtattcgtcgccgcggcggcgggcgttggccagggaatcgtcgaagcttgtgccggtcacatcgattacgtcgaagccatgcttgcgtccggctccgcgcagcagatcaatgacatgaccgcccacttgggcgcccttgcctttgttcgatgtcggattgcagaccacggcaacggtcgtattcgcatgtgacgtcttgctcatacttgtacgataaccatgtttcacgtcaagcgccagattgcccattaccttcagctgaacattccgtgccgtcatgcaacgactgtccggcaatctcctaatcacaggcaataggccccgcacgtgactgccggacgacccacggtgcgaacggcacctgcgtggccgcctgcacggcgaccaccgcatcctcgccttcaatggcacaggattcgagccgggttccattgcccgacgttgtacgcgatgcggccgcgcacgggtcggcggcaccgtcacgcagcgactgcgcggcggccaccgacgccaggtcggccgtattctgcgcgcgatgcacgcacaatagcagattgcctgccatggcgaccgcaccgagcatggccgcgacgattgcgatcagcgcgactcccgatatggttccggaaccttcgtccgtgcctttcaacacatgcgacacacgtcgcacacactgtttcacgccatgtttcacggaagtcgcttctttcttatcgcgcattggaagcctttcaaaaaccgttacggacagcacgctgtcatgaacatcgcaatcagaaataccgagttgccttgcccacgacgctggcgggcagcacgccggtcggatccgccgcaaccgggcaacgcaccacaacggtgacgctgttcgcattggcggcgaacgacaccgtggaaccgccaccggcaatggtttgcgccgcagcgcgggctttcgcttcgccgccggcgtcaatcgccatggccctcgcaccggcggccgcagcgtcctgacagttcatggacactatggaggcacgccccaaacacagcaccagaatcgccaccgcggccacgcagggaagcaccaccgcgaattcggcggtgacggttccgcaatcggcgtcacgggcatggcgtctccaccatcgcgcaagcatggttaccccacgctcaacgctttcttgatgaggccggtcagcagcgttttcacgacatccgatttcacgatggcgatcagaaccgcggcgaatgccgtggccgccaccagcaccaccgcgtattcggcggtgaccgcgcccttctccggctcggcggtcagcaggcgcatgcgcgcgtccaataggcagaccgccttattggcacgttccttggccgcacataacttctggccgacgcgacccatcagacccggcgaaccatcgacattgattgacattgcgtcgttcatgacgctcctttcattcggctaatcccggccgattgaccgggtacgctcagtgtcaggtattggcatcggcgatggcatggttttcgtgggttgtggtcgaagaacgtgggttatccacaccctcggcgtgtcatccacacttatccacaagcgattagggcatgacggaacggaccgcgcatcatccgtcattccgaccgcggtccgattcgagcaaatttgagccaattcgcaccaacccgcactaccccatggcgaatcggccgctacagaaacgacatcaccgccggaatcacgccaatggcgacaaaggccggcagcatgcacaggccggtcggtagcaacaaccgaatcgacagtttcgccgccgactgttcaatccgcgaccgttcatcccaatccagctgctcgattgcggttgccaaccgattcaccggcgaggagccgctcgaccatgatgaggagaacgtgtcacggaccacggcgcaatcatcatcgtcaggccatgcctcattccatggcatgccactattcagccgttctccagccgagcgcaatccaccgccgaactcgccttccacaatgtttccgaccgtaatcagcgcgcgtggaatggacgctccttgacgtatcgccacgctcaacatttccaatatcaagggcaatggcagattgcatgaccgcacgtcggaatcgggcggatttctggctggcgaccattcatacagccatgtcgcgccagcggcgcccaccgctgccagcatcggccatgccaagctcatcgcacatgctcctgccgcatcagcctgcgaatccaataccagccgaaggcataacagcagccggcgaagccgaggcacatccatcctttcacgtcttccacaaggaatcgcaagggatgggctcccatgcattcccctagcatcaccgtcagcaacggcaatgccatcagcagcttcaccgtggcctgcggcatggcaaaagcgttggcacgcaagtcgtcgagcagccgtcgccgcttcaacgacgccgcgacggcctccaggcatcggctcatctcgcagcccaactgcagactcaacgtgcaggccgcatgaagttccgcaccaagctgatccacatgcttgtgttgttcctgaagcgagcagcggcttcgtacggccatgtcaatacggaaacgggtcagttcaggcactgcgaaaggagcgccctgtaattcctcgaacgcttggaccaaggtggctccgctgcgtacggacgcccgcagcgcggccacgcatgcggcagcgccgatggtcggcatccgtggcgatgcatcccggttttccccatcgttccggactgttctgccatgcccgtcggattcatcatcacaagttccatctccatcggccccgccgctatcgtcagccgaacgaagcccgaagcgaaccagcacacgctgtaatcgccgcaatcccgcccattccgcgttccgattcagccacagccagacggccatcgacgccagccatgcggcgcaatattcccaaccacacgcatcacgcatcatgcgctccatcggctcatgaatccatcccaacgttggccggcacggaccgtacggccatcccaggcggccagcagacgcccatgcaatcgcccttccaccgcttccaatctgccgacctgcgcaatgcgccgtctgccggcgatacgttccacatgaagcaccacgtcgaacgcatcctcggcgagcgccgccgtggcacgtggctccaatccggccagcaaacccaatgagaccaatcgcgccggaaccgcctccacttgattggcgtgcaatgtggtcatgccgcctcgatgcccggaattcaaggctctgagcagatccacgacttcaccgccacggcattcgccgaccaccacgcggtccggtctcatgcgcagcgtcgcgcagatcagttcggaaaggcctatgccgccggcaccttccgtgttggcttcgcgtgtgaccagagacacgtggttggcatgttggatcatgcccaattcgcgcacttcctcgacggtgacgatgcgctcgttcggcgggcatcgcatcagcatggctttgagcatcgtggttttgccggcaccggtgccgcctgtcaccagcacgcttgccttgcaggacaccagtccggccagcaggggcagccattcggctggaaacatgccgttgcgcgccaacgattccagattgggcgagaccgcatcgggcaatcgtatgctgatggccgcgccttgcggcaccagtggtgcgatgacggcgtgcacgcgcagaccgtccacggtggaggcgtcggcgatcgggcaggcgtcgtcaagccgtcggccaagttgcgagcataatcgcactgcgaattcacgaatcgactgcgctgacggaaagcatctgcgcagcagacatacttcctgcatgccttggccgcaatccgcccaaaccgtgccgtcgcaggtcaccgcgatgtccgtgacgcccggctgcgaggcgatggcgctaaggggtccgagttccatgcttcacccgcttgccttccaacgattcctgcagttcatccgtaagcgcggccaaggctttgacggtttggcggttcggtctgcgcaggcccaggccgtccaacagttcaccgcatagcttggcgtccggtttgacaaccgccgcgagggaatggccaagatagttttccgtctcttccagcgtggtcacgccacgtccacgcgccacgccgcgtggttcaacgccgacgatatggccatgtttctgccgttccgccgttccacgcgatttcatggccactctggctcgggccagtccgagcaccgtcatttcgaccacggtgatgtgtgtggcctgggccagttccggaatgtcatcgagtccacgccattgcccggcgtccacgatcaccgcgtccttcacctgcgcgagcgcgcggatgcatgcctggatctcccaggattgcgggttttcgcttcgccagggattgcaggccagcagcggcacgccatcccacacgggcagttctcgcagcagcgctttgccgtccactttgccgagcggggcgctgatgtctccgaagcgtgaaccgtcttcatcttccacaccgagcagcacgtcaagaccgccaccgttgagatctgcgtctaccagcacgcttttgcatccacgttccgttagttcgcgggccagcagcgccgccaacgtgctggcaccgactccggcgacggcggatccgaccaccacgacgttgagtggagcaggttccggttgcgcttcaacgggtttcatccgtgtggatgacgattccaacggcgaacccatgaaaccgcccgccacggcaggcccggcccatcgtgccgacgttcgcgcgtccatggcgttctgtggcgtatagaaccgttgcggcggggctgtttcccgccgaacggtttgctgggatcgagtcggctgccgcactctggccgctggctgcgaccggattttcggcgaacacgtcacgcgtgcgtcacggcctccgtatgacggcaatgggaccggagggacctgtaatgaagaaattgcatcgctcataccgccgattgaaaaacgaaaccgcacatgggttcaagccgaaacggcacctgtggtcggagaatgtgggttatccacaccctcggcgtgtcatccacacttatccaccgcaacgcgattcggcacatcgcaagacattacgcaacgcagcacggcgcaacgcaacaaaaaaggaagacccgccgaagcgggccttcctgcaagaatcttcggagcagaatcgctgcacaacaacatcgtcgtaacggtaagtctatccaatgcccgttcaacgtaacaacctatctcggtcatacacaccttgtggggctctgctcttcagttgttcttgtacttcgtaattatgctcgccattgcggcaagtgcaaaccgaaacgggacgatgttccgtatttatcgcaactgttgctttccgatcgcaagaatcgcaaaaatgctccatgctgtgcgaatcgcaacgcttgcctgttcattcacgttcattttccccgaaaaaacggcgtgtcggaagcatatttcaccaactcggcgaacgaatgttaactcctgcttaattttcctgagttttgcaagacattccaagcacttgaggataaagtagataactatggcacagatttttgacgcaccctcaaaggcgatcctgcgcagccagatagctgagcatatcgctgagaccgataagaacgataagcgcgagcttcaggcaggcgaggaaccgctgccgaacgaccgtttcttcgaccgtgagctgagctggctgaagttcaacaagcgcgtcctcgagcttgcacaggatgaggacctgccggtcatcgaacgcgcgagcttcgccgcgatcttcgcgaacaacctcgacgagttcttcatggtccgcgtggccggcctgaagcgccgcatcgacaccggcatcgccgtgacggccgcttccggactgagcccgaggcagcagctgcgcgccatcagcgagcaggcccaccgcctgcaggacgagcacgcgcactacatcatcgatcacatcctccccgacctggcgaaggaacagatcgtgctgctgagctgggacaagctcaccgcggccgagcaagagcgcctgtcgcgctactaccgtcagcaggtgttccctgtcctgacgccgcttgccgtggatccggcccacccgttcccgtacatttccggcggttccctcaacctcgccgtgctggtggagaatccggcatccggcaagtcgcacttcgcccgcgtgaaggttcctgacaacctgaaccgtctcgtgccggtcgacgacctgaccgaagacgagaacaccaacgtacgctatggcttcatcaccatggagaacctgatcatcgcccacctggaatccctgttcccgggcatgatcatcaaggaggcacgctccttccgcgtcacccgtaacgaggacatcgacgtggaagaggatgacgctgagaacctgctcaacgccatggagaaggagctgctgcgccgtcgtttcggaccgccaatccgtctggagatctccgatgagaccagcccgttcctgtcccagctgctcgccgaccagctgcgcgtgagcgccgacgaggtctaccgtctgccggcaccgcttgacgcgaccgtgctgttcgagctcggcggcatcgaccgtccggatctcaagtaccgtccgttcattccgaccaccaatcgtcagatcgccgaagtcgaatcgtcccgtgcgcaggacattttcgccgccatccgcgagcgcgacatcctgctgcaccacccgtacgattccttctcgacgtccgtgcaggcgttcctggcgcaggccgcggccgatccgaaggtgctggccatcaagcagacactgtaccgtacgtccagcaattcgccgatcatcgacgcgctgatcgacgccgcgcatgccggcaagcaggtgctggcgctggtcgagatcaaggcgcgtttcgacgaggacgccaacatcgcgtgggcccgcaagctggaacgcgcgggcgtgcacgtagtgtacggcatcgtcggcctgaagacccactgcaagctgagccttgtggtgcgtcaggaagccgacggcctgcgccgctactgccacgtgggcaccggcaactacaatccgaagaccgcccgcatctacaccgacctgggcttgctgacctgcgatccggtggtcggccaggatatgacccgcctgttcaaccagctgtccggctacgcgccgaagtcgagcttccaccgtctgctggtggcgccgcgcaccgtgcgttccggactgattcagcgcatccgccgcgaggaggacgccgcacgcgccggcaaggaggcgtggatcaagatcaaggtcaattccatcgtcgacgagaagaccatcgacgcactgtaccgtgcaagccaggccggcgtgaagatcgacatcgtggaacgtggcatctgcgcgctcaagccgggcgttccgggactttccgagaacatccgcgtacgttcgatcctgggccgtttccttgagcacagccgtatttacgcgttcgccaactccgatggcccgcagatcggcgaaggccccgcagccggcccagaagtgtggattggttccgccgatctgatgcaccgcaacctcgaccgtcgagtcgaagcgctggtccgcatcgtggctccggagcaaatcgacgagctcatcaagtacgtcgatctgcagatggccgattccaccgcgtcttggcatatgcaggccgatggcacctatgtgcgccattgcaaggatgaggaaggtcgaccgctggtcgacagccaggaatacctcatcaagaaacacacgcgtcgaccggtaaggcactgatcgatcgaggcgaatggccggttccgcactttgcgggcccggccattttctgtatgttcggacgtcacgcgccgccgccagcccggcccagcctagaataggacaatatgagcgaaaagatgagacgcatcgtggaagccgccggcggcatcgtatggcgatggaaggcgggcagcgatatcgcgaacgatcctgcgatcgccagtagcaaatctgcgcaggaacagctcgacagcattgaagtatgtatcgtgcaccgtccgaagtatgacgattggagctggccgaaaggcaagctcgagcagaacgagacgcatcggcatgcggcggtgcgtgaaatcggcgaagagacggggtcgccggtcaaactcggaccgtatctgtgcgaagtcgaatacccgttgtccgaagagggcaagaagacccggcattcgcacgattgcacggccgacaccaagcacacgttgtattggatggcgcagccgatttccgccgacgacgccgaacatctgctggacgcgttcggcccggtgcaccgcgcggacgtgggcgagatcaacgatatcgtctgggtttccgtgcgtgaggcgcgcaaaatactgtctcattcgaccgataaggacacgttggcagtgttcgtggaccgcgtgcaggagggtgccgcgaccgcgcagaatctgctgatcgtacgccatgcgaaggctgaatcgcgcaagtcgtggaagggcaccgacgcgaaccgtccaatcacgccgaaaggcgcggcgatggcgttcgccctcaaccgcgagctcgcctgtttcaacccgacgcgactggccacctcaccgtggctgcgctgccaggaaacgttgcaggtgctgagctggcagaccgaacggccgatggaacacatcaacgcgttgactgaggacgcgttcgccgagcatccggcggcctcatggctggcgttccgcgagcagatcacgcagacgctcaacagccgcgaaaccacggccatctgcatgcaccggccggtcatcggcggcatgtacgaccatttgcgcggcctgtgcgcgcgtaagcagcttgccaagcagctcatcgcaaaatcgccatacatgcctaccggcaccgccatgtcgctgttcatcatcgacacaccgcaaggccccagcatcatcgacattcagaaggtctcccccattgtctactaacatgcactacggttccggttcagtcgttcccagccgttccgccggtttcacgaacaccggttcgccgcgtccggcacgccccggccagctcgaccagatgatggccgacaatatcgccggcggcgccgatccggcggagatcaacgaaatgtgccatgcgtcggccgcggcgctgcttgaccgcgtgcaccacacgcaggacgccgaactggtggaacgcgtgctgacgctggtggaccgcgaaggcgtggacgtgatcgccgaactgtggagccatgccgaccccgactcgctgccgggcattctgtggcgactgtatctgctgcgtacgtggatgcggaagaaccgcgaatcgatcgcgcgactgtggcgcgtcggcgagcccgtcgccaccaccgcttccgcgattgccggcgtggaccaggcaccgacggaagacgacatcgcacgtaccgccgattcgattttggccggcgcgtttacaggcgatttcgccgtggcgcttgagcgggccgccgccttcaccgacgtggttgcgttgggattgcgtatcgaagcgcgcaaactggcttcgctgggcggttccagcgaggccggatcatctgatgtttccgacggttccgctgcgtctgctgcggccggcagccacccgtcggccgttgagaagcgggcgcgcgcgaaggctgcgaaactgatgcacacagccggcaacctgttcgccacggccaaggatttccgccacggggcgaatctgtggcggcgcggacgattggaataggccgttccactgtcgttttccactactgctttccaccgccgctttccgtaattttccccccgtttcataccccacgcgacacggcgctgcgaagcgtcgagcgcgactgtacaataggaattcgcgccgggccatgcatagccccgggctccattttttgccgctgcgagcggcctttgcgccgacaggcgctttcgtggttcggcgcttttctcctctttcgatgtttttcgaatttttctctggctttcttgcgattttcgattgccatccgatcggcgctcatctgggtttcatctgcccgacctaccggcgcgttgccgaacagccgatacatggactacgcttagaaaccatggatattcatgttttgaaccacccgctggtggaccacaagctcaccgttcttcgcgacaagaacactccgtcctccacgttccgcgagctcgtttccgaactcgtgatgctcgaggcctacgaagccacccgcgacatcgaagtcgtggacaagcccatcgaaaccccggtggctccgatgatcggcaagcacatcgccgccccggctccgattatcgtgccggtgctgcgcgcaggtctgggcatgctcgacggcatgaccaagatgattccgtccgctgaagtcggtttcctcggcatgaagcgcgacgaggagaacccgacccagcagatcacgtacgcgaaccgtctgccggaggatctcaccggccgtcagtgcttcctgatcgacccgatgctcgccaccggcggcacgctcgttgcggccacccactatctggccgagcgcggtgcgaaggacatcaccgcagtgtgcattctgggcgctccggaaggtctgaagttcgttgaggaaaacctcgacccgtccatcaagttcaagctggtgctgtgcgccgtcgatgagaagctcaacgacaagtgctacatcgtgccgggcttgggcgacgccggcgaccgtctgtacggcgtgatcgactgagctgccaatcggaataaatcaatcgaataaaaattcggcctgctaccgcaccaatcatgcgatggcaggccgaaaccatataaaaccggctgtcgcctgtcgatcatagtccgtcgactagcgcccggctgctgtcgctcgccgggcaactatcagtcggctactgttcgtcgggcacgaacgcttcgaagatgtggcggtcgaactggtcgcagcactgcgcgtattcgtcgcggctgcgcacggtccacgacaccggcaccgcacccatgaaccgggccagcttcacctgcgggctgttgccgcccttccaatcgtaggcaacgaaatcaggacgggaaatccagtcgaacaccagcgcgccggccgcgtattccttgccgagcgccaccggatcggtgggcttgtcctcgccgtacggccaccaggacagctggccgcggcacacttccggacggttctccttgtaccagttcacggccgccggattgaacgattcgatcacatacttgccggagtatgcctgcagcaacgcgtcgcccttctccatgagctccacatcgcgcggatcccacttcgaattatcatcgaacttatattccacgatcagcggcacgcggccggcgaccactttgagcacgtcggagaacagcggcacatgctggtagtagccttccggcgcgttgtcaggcgtggtgaccagcggcggattctccaacgccaacggcagcggcgcggccttgcatgcgcccggagcgtcggtcgggaacagcggaatacgagtcagctcgtcatacgtgagatcggcgatacggcgcggatctccggcaacacgcatcaggtcgccatcatgcaccaccacgacctcgccatcgcgcgtcatctgcaggtccagttcgataccgtacccggcttcacaggcggctgcgaacgcggcaagcgagttttcaggggcaatcacgccgggtgtatcagggctgccgtacccggctttcatggccatacggcgggcgagcgccacgtattcgccgctttcgttggcgtattgcgcggtgagtccggaaccggcgtcatgcagaccgcggtgcgcgtaccacacgtccggaacggccggcacataatgacggcgcttgtcggagaaagtacgcggcgcgattgcccagaccgcagctcctgctgccaccgcaccgccgagcagcgctttcttgagaaacgactttgacatgggcatcctcccttgcgattgaccctgctcaccgcatttgcgcgcgcaatgagccacttgttacgagcgtagcccagtttgccggttttcgctcacgatttcaccgattattcagtttcgccgttgcatatggcgattcccacgctctaacggcacccacgtcggcctcgaaaggctttcgcgggacaaaatatggaagggcgattgccgagtcggtggtggggcctggcaggtgcgcccttttgctcacgacttgcgatttaggccggtttggcacagtcgtgagcgaaagagggtgccgcaaagcatggtagggggtataaatcgcctgtttttccgtcttttttgacgcacatcccgccaaagatacgcaaaatcgtaagtcgtgagcaaaaggggtatcgccgatcgtttccctttcgcattttgttaccaggaacggactttcgcgggacaaaatacggaagggcgattaccgagccggtaagactggctaatcgccttttattagcggactgagacggtgaggctatgcggccaatcggcggcgtgatgcggggtgcgggccgctgcgttgcggcgttggctggagcgttggcggagcccgtttcgccgtccttggtaagcgatggcgactcgaaaccgccgttggtcacgaggttgccgccgtcgccgccttccgcggcaacggacacgtcgtccacgagattgccgtatgcgaggttgccgttgagcgtgttgtagacgccagcgcgaatacggtgtcgtcgccgtccgccgcgaattctccttcgtattcgttccatccgttgcgcgtgtactggttgaagacgccgctgtcggggaaggtccagccggggctgtcccaaccgttgccatccactcgaacatgttgtggaacaggtcggtgccgccaccccatgagaacgatggcggttcggcgccatgcgtgtccgcggtgatgaccgcgagtgtatcgaaaccgctcttcgaaccggacggacgcgccctgtgcttcagggaccatcggtatttcgcgccttgtgtggtggcgagccgctggtagatcgaatagttgccgttcgacgtggccggcttgccgaattggctgccttcggccgcggccactttctcgccggtgcgcatgtgcagggagtcattgtctccgttgccgtttttgaagacactgccgatttcgatgttgcctgaagtcgtggtggatttccaatacggaacatcgctggtttcacggtactggtacacgtccggctgttcgaaactgccgttctgcaggctgttttcggcggagacggtggcaacgtcggaagcggcggagacctccgtcccttcggcggaatccactccgacaaggggaataagggggataccaaatccaagaatcagggcacaggtgatcacgagcgcgagcacgcttcgctgggatttcccggcctgcatgtcctctcctccatgggaaccgggtggtgatgtcatcgtcgacattgagcattatgccaccaaaacagtaccccgtcaatgggtccatattagggggagtgaaatcattgacaacttgtctgattattcagcaaaaagccgtgtcccatcgaataatccgggaacgcaaatgcaatcgcaaacgcagatatgaacgcaatcaccaacacgaatgcgagcgcgccgcaacacaagccacccgcaacgcaagacgcccggctaccgcttcttcgaatcgcgtcctttgaagtagatgtcgaacacaatccagacggacaggatgaacgcgatcacgtagccgaggaaaccgacaatcggaatgccgaaaatcaccggcttgatgcccgcgtaatacacaatcgacgagccgatgaacaggccgaccacgataagcgccatcgtaagcctgttcaccatgttggcgagcaggtggatcggctcctgcgaaccgaccatctccatattgacgcgcagctggccgcgcgtgagcatgcgggacgccactttcagctcgttggcggcggcaagcagactgtgcagcgcctgatggctttcgagagccagcgatttcgtctcgtccttggcgaaatccttcttcgacgtgctcgacgcgatgtggtcggagatgatctggatcatgttcacgtcgggaatgaactcgtcgagcaaaccttccaaggtgaccagcgcgcggccgaccgtggtgacggtgctcggcacctcgatgccgtggcgttgcgccatctgcgttagagcagtcagcatggccgcaatatcgagttcagccaaatccactgtgccgaattccttgacgatcacgtccagatcggccagcaatgccggataatcctccggatcggcctcggcaccggcgaaacgcagcagaccgtcggcaagcttgggggaatcctgctcggccacggcgaagatcatgtccttcagcacggaacgggttttggcgttgagccggccagtcatgcccaggtcgagcagcacgatctgcccaccgcgcaccatgatgttgccggggtgcgggtccgcgtggaagaagccttcgtcgagtacctgcgtggcgtagttgtccacgagtttggtgccgatttccttcaggtcgtagccggctgcaagcagctcgtccggatgggagacggagatgccttccacgtagtccatgaccaccacgtgttcggtgcatagttccgggtacggcttcgggcagtccatgtatttgtagcgttcgcagaatcgtttgaattccgccagattgcgcgtttcgatgaggaagtcggtttccgattcgaaggtgtcccacagttcctcgaccacgccggacaggtccaccacctgcgcgctgcgcatggttttggtggcgattcccgcgatggtgcgcatgatggacacgtcctgcgccatggtttcgcgcacgcccggacgttgcactttgatggccacgtcctcgccggtgagcagtttcgcacgatgcacctgcgcaaggctggccgagccgagcggggtggggtcgatatggtcgaagatctcgtccacgggccggccgtattcgtcctcaagcacctgcagcaccgtgctgtatggcatggggtcggcgtcggcgcgcagtttggacagttcgtcgcagaacgattgcggcaggatttcggagcgcatggacaggatctgtccgaccttgacgaacgtggggccgagcgcttcgagcatgagacgcattttgacgggcgtgagtccgtgaaccacgtcgaatttgttggcgatctgcgcgatttgcgcaagacgccggagtttgccgcggcgggtcagatggtagcgcgcggagaacgtgtctttgcgcgctccgaagatgccgatggtttcggacgattgcgcgttggcaccggccgctttgccggtatcgtccgtttcgccggcatcgtccgcggattcgtgggcaagctcatccgtcagtccgtttgcttgggaggcggcgtccggcgaagggtcggccgtggggttgatgaccgcgttgaccctgtcggacagcgtgacgggctccacgctttcggggcgtgccgcgtccggcttgtcggatgggtgtttcaaagacatgtcactgctcgcaaacggttgggaaatcggctggaaagcccgcgatgccagacgaacgtttcgccggcgtcgcgcgggcatagcaaatcgccgtccgggcgctcacatgcgcggcagacggcgatacgaaagactggagctactcggccttgtcttcggtttcggccggggctgcatccttggcctcaggggcttccttagcctcttcgaccttgtgcttgagttcggcgttgagggccttgccctgctcgacggtcagctcgcccttcttgacgaggtcgtcaacgatttcctggctcttctcaacagtggtcgccaaggcaccgacgccggcgagaaagaccttgcgcaggccgtcaccaaaattaaaatcagccatgatgtcctcctttaggtgatggtggtaccactctatcgcattttcttcacatctgcgccgagcgaaaccggtcaatcgcataaaaagtggcggatatccggcgttcagcgcgggcggtgcgattgccggcgaaccggcatggcagccgtcagcgcggacgggacatggccacgcggcgagcacggtcggcgatttcgtcgatgcgatgcagggcggcccgttgcgcgtccgtctgtccggcggcggccggatcgaacgtgccgtaacggcgttcgacggcggtgcggatcaggaaatcggcgatcgcgggattcttcggcagcagcgagccgtgcatgtacgtgccgatcacgttgtggacgcgcgcgccttccgtatggtcctcgccgttgttgccggtgccgtcctgttcgacggtgccgagcggctgcacgccgtcacgcaggaacgtctgtccggaatggttttcgtagccgatgatcttgccgaaatcggcggaggtttccgtaagattgccgatcatgcgtgtttcctggccgaccgtgtacgcgccgatcacgccgatgccgtcgagtcgggagccgtcgaccgtttcgaaatactcgccgaacagctggtacaggccgcagatcatcagcatcggcacgccgtccgccgcgagcgaacgcagcaggtcggcgcgttggaagaagtcgtcgataatcttcttctggccggtgtcctggccgccgccacccagaatcatgtccacgtgctcgggccagtcgcagccctggttgtaggcgtgtacgcgcggctcgtagccgtacagcgcgagccggcgctggatggtgagcacgttgccggaatcgccgtagatgttcatatccttcggatacagcgacacgatgtcgatgacctggctcatatcgtctcctcgtcttccttccgctgttttgctttgcgattgcgcggtttcgtttcgcgcggcgctcacttgcccacgccggcgtcggccacgtcggcgattttggcgagcgcggcacgcgttttcagcatggccgtgtacgtgcagtagatgtgtttgggggtgccagaattcgcgttcacgaagttcacgaccgattcctccaggtcggtgctgaccgattcgaccggcacctgatcgtattcgaggcgcagggccatgtcccacgcgcgtacgccggacacggctttgacgccggtgccgcgcagcgaggtgaagtccacgtcccacagccagctcatgtcgcggccgtcggcgtattcgtcgttgatgcagatcatggtgtcgcagccttcgggcttgaacgaggccagcgacaggcggaagcccatggggtttttgacgagcagcagttccacgggggtgccgttcacggtgatgacctcgcctcggccgaatgccggtgtgacctcgccggcggtgtcgatcatggcctgcgtggtggcgtgcgcgaaggcgatcatacggggtgagacgcctgccgcgcgcagaatctcgtccgcagcggcctggtcgatggcgtcatgcgagccgttgccgtccgtttcggtaccggtatcggcaccgtccgcgtcgacactgtcggcgagcgcgtcttcgaacggcaggaacatcgcctgcgcgtccgctgcgacggcgcgcaccacggcgagcgcggcggccgcgttgtacaggttgtatacgccttccagtttcacggccgtctcatacgtttcgccgtcgatcgcgaaggtggcgcggtggtcgcccacggcgcgcaacgtcacgtcggcgggcagcgcgtcgggaccgtcctgcggttgcgatgtggccggcgcggcagccgcaacggcatcggcagtatcgccggcattgcccgaatcgccaatatttccgccatgttccgcactgtcgtgcgcttccgcgtcaacagtggtgctcatgtcgtcatccgacgggaagaagccgcgcaacgattcgtcaaggccgaagtagcgtacttccacgccgtcttccgtatgcgccacgtcagcaagacgggcgatgcgcgggtcctcacggttgagcacgacggtaccggtggtggcttccgcagctttggacagcagtcgcgcggtgttgtcgatctcgccgaaacggtcaagctggtcgcgcatcacgttgagcagcaggcagtagtcgggcggcacctgcttgacgaaatgcacggcgtacgcctcgtcgagttccagcaccgcgatgtcggcgtcgagtttgccggaaagcgagacttccgcaagcagcgacgaaaccacgccacgggtgaagttcgagccggtcgggttggtgaacaccttcaatccgagcgattgcagcatgctggccaccatgcgtgtggtggtggttttgccgttcgtgccggagacgagcaccacgccgagcggcagttgcgccaatgtgcgcgacaggaattgcgggtcgatgcgttccacgattttgccggggaacgcgctgccaccgccgtgcgccaaacgggaggccgcgcgcacggccttgccgatcaacggggttgcgaaggaattccaagccatatcacaccgcctcctgctgggactggtaatcctggggcatgtccttgaacttcgaatacgcgccaaggaacgcaagattgaacgtgtcggtcggaccgttacgatgcttcgccatgatgatgtcggcctcgcccgggcggtcctccttgtcgtaggcgtccggacggtgcacgaggaacaccacgtcggcgtcctgttcgatagagccggattcacgcaggtcggacagctgcggcttcttgtcctgacgcatttcggggccacggttcagctggctcagtgccaccaccggcacttccagctccttggcgagcagcttcagcgcacgggagaagtcggacacttcctgctggcggctttccacggccttgccggaggtcatgagctgcaggtagtcgatgacgacgagtttcaaatcgttcgtctgcttcagtcggcggcatttcgcgcggatttccatcaggctcatgttcgggctgtcgtcgatgaacaggggcgcgttctgcagcttgccttgcaactcgttcaggatggcccaacgttccggcgtgatgtcgtccgcgcggcgcatggcggcgagcggaatgttggattcagcggagatgatacgttgcgccaactcgtttttgctcatttccaagctgaagatgatggtcgtcaatccgtgatgcagtgccgcggaacgggcgaaatccacaccgagtgtggacttgcccatggccggtcggcctgccacgacgatcatctggccgggctgcaggccctgcgtcacgtcgtcgatgtcgcggaagcccgtcggcacgcctcgggacacttcgccgctttgcagacggtcgagctggtcaagcgtatcggcgatgacggtgccgatcggcgcgtagtcctgccgcactttgccggtggacatctcatatacttcggcctgcgccaggttgacgacgtcttcggcctgcgagccttctgcggtgtagccgagctgtgcgattttggtgccggccgcgatcacattacgcaggatggcgcgctgatgcacgatgtcggcgtaatacgtggcgtttgcggcggtcggaaccgatgcgaccaggctgtgcagatagtcggagccacccactttttccagattgccttcggcgagcagctcgttggccaccagcacggcgtcgaccggctgggaggccgagaacagtttgatgaccgcttcgtacacggtttggttgcgtggctggtagaagtcggacacgtcgatcatctgcgatacttcgccgatggcgtccttgctcatcagcatgccgcccaacaccgccatttcggcggcgtcgtcatgcggcggcacgcggtcgaacagggcgtcgcgcacggcttggccggatcggccgttcatgccgttcgcaccgtttccagcgttcgaaaatccgcggttctgcgccgaaccgttgttccaagagtcgttctccgccatgtccctccaaccgcagcagtcaatcgaatgtgttcaataccgaggaaaaccataatacgtgcgtgccgtcacgaccggtgttgcattgagattatggatgaatctccgcatccaccgaacgacacgcgcgaatggctttggtgtggataagaaagtcgaaaaaagccgagttatccacatattggggataaccatgtggaaaacgtttcgacttatccacagagtggggataactgagtggacaacttggggacatcctaaagcatgtaccccgattcccttatttcgatttgccgaagtgaacggaaggtgatatgcaccccgcttttccgtaaacgacgagaaatacgggggcatatcggcttggcgcatgcgagaaaccggcgctcacatgtggtatcgggtggcgttgtacatggtgcgcaccaacgtttcacgccatttgctccacccgtactgtttggagatggtctcgccggacgtggcccccaacgaggagccgtcggcgcgggtcaggtcgaacagcatgtcgagcagcacgggattatggtcgagccggccggccagatcatcgccgacgttgggatcattgggattgcggcctgtggcgaactccgacaatgtcagatgctcgcgtaccagcagcgtgacccagcggacgatgtcgcggtcgaatcccatgcgttccacgaccacggtcgcatgccgagcaccttccgccgcatggttggccacccccggtcgtttgccgatgtcatgcaggatgccggcgagcagcaacgcctcgtaatgccggtcgtcgtaccgcccaccgctgggtgtttcacggccgagccgcgtgacgacctccaccatgtgccggtcgatcgtatagcggtgcgcggcggacgcgcttggccggttgcgcacgcccaaccattcggggatgagcttgccgggcacgtcgatgaaatcaatgtcttcccacacgttgagcagcgcggggccggaagccagcagtcgtatgaacagttcacgcgattcgtccgtccagttgcggtcgccgatagggcactttttgagattccgcaacgttcctggggcgatcggcaggccgaattccgcggccgcgacggccacgcgcagcacgaggttcgggtcggcggccggttccgcgcccggagcgagcactatttcctcttcatgcttggccacgccgggggcgatcacatcgaaggtcggtgcctgacgtttgccgccaccgcgcggctggaacacttggaagaaggcgaatcgcggcttgtcgtgcgtcagcgaatgctcggcgcgcgacgcggtggaatcaagggagaacgcgatctgccggccaacgcgtgccagcaacgtttgcagatcgtcgatcgacttcgcctcacgttcgccatcgggcagcgtcggatcggccagaccgagcatcgccgcgactttggcttggtagggcgatagcagcatgttcgtatctttgccggcgaccagatggatgcagtcgcgcacgtccagcaaccgttcgacggcgtcgtcatacgtgccgtgcggacggtcagcaagccaggatgcggcgagcgcggacaccaatacggagtcgcgcaaaccaccgcgtgcctctttgatgtccggctggttgatgtaggccatgcggccgaattcgtcgaggcgcgatttggcggagccgagcagttccggcagacgtttgcgcgcggccttgcgccatcgttccaatatggatacggctgtgctttcgataagtccagtgtcccccgcgatcggcaccacgtccaaccatcccatagctgcgggcaggtcgcggtcggtgacggcctcgcattgcgcgacggtacgtaccgactggtcgaggtcgaggccggaatcccagatcggataccacagtttgttggcgagctcgttgagctgctggtcggtcagcgcgtgcggttcgtagatgaccaccagatcaaggtcggagctggggcctacctggccacgtgccagcgaaccgaccgcgccgaggccgatgccggttgccggcacgtcgaaggaaaccgcttcgcaggcttcgttccacaactgtgtgagattgcccatggccaagcccgtgcgggctttgcgtttcgccgcgccattgcggtagacgccgtcggcgtcgggctggctcatggccatgaaccgttgtttgagaccatcgactgctgaagtcataacgcacgttccttatgaaacctatgacggcttatgacaatccccgcacggcgcaaggcacgtacggggatgtgtcgtaattgataacccgaacttcaagcccggggtctttatttcatcttgtccgaatcggcccgatcacaaggccggacggatcagatggcggcggaaccggtttcgccggtgcgcacgcgggtcaccgagtcaagcggagccacccagaccttaccgtcgccgatggtgccggagccggcggacttgacgatcacgccaaccagggtttcggcatcggcgtcgtcggacagcacctcgatgcggatcttcggaatgagatccacggtgtattcggcgccacggtagacctcggtgtggccgcgctgacggccataaccgtttgcctcggacacggtcaggccgtgcacgcccgcggctgcgagggcttccttgacatcgtcgagtttatggggctggatgatagcggtaatgagcttcatctcacttcacctccttgaggacggagctggcggtaccagcaaaatcgtaagcacgttcgccctggtcggcaagatcgatgccgccgacttcctgggcttcggtgacgcgccagccgatcgtcttctccagagcgaaggcgatgatgccggtgatgactgcggaccagacgatggccacgagagcgacgatgagctggacgaccagctgcctccagtcgccgcctgcgaacaggccggtgccttcgccgaagaagccgatgagcacggtgccggtgaagccgccaacgccgtggacgccaacgacgtcgagggaatcgtcatagccgagcttgaacttcagaccgcaggccaggcaggtgagcacaccggcgatggcgccgagcacgatggcccacagcggggagaccacatcggcggccggggtgatggcgacgaggcccgcgacgatgccggaagcggcacccattgcggtgtagtggccggtgcggatcttctcggtgaagccccaggagagcattgccgcagcggttgcagcggacgtggaaacccacgcgtagccggcggtgccgttggctgcgaaggcggaaccggcgttgaagccgaaccagccgaaccacagcaggaaggcgccgagcatgacgaacggaacattgtgcgggcggaacggctgcgtgccgaagcccttacgcttgccgatgatcagcacgatgaccagagcggcgactgcggcgttgatgtggacgaccgtaccacctgcgaaatcgtgggcggctgcgccgatcgcctgggaaatggcgccgtcagcggacagcagaccaccgttccacaccatgtgggcgagcggagcgtaatcgaacgtgatccacagcgccacgaaaatcatccacgtggagtacttcacacgttcggcgatggcgccgcagatcaacgcgacggtgatcatggcgaacgcggactggaaggccacgtccacgctgaccgggtagttgttgccgttcagcgccgccgatgtgaagacgcccttatcggaaaccatggtgtccttcagcaggaagccggttgccgggtcgccgaagatgccgccgaccgaggtgccggcgtaggcgatcgaccaaccccacagcacccacatgatcatcgtgacggacagtgcggccgcctccatgatcatcatattcagcacggccttggcgcggaccatgccaccatagaagaacgccacaccaggcgtcatgaggaacacaagggacgcggaagtcaatatccacgcggcatttccagaatcaagctggcccatgtcaccctcctctttctttctctatatttggttcaacatttccgtccccatcgtgtggggctgacagaacgatatggaacgccggccgcgttttgaaaacgttacgacgtgttacgccaacgtaacgccatccgcgcgaaacgtcaacctacgccgaaaaatggcggaattccaacgaaactggcggtacggaaatacggaaggcataatcgcccggcaatcgcaatatgaaattgcgacggtggacggaagcggcgggcaatgctgcggacggagtaagttgggtagctgaaacttacggaacacgcgtggcacgcgacgggagaacgccgcgtacggcgagcgcgtggcatgtacaccgaacgcgcggtgcggcgaacgtatgacgcgcgtaacgagagagcggcgaggaccatggcaacgttcatcatttcactgtgcgccattttgatgctgaccacggtttccgggctgatctgccgcaaagcgcagctgccggaagtgatcgggcagattctcgtcggcattctcgtgggcccttcgctgctgggcgtgatgcacatgagcgattcgctgtcattgttcagcgatctcggcatcatcatcctgatgtttttgggcggtgtcggctgcgacctgcagttgctgaagaagtattcgaaggcggcggtcatcatcgcgtgcatgggcgtggtgttccccgtggcggtgatgggtggagtgagcctgctgtttggcttcaagccgattccggctgcgttcatcggcgtggtgttctccgccacgtccgtgtcgatttccgtggcggtgctgaaggaagccggactgcttgattcgaaggaaggcgtgtcgattctcggcgcggccgtggctgacgatgtgatcggcgtgatcctgctgtccgtgatgtgcacgctcgtcaacaccggcagcgtggacgtggcagggctgggtttgattctgctcaagcaggtgctgttctttgtggcggccgccgtggtggtggtttgggtggcgccggcgctgatgacgctggctggcgtgctgaaggcgccgtccggcatcgcggtgatggccgtgatcatctgcctggcgatggcgtgggcgtcgaatctggccgggttgagctacgcggtgggcgcgtttttcgccggcatcgcggtaagcaacagcgattacgcggaggacgcggaccggtatatcgagccggttggagacacgttgttcgtgccggtgttcttcgtgggcatcggcctgcagaccacaggcgtggatgatacgaagatgatcgtgttcattgcgatcatgacggttctcggcgtgatcacgaaggtcgttggctgcggtttgggtggccgcatggccggtttcggcggcgcttcggcgctgatgatcggcgcgggcatggtgccacgtggcgagatggcgttgattaccgcgcaaatcggcttcaacgagcatgtgctcggcagcgaatactattcgacgatcatcttcatcatttcgctggtgacgctggtcgcgccgctgctattgaagctgacgatccggaaagtgccgggagtgggggctggcgctgccggtacggctggcgctgagcagtaatcgcaatacgaaaacctcccgccacgtacggaacgtgacgggaggttttcgctacggaaatcgcaaatccggaaaatatgggaacgtcaggcgaggatgccgtcgacgaagccttccggatcgaacggggcgagatcgtccgggccttcgcccaggccgaccagcttgacgggcacgccgagctccttctgcacggagatcacgatgccgcccttggcggagccgtcgagcttggacaggaccacgccggtgatgccgatcgcttcggcgaacaccttggcctgcgtcatgccgttctggccggtggtggcgtcgagcacgagcagcacttcgtccacaggcaggttcttttcggtgacgcggcggatcttgccgagctcgtccatgaggttggacttgttctgcaggcgaccggcggtgtcgatgatgagcacgtcggcgttctcttccttggccttggcgctggcctcgaacgcgacggacgccgggtcggcgccgtccttgtcggaacgcacgaccggcacgcccaccttggcgccccaggtctccagctggtcggccgcggcggcgcggaacgtatcggccgcgcccagcatgacctgcttgccttcggagacgagcagtcgggacagcttgcccgcggtggtggtcttgccggtgccgttcacgccgaccatgatgatgacgctcggtttgttcgcaccttccttgtcggcgttgagacggcggtcgacgtcggtgccgacgagcttcagaagcttgtccttcaacgccgcacgcacttcggccgggtcggactggccggcgatgcgggcgtcgttgcgcaactcctccaccagttgctcgctggcttccgcgcccacgtcggcaagcaggagggtgtcttcgacgtcctcccagtcggcttcggagagctggtccttggcgaggatgttgaacagggccttgccgaacggattgccggacttggacaggcgcgccttgaggcgctgcatgcgggtgccggcggcttccggggtttccaccacggttttcgcgacgggagatttctcagccgcgggcgctgctgcagatgcagacggttcctgcgcgttgaccgccgccgtttgagtttcctcagccgaagccgcgctcgcttcggcatgctgggcatggtcggcatcagcattgctggcgtgctcagtgtcttcagtatcttcggtggcgagttgcactccctttgccacggcctcgtcggtggcccgttccacggaccgcttcgaagccttgccgaaccaccatacgccaatgatgatggccgcgatgacgaccacggccacgacaatcgcaataatcacattcgtatccatggctccagcctaaaaagcgcaacggacacgctgcctccgccccgcggacgcaccacaaatgtccgattcaccaaaggaataaggtgctctaccatgcaaggcattgaagtgagtacttaattattacgcatttttacctcgttgtagctatgcgtgcaggtgatatgcctggtaacgatctttacaaatcgtgaagagtgatttttttgtcttctgctgcctgctttgaagaactgtctcctttctttagggaatttgcgtagcgaatcaggctcctcgcgatgaggaagaccagaacgaatacggcgattatgcctaggatttcgatcaataatgcgatccatgtccagctcatgattcatcccttctctttctgtactcgtctatgagtattcgagccgtgtcgacgtcgtatctatcgtcgatggcgagactcttcaccaaaaggatgaatggatcctccgtctcgttgtcgttcaaccgtattttttcgataagcctgtcaagccggagcctcatggtcgggtaggagacttgatacagctgagacatttgcttcagagatcctgacgatagcacgaagttcttaatgaaggccaaatcctcctccgcaaggttggccaaccattctggcagatggtccacatcaccccctttaataaaatttattatttattaaatatattaaagccataatggagcattgtcaatatgacacacgtgtccgattccgcggaatcggacgataatgggatcggacggtcaaggggctatccacggggcgtgaaaaactgggcagtatggccaatacatccagaatgacgtcgtatcagaggcgcgagcagctcatcgaaatcggtcgatcgctgttcgcggccaagggattcgaagcagtgagcgtggaagagatcgcctcgaccgcaaaagtgtcgaaacccatcgtctacgaacatttcggaggaaaggaaggcctgtacgccgtggtggtggaccgcgaaatgcgcgcgctcaccgacgttctcatcaacgcgctgtccgacccgcaggcgcatccgcgccaaatcgtggaacgcaccgcgcttgcgctgctcacctacgtggaggaaaacgccgaaggcttccgcgtgctcacgcgcgattcgccgaaaaccgacccgtccaactcgttcaattcgctgcttggagacatcgccgtacgcgttgaggacattctcaccgacgcgttcaaacgccagcatctgccggccaaaagcgtgccgtattacgcgcagatgctcatcggcatgaccgtgtacacctgccaatactgggccgaccagcgcaagctcagcaaggagcagctcgccgcgcacatcgtgaacctggcatggtatgggctgagccgcatggaagccaagccggaactgcgctacgaaagcgaaaaggccgcccgcgaggcggaaaagcaggccgcgcgggaagcgaaggcgatcgccaagcaggagaagcagggcaagaaggctgcgaaatcgcaggagaaggcggttgctgcgggagatgacgcgacggacgggacaaccgtgacggacggatcgcaagcggcagacgaatcaaacgaatcagacgagacgaacgaatcgcaaaacccgcaaagcccgcacgaatcgcaaaaacaatcaacaattgacgaaaactgacataccgtcacccgaaatgaccctaggggaaatttcaggtgcagattgcgtatttcagggtgccgtttgtgcgcaaaaccgtgccccggaaccgcacatggtgctacgttagtttcgttatgcttttggccggagcggtcggccagccgcacggcccgacacgagcccgatccgaggaagaatatgcaggagaagaagacgctcaccttcgtggtgcccgcgtacaacatgacggaatacctggaacggtgcgtcgaatcgttgatcgcgtcgaagcgcaacgacgacatcgaagtgctgatcgtggatgacggctcgtccgacggcacgctggagatggcgaagacgttcgaggcgcgcaatccgggaatcgtgcgcgcgatccatcaggagaacaagggccacggcggcgcggtcaacaccggcatcgcggcggcgagcggcatgtacgtgaaggtcgtggacgcggacgattgggtcggcccggaatcgctcgaacaggtcatggccgtgctgcgcggcgaggtcggcaaggacgagccgctcgacatgctcgtcaccaactatgtgtatgacaaggtgggcaagcgcaacaagcacgtcgtgaacttccgtcacgccatggagcccggcaagcggctcacttgggacgatctgggacatttcggcctgaccgaatacattctcatgcacgcgctgatctaccgtaccgccgtggtgcgcgaatcgaagatgcagctgccggaacacacgttctacgtggacttcatctacgcgtaccagccgttcccgtgggtcaagtcgctgcaatacgtggatacgccgttctaccactatttcatcggccgcgacgggcagagcgtgcagacggacgtgatgatccgtcgtgtggaccagctgcggctcgtcaaccagtgcatggtgcgcgccacccccgaacggggtacggtgccagacggcctgtaccgctatatgattcattttcttgcgattgaaagctccgtggcgagcgtattcatgatcctctcgcgagagccggagaattacgagaagaagaaggccatgtgggaggatatcaaggaatattcgcccacgatttacgcggacgtgcgcaagaaggcgatgtcgcgcgcgctgaacctacatggttcgctcggccggtttgtgattcgaaagggatatttcgtggcggaacatgtggtcgggttcaactgatttcgcgcgggtttcgcaggtttcgcgcgatagagggtttacgcgatattgcgtgagtattgcgattattgcgatcggctaggcgctcctgtgtccgtttctggtgattcggacacaggagcgcttcattttgatgcctgtgtgtccgattcgggagaaacggacacggaaagcaccagcgggcttagttccagcgatccgacatggcgaaactgttgtgcatgagattgctggacgtgtacagcacgtcgccgagcagcttcgtattgcgcgatcgcaggtattccgccatttcgtcgttagccgccgcaagacgggccggaacagatgtaggactagcaagcccatcggaaccggaatcaaccgcagcaccagacatagaaccagaaccgccaaccgcagaaccggcaccagaaccagcgccaccagccccagtcgccgacccaccaatcgcaagcgcatcatccgtacgttccaccagacggtggccgaaggaacggacatcttccgagaagccctcgaccgcgttgctggtctcgtagaagtgcgcgtcggcgagcgttgcaatcaggcggttcgtccaatacaggcagtccgtggagacttccggcgtggtgtcgcgcagatatgcgggggtatcgtcgacgttcgcgtagaacggcgcggacgtggtgaatgcgccggaaccgtacgaaacccacatgatcgaacggctttcggctggcgcatacgggcggatctgcatcgccaccatgtgcccggtgcggttgatgccgatcggacggtagcgatggcggctttcctcagttccctgcgtaccgtacgggtcatacggggtgccttcgaagtgcgaaccgagcaggaagtcgacatcctcgacggtcacggcattctccggttcgagacaccatggaatgtcgtccgattcaggggtaaggttttccgcgtcggccggatcgagatagcggtacatgtaccaggcgcgtggcgtgttgtagatgtggtccttcgcggtggcggtgccgaatacgatacgcgggttgcagtggccgccgttcatgccgccctgcgtacccgccgcgcgcccaagatggtgtgtttcgatgaattcctgcagatcggcgctgcacatgaattcgcgcgcgtcgctgaaggcgtcgtcgaagtcgaaatagtcgatgccgagctggttggggatgatggcgcatttgtcgtccggcacgcgacgggcgatccaatggtggccgccgatggtttcgacgtaccagatttcgtccacgtcggaaatgatgatgccgttcgattcgtacgttccgtacgtttcaagcagttcggcgaggcgcttcacgccttcgcgggcggtgctgacatacggcaatatgagggtgatgatgtcttcctcgccgatgccgccgggcacttccggcttgccgtcggcctcgtcggctggctgcaatacgaccagcgggtcggcggcgagcacgcgctcgttgacggcgatggtttcggtggcgctcatggccacgttgcgttcgttgacgccagcttccgcaaggattccacgatttggaagcacgttcggtacgatgctgtaccggcatggattgtcgggaaggtcgatttcaacgtggctcagcacactgcggtagtgccgcggctgctcctgcggtgcgacgactacgaatttcttcggatcgtaacggccggaaccggaatcgtcgtcgcgggcgatgatggtcgaaccgtcgtaacttgcttttttgcctacaagaattgtggtacatgacatggtttcgattgtaggcacaccaacactccgaagaccatttcgacgcccgtcagacgcccgcggtggcgattggtccgaatatgctgtatactatgttgctgttgcccctctagctcaacggttagagcagcgtccttttaagtcgtgggttgtgggttcgaatcccacggggggcacaggttcgaagtcctggaagccgatggttctcaggactttttcatttgtttcgggatgaggtctcagcacttcaatacggaacgcaccatatcgcgcaccctctttcgctcacgaatcgcaatttcggtcgattatttcgcgacgtgcgccgaaaagtatggaaaataaggcgatttataccccctaccgcactatgcggcaccacctttcgctcacaatcgtaagaaaacgagcgaaatcgcaatatgtgttccgaaatgaatagcgaacagcccgcgggcgattcgcggacggaccatacgcatgcaaccggcgtggcgcaatcgacgataatgatagactcgaatatatcgaacatttgttcgcatagattcggtattacgggaaattccccactatatacagtgggcgaacgtacgaaacgccactacgggtagtgtatactgatgaacggcctgctcagccgggcaaaatcaaaaaacgtggccgacaagatcttccgcaccaaaggaagccgattgcatagggaggaaaagtaatgaccgtgaccgtcttcaccaatccgaacaatcctcaatgcgaggccaccgaacaagagctttccaaactgggagtgcggtacgtggcggtcgatttgacgcagaatccgtccacattcgaacagatcaaggacgccggcttcaagcaaattccggtcgtcatctcaccgaattcctcatggagcggacatcgccccgacctcatccgccagctggcgcaaagcatcgcggcgtaggcgcggcaacagcagtcaagcatccagacagccggaaggcacgaatcccaaacggcaataatccggaagaatcaaatcccccgcggcaaaacccgcaacaaaaccccactgcaatcgtccgaaatcgttcaaaatcagccacccaaagcaaagcggccagccggaacatcgcccgaccagccgcttagcaaaacccgcaaaacgcaaaaaccagcctacatacgaccggcagtggacgggtcgatcttcatggtctggaatcggtgggccatgaaatcgtcattgaaatacgtggcgaagaactgcgaaacgggcgaattctgcgcaaccccagccatgcgggaataccaagcatcaagggccatcagcgtcatcacaccgtcgacgaaaaggaaaatgaagcagaccagcgtcagcgaatagcgaatcttccacggaatacgctggatcaatcgcaataatcgcggcagaatcaacttgacccaaaccaagccgaggacgccccagaagaacatgtatttgccggacgtacgcccgtcaatcgaaagccattgccccgtgtaatcccatgcgcgaataccgaacgcggcctgcatgaaccagctggtgaaatattcgaacgcgccaccgatcaccgcgcttgagcagaaaatcagcaaccaattcgactgccacaaatggttgagcaacacggtgacgatcaccacgccgaagccgtaaatcggcgagaacggcccccacaggaagcctgcgcgatcctggtattcgccgaacagcacgaaatggtagatggtctcgatcaccaaaccgaacacacaaccgatggcgaacaaccagaacaaattgaagaaatccagcgaaatatagcccttgccggtcaaatcgcggccagccataccctgggaagcggcgtcttcgtatgcgctacgggcatccatacgtcgcaacgcgaactggagacgacgttcctcacgcagcgacggatcggcagtgacatgcagggctatgagcacgacaagctggatagccgggccgatcaaattcacaccaagtccctgcaatgccagcgacagcaagccttcggcaagggtgagcggaatcatcagatacgtccattgcgcgatatgccgacgcttgttcataatgagcatcacgccgaacaccgccagacacgcggtggcgaccagcagcacggccgcgtgaaccaccgacagaatcgcggtgaggctgagcgcatcgaacgccactttgccggaaaacaccgcgcgaatcgagtacaggcacgccaacacaatgatcggcagcgtcaccacgccttcaataagcatgacgatgccgtaaatgcgaacgattaacggcagacgacggtcagcgggattgccgacttcgccagtgccctgctttccgccttcttcgatagccgcgatttcggtttcggcggcaatcgccttgatttctccatccgtcttgcccgcggcggaatcctcggatcgtgattcagattgtgcggtttcgctcatatgccgctccttccttcagcccacgctaccaaacgtaggcaatatccgccgcaagaaaagcggttcaggtgcgattattggcggacgcgagcaaaagagggggacgtcagctggctgcaatcgccattcgcacaccacctttcgctcacgtccgcaagaaatggcgatgcatagcgcatcgtgagcgaatgggggtataaatacggacggaaaatagcgatttattaccacctttcgctcacggacatacagaaatggcgatttgtcacggacgtgagcggaaggggctacgtcagccggcgatggttttgccgaggctttgccgcagtactcgacccgatttccgtcatccatgaaacgcgatggcgattgtcccggagcgcgttatacgatacgtaccgcgtagcgctacgaaatacgtatcgctatgagaggaatgattcaccaactcggagaaacaatgcacaacgtactgcagatcctgcgccgtgacttcaaacgattggtcaccgtacccgccgcgtgggtgattatgatcggcctgattctcattcccccgctatacgcatggttcaacatctacgggttctggaatccctatggcaacacggacagcatcaaagtggccgtggccaacatggacaaaggcacagacaacgcgctgcttggcaaagtcaatctcggcgatcaaatcgaaggcacgctgaagagcaacgaccagctcggctgggagttcatgggcaaagccaacgcgatggaagcggtggagtcgggcgactgctacgccgcaatcgtcatcccttccgacttcagcgaagatctggccaacgtcgtcaccaacagcaagcatcgccccacgctcgaatattacgtgaacgagaaggcgagtccgatttcgccgaaaatcaccgaccaaggcgcgaccgtggtcgaccgcaccgtcaacaacaccttcgtctccaccgtcagcgacgtgctcgtcaaagccgtcaactcggccaacggcaccatcagcggcaacaccaacgccatcgccaacgaaaccatcggcgaactcgacaacaccaagcggaacgtaggcacgatccgctccgcaatcgcggatctcgacacccagttagccaatgtgccacagcagacaaaagcagcacgcaatgccctgaacgacgtgcagctggccgcggcgagcgcaggcagaggactagcaggcgcatccaccgccatcggcacagcgcaaacccagctcaacacgctttcgtccaacgccaacagcgcgctggaaaccggatccggacttgtttcccaagcgacggcgcaatccacagccagcatcaaccagatctcgtcggcggtatccgcggcaagtggatcggcgcagcaggcggtgaccggcatgcaaaacatcaccgacagcaatgcgaaactgctcgagaagctcaaatccgccagcgacaacgcgcaataccagcaaatcatcagcaaactggagaataccaacaacacggcagccggaacactcgccgacctcaaaaccctgagcgagaacacacaggccacagccggcagcgtatccaaactgtccaccgatttcaacataggcacgcagaactcgctcaaaagcgcaggcacggcgcgcaacgccatcaattcaggcgcactgccgcgactgaattccgcgctgggctcgctggctgggacggccggaacacttgccggcaccgtgaccagccaggacagcgtggtcaggcaaaccaacatcgtgctcgaccaactcgaccaagtggcgtcagacgcccgcatcggccttgagcaaaccgaccagcagctggcgaagatggagacgaagctcaccaccgtcagcaccgacctgaaggcgctgggcactgcggatctgctcgcatcgttgaccggcagcggttcgcttgacgcggataagatcgcctcgttcatggagtccccgaccgtaatcgacacgaagaacgtgtatcccgtcaactcctacggctccggcatggctccgctgatgaccaatctggcactgtgggtgggcgcgttcgcctttgtggtgatctacaaagtggaggtggacgacgaggggcttgagggtctcgatccgaccgcaaccgaaaagtatctggcccgatacctgttgctcggcacgatgggcgtcattcaaggcgcgatctgcaccgttggcgatctgatactcggcgtgcagacggcttgcgcgccactgttcatactgaccggcatgatcacatcgctggtatatctgagcatcacgtacgcgctgtccaccacgttcatgcacatcggcaagggcctgtgcgtggcgttggtgatcgtgcagattccaggcgcttccggcctgtatccgatcgagatgatgccgaagttcttccgcatggtctatccgttcgtgccattcagctattcgatagacgcattccgcgagaccatcgccggcttctacgacggccattggaccaaggcgatcggcacgctgctgctgtttgccggcatggcgttcgtcatcggcctggtggtccgtcctctgttggtcaacctcaaccgactcttcgcccgcgaaatcaaggaaagcgacatgattatcggcgaggaagtggagcttccggaacgcggatacaacatgtcccaagccattcaggtactggccgacaaaggcggctaccgcgaggtgatcgaggaacgcgcaagtcggttcgcggaactgtacccgaaactcaagcgcggagctctggtgatcggattcgtagttccggtcactctggcggcggtgttctcgttcaccaacggagagaaagtggtggtactggccacgtgggtcgtctggattctgctcatcatgggcttcctcatggtcatcgaatacatgcgcgataatctgaaccgtcaagtggagctcggccatttgagcgatgaatcgatccaatccatgctggtggagcgccaagcggcacgcatccgtcgcaaaaagcgggcgcaacaggaacggcggaacagactgctgcgcaaaacgcggagacgcaccagcggcaaacgcacgacatccgataatcgcaataccagcgtcatcaaagaaacgacggaaaacgtgacgggcgtcaaccacaatgaagatgacggaatcgccatactggtgcagaaaatgcagaaaatgcagacgaccggtccaagcgccgccgcgaacgatgccgccacggacaccgccgagaccgccgagaccgccgagacaaccgagacaaccgaaaacaacgaaaacaacgaggaaaggagcaacgcatgaaaaccatctggaaactgttcgtcggcgacatccggcgaatcaccagcaacgtcgtctccatcatcatcgtcatcggactcgttgtgatccccggcatcttcacatggttcaacgtggccgccagctgggacccgttcgccaataccggcaatctgaaattcgccgtagccaatgaggacgacggataccggtccgacctcattccagtgaagatcaacatcggcgaccaagtggttaacacgctgcgttccaacgatcagctcgactggaccttcaccaccaaaaaagaagccatcaacggcaccaaatccggcaaatattacgcagctgtggtgattccaaagaacttcagcacccgtatgatgacgttcttcgcatccgatggcgaccacgccgaaatcgcctactacaacaatgaaaagaagaacgccttggctccgaagatcacaggccaaggcgccgatacggtcagcgcgcaggtcaacgagacgttctccgaaacactgaccagcaccgcgctgagtgtggcatcgcagctcgccaaccaactcgacaagccagccgcgcaggaacaactcacgcagttcaacggcaatatcagcgacttcgcggaaacgctcaccgacgcttccggaacgctccgcacgttcagcacgctgacccaaagcgcacggcatctgcttgagtcctccgacggtctgatcgccaatgtcagcggcaatgcgaaaagcgcaggaacaacactcaagcaagccggcagcggcgtggaggatctgacgggcgcgttgaagaccggcaccaccgcgctgggcacggctctgactgattccgccaacagcttcacagccgtggaagcagatgtggacagcctattcggcaatgcgggcgcgcaggccggcaacaccgccaccgcattacgcaaccaggccacgaacatcagcaagcaggcgcaaagctaccagcagatctatgattcgctcgacgcgctcagtgcaaacgaaaagctgccggaagcggtgaggaacgccatcgaccatctcaaaaccaacgtcggcaccaccatcacacagctcaacgacctagcatcggcgctgaatggcagcgccgacaacatcgacgccaaagtaagcgataccacgaccgaacgtgcggagatcaagaaactggcgcagcaggcggcaacgtccgtcagtggcatcaaaaccgactatgagagccaactgaaaccgcaacttgacgatatcgccacgtccattaccagcaccaccaccgcgctcaatgccacagcggccgatctgaaaggcgcgctgggcaatctgaacggcaccaccaagaccgcggataagaatctgaccgccatcagcagcgtgttggattccaccgccgatagtctggccggcgcgggcaaaaaactgggcgcattcacaggaacattgaccgatgcgctgaacagcggcgatatgagcgccgtcaaagatgtgctcagcgataataccgactcgttggccgccgcgcttgcagcccctgtaaaagtgaaacgcaacgcggtgttcccagtcaagaacttcggttcgcagatggcaccgttctacacgatcctgccactgtgggtcggttcgctgctcatggcagtgacgctcaagaccaccgtctcgcgtaaggtgcgcaaggaactcggcgacccgaaaccgcatcaactgtttctcggacattacggtgtgttcggcgtgatcggactattgcagagcacgttctccttgggaggcagtctgctgttcctccatgtccaggcggtgcatccgctgctgttcatgctgtccggctgggtgagcagcctagtgttctcgttcttcacctacacgctcgtggccagcttcggcaacgtcggcaaagccatcggcgtgctgtttctcgtcatgcagatctccggagcgaacggcgcatatccgctggccgtgctgccgaaaatcatcagcggcatcagcccgttcctgcctgcgacgcattcaatcacagcaatgcgcgcggcgatcggcggaatctacagtaacgattactggtttgcgattggcgcgctactgctgttcattccgccgctgctgctgataggtctgctactgcgcattccactggtcaagttcaaccattggtacgtaagcaagctggaaagcacgaaagtgatcgcggcatgatgggcggaaccacgcaagagggcacgcggaagacggtgcaaaaaaccacgcaggaagacgtcggcacagtacgtggccgacgtgagcgattacgggagcaaaccgaccgcaaaatcatgaaagccacattggggatagtgatttccgatggtatcggagcggtgaccatcgaagaggtcgcacgacgttcaggggtagcaaagaccacaatctaccgacgctaccgaaacgccgacgatttattgcaacgcatccaaccggaagttgccggactaccgaatttcaacgatttgaagccgtcgcggaacggactggccaccatgctgcgacgcatccaggactgcttcgacagcgaactcggattgaaagccgtgggcgtggtgctgtcttccgacaacgccacgctgaaggcgatcgcagcacaagtgctggcgccggccgaagaacggttcgtggggttcatggaacgtggcatcgccgacggagtgtttcaaaaccgtttggactacacgttcctgttcagcacggtgctgggttccatgctggcttgcaaagcgttggcggggcaggaagccggaggggaacggcaatccggcaaggaacgcaagtctgattcctgggccgagaacatggccacgttgctctggccgaacgtatgcgccgaatccgcacggtaaccacaggaaaaccgtccgcaccgacgcaagacgggcatgccgtgtcggtttcagaaggaatgggctattggattgacgcttcttgacgcgccacttccaacgccttgttgaaggcttcggaggtccagctggcgccggcgagcttgtctactttgagatccttcaacggcttgccgaccaccgcatccggtacggctttggcgaagtcgttctgatgctttttggagatggacgtgaacggatgcccaacgatttccacggccgtcacgttctggtctttgacggtcagatgcacgtcgatggtatcctcgccgaccggcccgtactggccgttgatcgaatagtcgccatccgcgtagttgccggtgtcctgcttgtcggatgttgcggaattcgcgtcggcacggtttttggtggcgtcgccgtcgtctgccgtgtcgccggacgccttgccgtcagttttcgacttctcttcctgcgattgcacgctttcaccggaattgccggcgtattcgtcgtccatcggcgttgccttcggttcgccgcatgccgacaacagcgcgatactcgccgcggacagtgcgatgactttgattgcgttcgattgtgcggcgctcatgcgcgctccccttccgtgccgtcggcgtccgcgtccgtatctccggtttttgcggccttcgtagggtcggcgaacaaaatcgcgacaccgccgttctgtgcgccttcctcggcggaaccggtgtgcgcaggcttgccaccggccgcctcgtacgcacgtttcgcctcctcgtcattccactgttcgccgacgagcacaccatggttgagcatgatttcgcgttgtgcgcaggaggcgacgagcgcatcgtgcgtcacgacgatgatcgtagtgccctgctcgtgtagctgacggaacaggtcgagcacgatcttctcattcctctcatcgagattgccggtcggctcgtcggcgagaatcagcttcgggcagttgatgagcgctcgggcgatgcacacgcgctgctgctcaccgccggacagctggccgggcaggtgatgcgcacgctccttcaatcccactcgttccagcgcttccatcgcctgcttctcatcgactacagaatggtagtattgcgccaccatcacgttctccaccgccgtcagatgcggcacgaggtaaaacttctggaacacgagtccgatcatgttcttgcgcacatcggcgagctggcgggcgttcagatcctccagccggcggccttcgagcatgacggaacccttcgacggcgtatccatgcagccgatcatgttcatcagcgtggttttgccggaaccggacgagccgacaatcgctagccattgcccttgcggaacggtcagactcaggtcgtcgacggcgtgcagatcgccgtaaatcttggaaatgtggtcgagttccagcagcatatgttcgttgtccatgattattcctccctcaaaacgatggcggggtcgatacgggtggcgcggcggaccggcggaatggaggcgatgacggcgatcgccacgctcagcagcagcgatccggcgccgagcagccagtcgaagccgatcgcgcgaccgaagacggtggcgcacagcacacgcgccagcacatagccgatagcagtgccgagcagaccgccgatcaagccgtagatgccggattccacgtagaattcgacgccgatggcgcgtgaatcggcgccgagggccttgcgcaggccgatttcgttgcgacgctggctcacgatggagctgatggtggtgcccacgccgacaagcgtcagcacgagcacgacgagcgagacaatccagaacagggtctgcagcatggcgatgatgcgggtgtcggacgaggtgattttggtgacggtctgcgctgtgactgcgatgtttggatttttgccggttttgttggttttgttgatgttgctgacgatggcgttcagcccatcccccatggcattcaccgaatactcgaccacgtcggcaccacgcttggaaccggcaagtttagccacgtccgcggtagtggcgtagatgatggaatcctcgttgccgccggtgtcgacgatgccagcgatacggaattcggtgccgttgttatccatgatgtcggacgagacgcggccgttttccgtggcttgcgtggtctgttcgccttgcgtagtttgcgtactctgcgtgccttgcgcggacgattctgccgtttcagttgattcgtccgaatcggattttgcggacgcggaagaagacgctgaagcagacgcgtcggcggcgcggtagccgatggtgatgcggctgccgaccttcacgccgagcgcgtcggcgacgtcgcggccgaccatcacgttgcccgagccgggccaatcgcccgtcacgttccaatggcgattgagcgcgcggacggctttcacgtccacgccggcgatggtgtacggcgcggaattgatgcgcacgctctcataccggtatgcggctgatttcacgctgtgtccggcgccgacgagcgccgtcacgttgcgtacggttgcagtatcgatgccttgcgatttgcccgttgcggacgcgggcgtgacgatcaggttcgcgccgtacgcgcgcatttcctcgttcatctgctgcggcaccgcgacgcacacggatgcaaggcagaacagcgtggccgcgccgacgagcgacgcgatcacggccatcatcgcacgggagcgacggcggaacaccgcgccccacagcatggtgaagaacatcttgcgattcgtcatcgcacaccccctacgaaagccaagcacaactcacctaccatgcagcacctccgccggacgcaagcccagaatcgcccgaatcgacgaaagcgaggccacgagcacagtgaccgccagcaacacgaaaaccaacacgaacaccatcggacgcatggtgatgcccgagccgaacaccacgtgccccacgatctgtgcaacgcccgagccaagcagcgcaccggcaatcgcaccaaccagcgaaatcaccgccgtttcggcgagcataaggcgcgaaaccgcaccgtccgtggcgccgatcgccttcaacagcgccaattccgaaccgcgttcgccaatcgacgcggccatcaggttcgccacggcgatcgcggcggcaaccagcgacagcacggtcatcagcaccatcaccgcctgcgtcttgttcagcacatcgccctgcagcgcggccacctggcgcacctgcttggccaccgcgcccggcagcacctcttcgatctggtacgcgatcgacgacggatacgcggtgcaataccacgtctcccactcgtcctgcgtgagcgcgttcggattcttcgacgccttgcgcgcgaggtcgttgtcgggcgtggtgagcgccttgacttcaatcttgtcgatggaattcggcagattcgcaagcgtttgcgcggcgatggacggcatataaatggcgctgttgtcggaatcgcccgaatcgaagatgccgacgattttcactttcacgcgattgcgttcggtggaggatttgccggttttcccggtacctccgttcgtattgtcgcccgcaccgacggcgatcgtcttgtcgagcgtaacgctgtcaccgacgttcacgcccagtttcgcggcgagcgcgctgccgaccatcgcctgctcgctgtcgtctttcggccaggttccgttgattttccaccatgagcgcatgccgttcatgccggccacggtggactcgccggagtccatgtgcagggttttcgcgaaccacgtgcccacgatcggcacgttggtcgccttgcatttcgccgcggaagcagccgcacctgacgcaccagccgttccagcagagccagccgaaccagcccccgaaccgacacaccccgcatccgcgtggatgttcaattccggcgcgaaattggtgatgttgaacgcccagaagatggtcttgatcttctgcgcgtccgactccttcagaaacgcggtcgggtcggcgctgtccgccgcagccgagccgtcggaagtggaacccccgtccgaaccggacgaactacccgaagccgagccagcagaatcgccggtattgtacaaatcgctcaccacagcatcggacttcggctgcacgacgatattcgaaccgtacgtgctcagctccgcgttgagcttgtcgcccacgtcgaacaccacgccgagcatggccacgctgacggtggcggacaggcacacggtaacggcgatgagcagacggcgtttgaactgccggctgaacgagcgagagatcattttcaggaagaacatggcacccccttacctttctcggcgctcactggaaatggctcgacagcgcgtcgagcgtggacgtttggatgacgattttgcccggcttgacctggtagtcgaacggtatcgggttgcagccgcctttgaagccgatggtggcgaggttgatggccacatcgcacttcttgcagatgattttgccgtccttctcgtaatagccggcgtcgccgcagttatcgcacgcgtcgaggccgacgccgtacgcgccgccgttcttcttgatgatgatgaatcgcatggaggtgccgtccttcgcgcggtattcgaagcggtgcaggtggccgtcggaaatctggctgaatttgatggtggccacgccgtcggcgagcgagtagtcttccggcggcgacagcgtgacgactttctgcgtttgcgcgacgccgtacgtcagggccacggtgacgcagatcatggcgaccaggctgaacgcgccggccgctttcgcgcggcggcggaacgcgatatgcgtgcgtgcgatcgcctcgttggcgccggtcggcttgactttgaagcccatgacgatgctggcgattgccggaatggcgaagacgagcgccattgcgatggtcaggctgcgctgatggttgatgccccacacgagcgcgaggaaggcggcggtcgggaagctgacgatgcgtttggattggaggatctgcgcaaggtcggtgaaatgctgtgcgaacaacagcgcgaccaacagcagcaccgccgtcgtgaacgaccagcggacggcggtggaacgcatcgtgcggaagataagcgcggcgatgattgcgacggccgcgcccaaagcgaagccgagcgcgcgcaacagcatgtcggaagtgaagatgggatcgcccggctcgacgaagatcgtcagtcgcagaatcacgtcgggcagcgcacgaaaggtggtggccgcgatcgcaagcgccgcaacgagattcgcgatgtcgagcagcgcgcggtggttgtgccagtcggcggtgatgcggcgggcgaacaggacgatgacgaacacggccacgtcgaggatcacgcagcaccacagggtcggatagttgacgaacgtgcgttgcgtgatgacggcggtggcgcgcagcgcggcgaatacgactgcgccggcgaatccaacaacgaaaccggccagccgccagtacgcgctcagaggcttgtcacgcccctcaccgacggtgagcatgacgctcaacgccatgacgagcagcgccggcgccaacaccccctgcaacaccgtcacaaactgcagcagcatcccaaaatcctttcatccaaaaacccaactcaaagagcccaacgattcccattccgccccatcccaaagagtcccacccctctcatccctcccctaaaatgcgaggatttcccggaccccctccacaatcgcagaggtgaatccatccccctaaacgcgagagagcggtttcggtatgcattgcccgaccgtaagcttggccgaacggccttgaatgtgtcgggtaatgcataccgaaaccgcgaacgggctacgctaggagatcaccactcctgcggcgtatagttccagtccgggaaggtgacctcgatcggttccgtccagaagcgtcccttcacacccgtctccggatcgacgtgcagcatccagcccttcttctccggggattcgatcttcagcacgagcttgtacgcgccggccttgtcgagcttgacgttggcgccgtagtgcgggccgtcggaggcgttcatctgcatgaaggttccggaggcgacggacgcgttggaggtcttgtcgatgatgtcgtagttgacggtcaggtccggcacgaaatcgcccttgccgtagccgagttcggtgcccttctggttggcatggatgtcggcttcgaggtggaagctcgcatcggcggccttgaggcccatgccggacggttccatgtcgatcggctggaagtagacggcgttgacggtcagcgggccgcattcctggtcggagtgcttctcatcgacctggatctcttcgaaaccggcggaatcgctggaatcgtccttgctggagtcgtcggccttcgaagccgacgcggaggcgctggacttgtccgaagcggcggaatcgttggaattgccgcatgcggacagggagaaggccatggagccggccagcaggatgccgagcagagcggcgatcttcttgttcttcatttctctttcctttgttgttggatgtggaaaaaaatatcggtaaatctcggaaaatttgcgtattacttgcgattgtcaggcgtgcgcaacttgcgtttgcgtgcgaagccgacggcgaacagcgcgagtacggcaatcgccgcgatcgcttgtgccgcaaggcattcgacgtacggatacaggccgatccagtcgtttgtgggcacgctggacagatagtggccgtcgatcaggtcaccttcgatgagcgcgtggatgccaccgccggcgaagatgacgaccagcacggccatcaggatcgacgtaacgaggaagaacgggccaatcggaatctttacggaggtgaagcgcagcacgaggaagatgacgagcagcaccacacccgcggcgatgccgccgatccacatgccttgcgcatcgcgactcatcgagtagatcgattcgtagaagatgacggtttcggcgccttcacggaacacggctaggaagctcagcatggcgagcgaaacgaccatacccaggcccacgccttcgccggcggcgactttgttttgcgcgtcggccacggcggactcggttttggtgcggatgtaacggttccacgcttccacggaacttttgttgagcatccagttgctggtccacagcagcatgagcatggcgatcagcgcgcacacgccttcgctgatttcctggaccgggccggagccgccgaacaggaacgtgaagagcacggcgaccagaccggagccggcaaggcccgcgagcacgccgaggtaaatccacttggtgaaacgctggttgccggatttgacgaggtaggccaccacggcggccaccaccagcagcgcttcgagaccctcgcggatcaggatgaggaacgcctgtccggcggagctggtgatggctttggtgaaggcgttgacgttgccggccgcgccaccgtcgagggtggccgcgtcttcgacgagccagcttttcaggtcgtcgacaagctttttgatctccttgtcggaaccgccgtcgcgcatggttttgcgggtcatcttgaactggtattccacctgcgagacgcggtcgccggagatggcgttcatgacgttcttttcgaagccgagcttttcgtagtactggtagtacgcgtcgttgacgaggctggagccttccgcgcccttgccggagacggcggccttgtatgccttgtcgaggatgacgttcatttcgctggcgacttcgctccacgtgcggtcgcctttgcctttggaggaattctttttggccgcgtcgagcttcttacgttccgcggcggtctgttcggcgcgctgcttcgcgtaggttttggggtcggcgaggttcgcgttgccgtcaagcgtctgcgcggtggcggtgaggtccgcgttcagcgcatcgattttgccggcgatcgcgccgccctggctctgctggtaggcgaggccttccaagtcggtgaactgtgtgagcaacgcctgctgcttgtcggcggaaatggtgtcgttgacggccttcgagaagttggaggcgtcgtagccgatccaatgcgcggtctggaagtcggtgacggcctgactgtagttgccgtcgttgtagtcgttctcggcggtggcgagctgcttggcgatattctgtgccacctcggtccaggaatcgaaattcgtttggctgtcgtcggcggcggacgcctgctgcggcatcgcggtgccgacaaacagcgtggcgagcgcgatcatcagcgcggcgacgagcgtgatgagacggccggaagccgagacgcgcgaaccgcacgaatcgtaggaaccggctgcgtggcgctgcgcgacgcgggatgacatgttccaaaccttccttctcaaaacttttcagtgcgcgatatacgcaccgaaagccaagataaaacgaaaattttttaaagaacagtcttgatttttaatttgtcttgatgtattacgcatggagaatcagcggaattccgccattcctgtttttaccatcttcggcgtgtcatctcacatcgtggcacgctcgcagcatgctcgtcgaactcgacgcgccggaatccgccacctccggcgaagcctgttgtatccgccgccaataagcgagccgcacgcatcaaacgttccgcagccaagcgcccgcattgacgaaacgggcgcataaggtctcaccctcaacaaacgaacgcgctagcatcaggagtatggattcttccgtttcgctcgcgcagcgcatgccgtataccaccgctttccccaaggcgctcggcacggggttgttgatttcgacgcctcacccgatcactgcggaattgcgcggcgagatggaacggttcatcgatgaatacgagcatgcgctttcgcggtttcgcgctgattcgctggttgcgcacatcggcaatgcggagcatggcgggcatttcgattttcccgattgggccggcccgctattcgatttgtacgacgcgctgcacgccgccacgcgcggtgcgatcgacccgtgcgtgggcgaggacctgattcgtctcggttacgatcccgcgctgagtttcaccgttgaagccgacgccggcgagcgcctgggcgcgctgcacggacgggccgtatggggtcgtgatgtggttcgttcgagtggcacgacattggttacacgcagtccggttcatgtggatttcggcgcgtgcggcaagggttatctggtggattcgctgggcggattgatcaccgattcagaactttcgcgcacatcgcatgtcaagtcagccgaaacgaccaacccgacatgccaatcttccacctcagacagcaaacgcgaaagcgctgccccggaatttgtgattgatgcgggcggcgatctgctggcgcgcacgaacaagccgattcgtgtggcgcttgaggatccggatgatccgtcctgcgcggtcggcgtcgcactgatcggcgatggcgcgttctgtgcgagcgcgcccagccgtcgccattgggaggtggcggtgaacgaacagacgcatctggcgattcaccacctgctcaacgccatcgacggcctgcccgtgcaacaaacggaagccgcctgggttgcggtgcgatccgcgtcatttggcgactatccgactgcggtggcggacgggttggctacggcgctgttcgttgcggacccgaatgaactgcgcagcgtttttgttttcgattgcgccacgttggacgccgaccgtcacgccaccatcagcgccggtttccccggccgtttcttctgattgccgaccggtcactgattgccaggttggccggttggcggcccgccaatcgcggaccgcaaaccggccaatcgcaagcaaaactcacggaatgaggttgccggcggccacgtacagttcccaccaatcctgcttgtcgaggtcgatgtccgcgccgtcgagcatttcgcccagccgggtggggttcatcgagccgagcacgatctggatcttcgccggatgcctgagcacccatgcggtggcgatggcgttggcgctcacgccgtacttggcgcccttttcgtccagtgccttgttcagctccgggaagtgctcgttgcctacgaacgggccgtattccgtgccggactggaacgggctccacgcctggatggtcatgtggcgcagtcgcgagtaggacagcaggccgtccgaatggttggccacgaccatgccttcggcgccggagttggtcatcagctcgtcgctgaccatctgcgcgtgcatcaggccgaactgcagctggttcgcctcgagcctcatggccgggtcgtcgccgagccaggactgcagcagttccgcctgccacgggttcacgttgctcacgccgaagtggcgcactttgcccgccttgtgcagggtggtgaacgcttcgacgatttcctcggcctccatcagggtgtcaggcctgtgcaggagcgcgaagtccacgtagtcagtgccgagcgcttccagttcctcgtcgagtcgcgtgatgaggtgcttcgcggagaagtcgtagcgggtggcgtgcacgttgttcgggtcgctgaagtcgatgttgataccgaacttcgtctgcaggaagatgtcctcgcgcttgagcccggcgtccttccacgcgcagccgagcacacgcgagctggcatggtcgtggttgacgttgaatccgtagatgtccgccgtgtcgaagaagttgactccatgctcggcggccgtacgcacgacttctgccgcagcgtccgcatccagcgcgtccatgcgcatcacgccgagcgccgcctgcgatgcgaccactgccgatttgccgatttcgatgcttttcatgactgcccactttctttgtgattttcaaatacgtcaatcgattgacgtcagtcacctcaatggtaaatccgccgtcccgtcagcgcaacacaataaaaatgccgaagccaaaacgcaaaaatccgaaggggtggtccctccggattttttagcgagtcagcacaccaacctcactcggccagcgtgaactggctgttgtagatgtcggcgtagaagccgcccttggcgagcagttcctcgtgcgtgccgcgttccacgatgtcgccgccgttcatcaccaggatcatgtcggcgtcgcggatggtggacaggcggtgcgcgatcacgaagctcgtgcggcccacggtcagcgcgtccatcgccttctggatcagctcctcggtgcgtgtatcgaccgaggaggtggcttcgtcaagaatcaggatcggcgcgtcctccaccatcgcgcgggcgatcgtcagcagctggcgctggccctgggaaagcgacgccttgtcgtcgagcacggtgtcgtagccgttcggcagcgacatgatgtagtggtgcaggccgacggccttgcatgcggccacgatctgctcgtcggtgacgtccttcttcgaatacgcgatgttttcacgcactgttccacggaacacccacgtgtcctgcagcaccatggagaactggtcgtgcacgttccaacgcggtacggacttggtgtcgatgccgtcgatcgaaatcgtgccaccggaaatctcgtagaagcgcatcagcaggttcaccatcgtggtcttgccggcgccggtcgggccgacgatagccaccttctggccggccttcacggacgcggagaagtcgttgatgatggtcttgtccgcgtcgtagccgaagcgcacgtggctgaattccacgtcgccgcgcaccggccgcggcttgccgtccgcgccgacgccgagcagcgcctgcttgccggtttcgtcggacagttccggctcctcaaggaagccgaagacgcgttcggatgcggccgcgcagcgctgcaggttctggaacgcctgcgcgaactgggacagcggctgcgtgaacaggcggatgtacatcatgaacgccacgatcacgccgaattcgatcttgccgtccatggcgagcaccgcgccgaccacgcacaccaccacgtagccgaagttgccgacgaagttcatgatcggcatcatcaggccggacaggaactggcttttccagccggacacgtacaggtctttgttgtacttctcgaactgctcgatggagcgttcctcgccgcagtatgccttgaccacggtgtggccggtgtacatttcctcgacgtggccgttgacgtcgccgagcgccacctgctggcgggtgaagtacttctgcgacaccttcatgatcacgcccatgatgatcaggccgagcagcgcggagccgatggcgcacagcgtcatggtcacgttgttgtagaacatcatgatgagcgcgccgaagaacagcgtgatcgatgtgatcagcgagccgaccgactggccgagcgtctgtccgatcgcgtcgacgtcgttggtgatgcggctcagcacgtcgccgtagctgactttgtcgaaatatttcagcggcaggcgattgattttctggctgatcgcctcacgcagctgctgtgccgtgcgttgcgtgacgttggccatcagccagctttgcaggtagctcagcagcgcgtacccgacgtacagcgcgacgagcagccatgcgatgcgcgacaccgcgtccatatcgatcgaattcatgacgggcttgccgtgcaccatggccggcagacccttcgtgatctcgttggtcatgtccttgagcttgtccgggccgatgatctggcacaccgtgccggcagcgcccagaaccagcgcgagaatcatcaccggaatgtaccggctgcagaatttcacgagcttcttcatcactccgccgaagtccttcggcttttccacggccccacggccgcgtcccattcctcttggcatgtctccccctttcagcgcttcagttcgtcttcgctcaactgcgattcggcgatctgccgatacacttcgcacgtgtcgagcagttcctcgtgcgtgccctggccgaccactttgccgtcgtcgagcacgatgatgcggtcggcattcatgatggtgccgatgcgctgcgcgacgatgagtttcgtggaatccttcgcttccttttcgagcgcgtcacgtacggcacggtcggttttgaagtcgagcgcggagaaggaatcgtcgaagatcaggatttccggatgacggtagacggcgcgtgcgatcgacagacgctgcttctgcccgcccgaaacgttggaaccgccctgcgaaatgccggaatcgtacttcttctgctttttgtcgatgaattccgtcgcctgcgcgacgtcgcatgcgcggcgcacggtgtcgtcgtcgcggtccgtatctccgtacgcgacgttgctggcgatcgttcccttgaacaggaacgactgctgcggcacgtagccgatcttgtcgcgcaacgccttcagcttgtagtcgcgcacgttgacgccgtcgacgagcacctcgccttgcgtggcgtcgtagaaacgcggcacgaggttgatgagggacgatttgccggagccggtcgagccgatgaacgccaccgtctgacccttcttcgccttgaaattgacgccttcgagcatggcgtgacgcgagtcggggtaggcgaagctcacattgcggaattcgatttcgccttcctcgcccggcttgcccgcgtcctgcgtgccgtcggtgaccatcggctcggtgtcgatgacttcgagcacgcgctgcgcggacacgtcggctcgcggccagagcacgaacaccatgctcagcagcaggaagctcatgatgacctggatggagtagctggagaacaccaccatgttggagaaggtggtgagcttgtcgacggcgtcggcagcgtcgatgaggtacgcgccgatccagtagacggcgagcatcaggccgttcatgatggtgttcatcaacggcatcatgatggccatggcgcggttggtgaacagctgggtttcggtgagttccttgttggcttcggtgaacttggcttcctggtagtcctcggcgttgtacgcgcgcaccacgcgcaggccggtgaggttctcgcgcgccacgaggttgatgttgtcggtcaggcgctgcatggccttgaacttcggcatgacgaagtgcatgagcacggcgatgaccaccagcaggatggccacggcgatgccggttgcgagcgtccaatcgaagccctttcctgcgatcttgcacacggcccacacggccatgatcggcgctttgacgatcatcatgaggcccatggtgatgaacatctggatctgcgtgatgtcgttcgtggagcgggtgatgagcgacgcggtggagaaacggttcatttccgccggtccgaagctttccaccttgttgaattcaagcgaacgcaggcgctggctgaacgaggcgcccacgcgcgcggcgatgaagccggtgacgacggcgcaggccgccgagccgagcgagacgagcagcattttgccgccggccacccagatgtcgtgcatttcgctgccgggggtttcgacgagctgcgtgatgtcggccatataatccggcagggtcaggtcaagccagatctgaccgacgatgctgaccagcgcgacgagcatctgaccgatctccgctttggagaggtatcgtacgatgcgaagcatgcttggttccttctcttacgttttgtgttttgcttgttttcttacgattagtttttgcgatttttcgcggtttttgcgattactggattgcgattacttacactgtgaattatttacagcgtaagatactacgcgtcttcctgtgcgtttcctgagaacgcggctttgacctcgtccgccgtggggcgcggtttgccgggcatgcacagcgacatgtacgtggtgaattcctcggtgagctcaacgaattcgcgcgcgcggcgctcccccatctgcgagaagatccagcagatcgcctcgcgcatgctttcgcgctgccgttcggcgcgttccctgccggcttcggtgaggttcacgtgcaccacacggcgatcgtcggggtcggattcgcgtgtgatctggccttttttctccaacgcggacagcagtgtggacacgcgtccggtggtggttttcattgaagaggcgagctgcgatggcgtcagcgggcctttcctatagagttcctgcacggcgaagggttcgcccttcgcgcctttcaccatctcctgctgcatgcgcgagcgtttgtcccatgtgttggtcgccaattcgtggaacagttcctcttcaaagcccacgcggcacctccttccgtcgcaatcgccgtcataatatcttacagtgtaaacattttacagtgtaagttattcccagggcgattttgcagcgagcaagctacagaaggcacgaaaaaggccgcggcccgaatcgcgattattgtgcggaatcgggcgcggccaatcgtacgtattgcgcggaattcagccgcgacgggcgtcgacggaggcgttcagcatcgccagctcatcctgcgtgagcgtcagttcggtggcggcgaaggaatcgttgatctcctgaggattgcgggcgctggggatggtgaacaaccgctcgtagcggctcagttcccaggcgagcaccacgcgctggtaggagcagccgcggttgccggcgaccgtgcggaacgggtcgtacgcgcgctggtcgaacgcgtcgaggaagccaccgagggggctccagcacacgaacgcgagtccaagttccgcgcagtgctccatcgtatgctcagggtcggggtgcgagggcgagaactggttctgcacggcgatcagcttgtcgccaagcatctcacgggcagtgtcgatctgcgcgttgtcaacacgggagatgcccgcgtactgaatcacgccttcgtcaagcaattgcttgagcgcgccgacctgatcctcataagccacttccgggtccgggccatgcgaatacaacaggtcgagcgtatcgacgcccaagtgcagcgcggattccttggcgtcacgaatcatggtttcggggcgcgaatccgccatccacccgtattgactgcccgccgcctgcaaatgctggcgttccccgccaggccgacgactgcagccctcggaatcccgcccctgagtgtccgattctggcgaatcggacacaggagcaacaaaagcgggaacctccatggtgcgtcgatagccggttttcgtggcgaccagcacttcatcgcgagggccgtcccagctggcgagcgcgtcgcgcaccattttttcgccgtagcccaggtcttcggcggtgccggtgccgggttggcttggcaggtaatacgaccaggcggtgtccagatatcgcacgcccgcgtccaagccggcgtggatcgtgcggatcgccgtatcgcggtccgggcggccctcaatcgccaaagccatcgttcccatgccgagccgaggaatcgtaaatcctgccaactcaccgttcatcatcatcttccccttccttgcaagcacgcagccgattcgcacatgttcacatcaagactaacccaacgtgaaccggcgcaagcttgtcgggcgcgtgcgcgaagataaaggcacaaccgaacgggagccggaaggctgagagggagctcgacgagcttcgaccgaggacttgatgcgggtaatgccgccgtaaggagacgggttgttcgcgccgcgaggcgcatctcatttccgttcgcgataaccgaatatcgcgtgattagggtcacggaggggcgcaccacctcatagggtacggttccttcggcgacccttttttcgtaccaaccgtgaatgtccgattcaccggaagcagacgctcggaagcccacaaagcagttctgaacgtccgtttcggcgggaacggcactcgtggggcctgacatacagaagggaaccgaaatgatcatcaacggcaaggaagaggacgtcgccacaccgatcaccgtggccgagctgattgaaagcaagggactgcgcgccgaccgcgtggccgtggagctcaacggcgagatcgtgccgcgcgcccagcgtgcgcagacgcagctcaagggcaccgacacgttggaaatcgtcacgttcgtgcagggcggctgagcacagcagcgaaacaaaccatacgagcggaaacgagaatacgagaacaaccatgacttttgaaccatccgcatcgcaggcgcagatcgacgcccgccagcacgctttcgacaaccagcccgacccggccaccttggtcagccgcgaggagatccgcgcggccctgctcgaccgtcacacggccgccacgcaggacaagctcgacgcggcgcacgtggccatttgcggctgcggcggccttggctccaccatcgcggtggcgctgacccgcatcggcgtcggccatctgcacttgatcgacttcgaccgcgtggatatgacgaacctgaatcgccagcagtatttcctgaaggacctcggccagtacaagacggaggcgctgcgcagcaatctgcgccaaatcaacccgttcacggacatcaccatcgacaccgtcaaggtgaccgacgagaacgtgccgacgctgttcgaaaacgaggacatcatctgcgaggcgttcgacgtgccggaaaacaagacgatgctcgtcaacgcggtgctggagaatctgccgggcaagaagctcgtcagcgcgtccggcatggccggcttccgcagctccaacctggtgagcacgcgtcgcgtttcgaagaacttctacttctgtggcgatggcgagacggctccggtaccgggtgccggcctgatggcgccgcgcgtgggcgtggtcgcctgccacgaagcgaacatgatcacgcgactgatcctcggcgaggaagacgcctgacgcactgctacgttactccactgccgtaatcgaaatttttattgcgattacaaacgcacgttgcacacaacacaacagcgacgcaacggcaacacaacagcagcacagcaatcgcaacaacagcaacaccaaacaccccaacgaaaggaaccgacgatgagcaccgaaaacaccatcaccaccgcagccgccgacgtcgcggccgcaccgaacgccacgcttgacgagctggtcggcaccaccacgaacacggcgatcctgccagagccggacgcgcacgcgtacgacgagatcgccacaggagacgccgatccgttgattctcggcgggcacaagttcacgagccgtttcatcctcggttccggtcgttacgacctgaacctcatcaaggcgaccatcgagaacgcgggcacgcagatcgtcaccatggcgctgcgccgctgccgcaccaccgaaaacaacctgctcgactacattccgaagggcatcaccatgctgccgaacacgtcgggcgcgcgcaacgcggaggaggcggtgcgcatcgcacgtctcgcgcgcgaggtgtgccagacggacttcgtgaaggtggagatcgagcacgagtcgaagtacctgctgcctgacaacgaggagaccatcaaggccacggaaaagctggcgaaggaaggtttcgtggtcatgccgtacatgttcccggacccgatcgcagcgaagcgtcttgaggacgcgggcgcagcttgcgtgatgccgctcggcgcgatgatcggctcgaacaagggcctgcgcgcacgtgacttcatcgaggtgatcatcaagaacgccaacattccggtgatcatcgacgcgggcatcggccggccgagccaggccgcggaggccatggagatgggtgcggatgcggtgatggcatacacggcgatcgcatccgccggcaacattccgctgatggcgcgcgccttcaagaacgcgattgaggccggccgtgaagcgtacctgtccggcctgggcaaggtgacggaagaccacgccgtcccgtccagcccgacgaacgaggccgactacatcggctgattcgcgccgatttcgtacgattcgtgcactaacgtttcgcactgttttattgcgattacacgacgagggtcggtggaaacgcacattttcgcaaggtttccaccgaccctctttcgtcggatgcgcgacacgtagcgcaacacgcgcatgccacgcataccgcagcgacaggcaatacgtctacttccctagagccgccttcaggtcgcggttctggaatcgctcgtgcagcaggcagcagccgccgaacacgacgagccacagcaggccggcgatggcggaaccgcgcgtatctgcggacaggaacagcgtgacgtacacgaacacgtagaacgcaatcgcaatccagtcgcacacctgccatgccggcatgacgaagccgtccggcaggaagtcggcgctttgacggtagcggcggtgcgcaagcatcgtcagcacgtagatgaagatcacgacggcgctggctgcggaggcgaacagcacgaacgcgctggagatgcccgggatcgcgttgatcagcggggagaacagaatcatacagccggacacgataatcgccttcgccggcaccttgtgatccgacacctcaccgaggcgctgcatagcgggcgattcggagtcctgcgcaagctggtataggtggcggcccgccgagtagatcagcgaattgagtgccgacgcggctgcggtgatcaccacgaagaacacgagcgcggcggcccagtcgagcccagcgtatttgaacaccatgatgaacggggagccgaacgagccgtccgcgttctgatggaagttgcgccacggcacgatggccatgatggccacgagcgcgcccacgtagaagatgaggatgcgcatgatcagctcgttgacggctttcggcagcactttgcgcgggttctgggtttcggacacggtgacacccacgaattcgatgagctggtatgcgaagaacaccatttggaaactcagcaggaagttcatccagccgttcggcgcgagttggaatccgtcggtgatgtttttcaggcttacggtggcgccggagaccgtgccatccacgccttcgatatgcgtggccgggtagtggaagccgaggaacagcatcaccacggcggtgacaatcagacccacaatcagcgtgattttgatcatggagaaccagaattccgcctcgccgaacactctcacggctatgaggttcacacaggtgagcgccacgaggaagcacagttcgataagccatttccatgatttgaggtctatgccgaacgtaccgaagaacgtgacgaaatacgtgctgacggctgtgatttcggtcatgccggtcaggatgagcacgatccagtacgtccagccggcgaatttgccccacgcgcggccgaggtagcgggtgatgaagttgatgaaggtgtgctggcttgggtcgctgtacatcatttcgccgatggcgcgcatgagcaggaacatgatgaggcccacgccgatgtacacgaggatgatgctcggtccggtcagcgcgatcgacttgccggagccgaggaacaggccggtgccgatggtgccgccgatggcgatgaactggacgtggcggtttttcaggccgcgttccatgtcgttgtctttgtcgaggctttcgatggatttgatttgcgcggtttccgtcgcttcggacgtgcttgtaccagtttttccggttttcgtattcccaaaagtcataatgttcacaccctaccgcgtcaaccgcacaatctctgccgttgttcgtaccgcgaaatgcgctatatgtggcagattcgcatcttttccaaaaaaacgctttgcgacgggtggagtcagcttgccaaggttttcagcctgccacggagcgattcgttttcgcgttccagctcgttgatacgccgagcctgttgtttgatgatgacaagcgccgtctcgctgtcaaggccgccgctcgcgctgagaggtgcaggcggcacggcgatggcagccgcatcggacgggacgggcacgtcagcggatatacaccccccccgacacgttcgccccgtccagcgaattcggagcattttcaatatttgccttatcgggattggcgattcctgcgatgccgtcgagtttctccttgcgcgtcaccgcatgaacatacaggttgacgagctccgtaatgatttcgccgttactcatgttactgctaccgttcacggatttgaggacggcagccttccaacgcgccacacttcgttctatacgtttatacccaatcagttccggcggcaatcccgcctcgcggaagattttggtcggcgattcccccgcaagataccgtatgacacacacctgtttgaaagcgttggagtacgtgatgcggtctttcgacacgttagccaccgccggcagatcccgcaacatttggagctcttccatgctgaatgatcctccaccgcgcatcgttttaccccctttgctataccccgtgatgaagcaagtgtatatccgacttctcacaagcagcttttcaaatattgctgaccgtatatcacttcaaccggtcggtcacacatcaatgcgggcgattatggaatacccacaaccgcccgcattgacttttattgtgagtgagtcaattcacaactcactcacaccgaacgcatgcgctcagtacgtgcggcgacgactcttgaccgccacagccacgccagcgccacccaccagcagcgccacgacggtgaacaacacggttcccgcggcaccggtcagcggcagctgagtgacattcttcacgttcagcacggtagcggtggcattcgcagtggtgttatcgaccggttggacctgacgaagggcatccggctcgaaggtgatgagaccttcatctgtgatctccacattgaaagtgaccctgaagttctgggcgtaatcggtcggagcctgagtctccacaaccgtgtaggttcctgccgcaagacccgcgaccttcaccaaaccatcattctcagtagtgaacgtcttggcatcattctgatcggaaacaaacgaccacgcaccgtcctcagcctgcttaaggaacttgccctccgcattcttgacaacgaacttggcgccggctagaggcttggcctcattcccttccttgccaatcttcgtgaactggaaaccgtaggtcttaaggacagtcttgccttcaccgctggtaccatccttggtggtgattgtggccttgttgtccacactgccgctcaagccatccaacgcatccttggtgacggtgccctggtacgacacgacgatcgtcctaccggccagcgttgtggcatcggcaaaatagatggtcgtggtggtgccggattgagcattgccttcctgcgttatcgtgtacagatcgggattcacagtagtatgatctctgaactggaccttgaagtcactcgtttccgcaatccgcaaacctttggacgcgatatcggtaatggtaaaggggtacgcatcccagccagccgcagcatgaggaacctccgcggccacagtgaagtccacggtgtcgcccacctttacgctctgaccgttcacatccacgtcattcatccgggcgaacttgagcggctcgtcggtcggattcgcgttcttcgcgttgaactggccttcagtcgtgatgttgccctgaccggtcgtcgcatcggcagcaatcctcagattggacagtccattgacggtggtggccaccacagccggagttcccgacgtcgcagtcgtttcgccagccttggtgaacgtatccttcaccagataccagccttctccgtccacattgaccgcctggctcgtatttgcctgctccttggttacggtcaggccagtaccatcaggtcctgccggcggagtaattccagccaaggtcttggcgaagacacggagctgatccgcagtgaacgtcgccacataggcggctggattatccttgtactctgtcgggatgccgttgtgacttccatcagccgcgtcagcagcggtggtcacagctcccttccatgcgtcaaccgttttcacttcgaccgagccattgccaggattctcgaacgtggcaaacttgtatggcgtgtacgtatggtcttcctgtgcgtggttaacttgcagcaatggagcatcatcagcctgtgcggcggcgacgccgatggccatgccgctcagcaacgttgccgcggcggccagccctgcgaaaagcttcctcatcttcatgagaatctccttttcctaattgttggttactgtgttctgcaatcgcgggaggcgggaacccaacgcgcccccgcgatccgcaaatcctgtgttattcagctgagccgcttcttacgtctccactggtcggccgcagcgacggcgagcaatgccagcacgccaactccgccggccgcaatctgccaccatcgttccgcacccatgcggcccgtcaatggcagtgacgatgccgaaatgtattggttggtgaacagcattggctgggtctcgtcccaattcgaaccagcggcaccataatcggttttcagctggatcacggattcgacaacggccttccattcaccggacgttccgtctttcatcacggacacgaccacccggtattccgcctgcgagtaatacattgcggaagcattaccagcgttctccgtcacaagatatgtgtactcggcttcacctgcgtcatacgtgatgtcgccgaagtaagcaacgtgatcgtcagacgaatcgcgtttcaccgtcaccgtgcacgccgactggttcttgcaggaagctggcatcggcgcgtctggattggaatcgtctgccttcagcttgaaagtgaactcgtcggaatccttccaatcgcgccccttcagctccttctgcacgccaatcgcatgcgtcagcatggtctgcttcaacgtgttggtgatgactactgtggcgttctgcgatgccgtggattccggcaccgtcaccacattgccgtcagcaagatttccatcgccgaccttgtgctggtaggaagccttccacaagtggctgtccggttcgacttccgtcaccgtgtacgtcttttgggcgcctgccggaataatcacgtcggtggaccatttgccgctatcgtcacgcttcagcgtgaccgtcttataggtatcgttgccctgtttgatatccaccgtgatgctttccggcttctggccgttaccgctccactgcttgtcgacgtgcagtgtggaatgcaccacctggattaccgggtgcggatacgggttctccctgcactcatgagtcttgccatcggccgtataggtcaagcatgcggaatcgttcgtatggaaacccggctggttcgaggacgtggcgtttcccggcagatcggtgttcgcgttaccctttacgccgtcatatccatccttgccggcattcaggttggcggcatactcgtcatatgccttctgcgtgggcttcacgttgtattccagcgtgtatgtcacgttgtgggccagaggcttcaggaatgcgaccgtgaatttcttcgtgctcgcgtcatacgtcaaggtgtaatcgacattcttagtcaaggagaccaccttgccggaagcatccttggcaacgaccttgtagttgctatccgcaagctcgacatagccggagagcgtgtcctccatggtcaccttggtgtatgcggatgtggtggtctcgctcttctcaatctcgtcgaagatggcattcagctccgaagcgttcgtcgcgcttttataatagccggctttgatattcccttcaccgcgctggttgtatttcgttgcctttgggaaattgctggacaccgcatgcatgaactggttctcgttgctggagagcgaggacgggttggcactggcgaagatgccgatggaatacaccgtggcgccaccatctttcaatcccttggcagcttcgacggccttatttgccactttaccctcgaagccattagacgatgtaggcgaaccatccgcgaagaagataacgaccttcttcgcatcggttcgagcactagcactgcccatcaccttgaccgcacgattgaatccattgtcggcgcgggtggcgccagcggctttgagtttgctgactttgttcttcagaccgttcatatccgcagtcagattgctaacgatttgggagtagttgtaggtgtacccaccacttcggtacatgtcatccccgattttgtccgttttatcgccggcgaacttcaccagtccaacgtgaaccagttcggaaccggcctccgtattagtattcgcagcttcatcaagaaatgctttaaccgcttctttcagtgcgtctaaccgcctggtccgatccgtcttactcatcggatcgtccatcgaaccggacacatccagcaccagcgtgaagtcgatcggctgggtggtggtgaccgtggtgctgttgacggcgcccttcacatccacgttcacggtgtaactgccattatcgttcttcttgatgcgcttatgcttctccggagcgcccaactgagaaccagtctcgttctgcgcaaccgactgcgcccgatttgctcgcgcaatcggttgagcggacaacgtaactggctgctcatcaggttgttcagattgttgttcagattgttgttcaacctcctgctcaacccactgctcagtctcttctttcgtttcttgttccgtttcttgttcgacttgctggtaagcctcttgatctgacggctgctcttgctctgacggctgctcttctcccaccatcaaattttgttccaccggctgtgaatcctcttgcccagattcttgcaataccggctgctcgatttgttgttccaaggctcccgtggcatcttccgccgccgctgacgaagcagtgacgcaccccacgccggcgagcattgcgaccgtcgcgacggccgcaatgacacgacgcgtgaacagacctgtgcccctcgccctgtttcgctcaaagacgtgtctcatacgcctacccccttgcaccgttaagcgatcggggaaataccttcctccttcgaccggtatatttgatgcgtcttcgcttcacataccgtccgacaatcgcttcgttgcctaaaccttaaggagaaaaacagagggatacataccctcccaacgaggtaatcaaggggatatactttccttgaaatcgcacatatcatcgcgattctagagtattcttgcccccgtaaatcgcgatgcaaaaactataagcaaacgttgtcatgtctctttcagaattttccccgacaaaaaagcatctgtcaagtgcaacattaacgccatcaacccctagttgcgctttggccaccaagcggcatgcctacggacatgccacggacagcggagcagccaaaccaacaacaaaccgaccagcaacgtggcagctgacaccacgcccgcaatcacacgcacatcttttgccgcatcatcctccgcgggaatctcttcgggaatggcggaacgcagcgcagaaaccaacagacggtgcgtattcacgccatacggggtgcatgtcatcaacgtcacacggtcctcgccgggcacgatcttcaacttcgacgtgtcatccgggttgatttcggtgatgcgatccaccatatagccaagcgtatggcccatcacatcgatatagaagtaatcaccaacccgtatctcatccaaacgcgtaaacattgaggcttcaaccaaaccccgatgtccggtaatcaccgcatgcgtatccttgccacccaccggcagactactgccatacaaatgccccgcaccggacgcaagcgtctgctccgacgtgccatggtaaatcggcaaatccacagaaatctttggaatgcggatggaacccatcacgccatcgccagtatccagcaaacgctggtattccgcgtctttggagctagcggaatccttgttaccatcgccagtggcgcctgcgcccgtcgagctggaaccggaaccgtcgctggagtcggactgattgttgttgtacaactcggcgagcggatcctcagcctcgccaatcaccggctgccccgattcggcgagacgcttgttgtacgccccagctgcggcgaatgcctcgtcggcctgcggatacggccagcccgcgacgctctgttcggaacgggcggacgtgctcgccagcttttgcgcggactggtattgcagcactttcgggaaaagaccaatgccgattgcggagaaaatcagcaccgccgcaagcacacgcagggcaatggatctacccacgtcggtacgacgctcgcgaatctcttcggacacatcggtcgcctcggcgaacgtcggcggaacgtaggtgcgtgtgttgcgcgtggtgtcgtgcgaaccgcgcgagccgtcgttgccatcgtgcgaatcgccataaaaatcgtcggcgcgtaagtccttaatttgctgcggaccgtcgcttctcgacccgccgcgcgcgctcccatgcggaaaaactgccatcagtcttacccccttgaactgccagccatagggaacattatattgcactccgcccgcgtgcctcacatcatctgctgcgcttataaggcagcgagtcgggacacgttttatgcaaatcgtgggttagacccatcaaaaccctttgcaggaagccaaaattagcattttcgccaagagcatctctaaccgagtctgcccatggtcaaactgatgggcctatctggcttatagatggcgggtgttggacgggaatagacagttcgggggcatgttttgtacccctgaactggcaaataaggcgcaccatccgccatctataagctagatagcataagtcaggcctcagcggaggcaggattgggcccgacttccttgtccagcttgttgcgcaacctcaccacatcgcgctcgagctcgtcgatacgacgagcctgctgcctgataataatgccggccgtatcaccgtcgaacagtccgagagacaacggatgaacgtcattcgacgcagccgttgcggcaggcttcggctcagtggccgtattggcgatgtcttcaagactccgcctcgtcgccaacgcacgcttataccgcgccgcaagctgcgctatgatctcaccatcggtcatggtgtcgctgccgctcaccgacttgatggccgcatccttccaccgcgccacactgcgctcgatacgcttgtaaccaaccaattccggcggcagacccgcttcgcggaagatcttggtgggcgactcccccgcaagatatcggatagtgcacacctgtctgaatgtgtcggaataggtgatacgatcacgagtcacattggaaacagccggcaatccacgcaacagctgaatctcctcgtcactgaatgctcccccactgcgcatcgcaatacctcccattgatgcttcgttgctttcttttgcggatgtgtctgcgattctatggccctccttccgtgcaatacccccacttcactcccctgactaacagcccccataacggttcacgtttccagattccgtttgttgcaacacatcccaccgaaacgccttataccctcgaaaaacgcaatgtccacccacatcgggtggcacgtccaaagcaacgcaatatggcgcaatccaagcaatcccacatgaaatacagagcaatacaaaaaggccgacccataatgggtcgaccttaaatcactccgaattggtgttcttaacgaacaccgtcagagatgggcgatcaggcctcggcgttctgacgagacttgatggcgatggtcacgccagcgccagccacgagcagagccacaacggtgaacagcatggttcccgcagcgccggtgagcggcagctgggtgatggacttgatgttcttcacggtcttttcagacgtgttgaccaggccccacggatcggaagtggtggtcttagccagaacagctgaaccgttctcctcgttgaaagacacagtgaagctcggcatgatgtcgagataggcatcgctggcacgcttagtttccgtgacggtgtaggtcttggtcttatcaagaccggtgaaggacaactggccgttagtaccagtcgtgacatcagtagttgcgccctgagtgttagcagaagcagccttcttgtaggaaccgtccccctgcttcacgaaatacagcggaacgccatccttatccttcacctggaaggtgacgccttcaatgcctttgccatcaggatccaccttggtgaaattgaaaccagtgaacttggtagaggcttcaacgttagtgccgtagttgtcaagcttgttgacaacgccatcctcggcatcggcatcatcattaatcaccgcatggaaggtgaccttgatggtcttgcctgcatacttggacggattattcaccgtgacatcgaaagatgcgtcgtcgccaccgatcacatccgcagtcggaacagtgaagtcagatgcagcagtttcagcagaaatctgcgcaccatccacatagaaattgaaagtaccagccttgatggtcagacccttgcccggcttatcggtgaacttgaactcggtcggagccgggttcgcgatagtaccggtaagggtataggtcagaatgtcgccgatggcagcaaaaagcttattgacttccttagtctttccggggttgttggtgttcttcatgttcacggtggcagcggcagtcggatcggttagaaccttcttctcagcgttaacggtgccggaagcgacaatcatcgggattgccttggtcacagaaccagtggcagacgcggaatcaatgaacacatagatacctgcaggcagggtcgcggtagcagtgtatttagcatccgcactaccattcgtagcaggaactggcttgcccagagtgaacgacgtcacagcagttagtttgccttcactctccagagcattagcaaacttacgggtcttctcaggagaagcccacggacgagcagcagaaacatccagagtgccggcattcagggctgcggccagatggtccacctcagaatccgtagtatccacaccggcagccttcaacgcggagtcaacggcagtcttattgttagaattcgtcaccacaccataagcaacgttctcgccggaaccatactgaacataatcgccaatcttgtatgctttcagtttggcgttggtcaactgttcagcggtttcagcagtgaacgtgaacgtcgcgtccctcgtcaccgttgtaggagtgtcatcagcctgtgcgctggctgcgcccaatgccatgccaccgagcagcgtcgcagcggcggcgataccggcgaaaagtttcctcatcttcatgagaatcctctcttccttattgtttgattacttgtttttgcaatcgcgggaggcgggaacccaacttgctcccgcgatccgcaaattttgatttgccggccggaatgccctcaagttggtaggcattccggcctcacacagcaactcagacgagtcgcttcttgttattccaaatttcggcagcgccgataagcagcaccgcgagtccgccgatcacgccaccgaccagcagccactggcgtcccgtcgcaccacccgtcaacggcagcgccgacaccgcgacatatcggttggtgaaggtgacaggttcagtagcagcactttgcgattcgggaaccgctgcaccgttgtcatccagcaccttggtcacggacttcacggaagccttccactctccgttggagtccttcgcgacagtcacgacaacctcatacttcgcctgcgaataatgcaatgaagcgatagagcccttgacctccgtcacgtaatacgtgtaagaggcatcgccagcgttgtaagtgatgttgccgaaggacgcggtatggctgcccgaatcggagttcaccttcaccgtgcaaggttgatcggcttcgcacttatccggcaacggcgcattgcccttcgccgccagagtgaaatcgaacgtgtcggaggtcttccactcgcgtccggccaggtccttcttcaccgaaatcgcgttctccagggcaaccgtcttcaacgtgttagtgatggtcgcgttcaacgtgcccgcatcggcattggaagaccacaccatctgcttggtcaagtcgacattgtttcccgtataggagacgtcatatcggtcattaccagagatttccgccacggaatacgtgtatccaggaaccaggttgtcgacagtcgtctgccaaccattgcccttattcagggggattacgccaccgacgttctccagctgagcattggaatcgccgctcttcttacgctgcaactgcaccgtaacggaaccgtcatcatgcttgctcgcaccatccgaccattgcttgacgatcttgatcttgccgagcttcacctgcaccacaggatgcggatactcgacttcagtcggtgcgcatgacgtagttccattaacctcggtaagcacgcaatagttcaatcgcgcgtccacattggaatagaatcccggctggcccgcagatgcggtgccagtattcggctctcccacattcgggtattgctggttgccggcataagtggcataggcggcatcgcttggcttgaccttgaaggatacgtcgatgctgtcggctttctcagtaacgataccgtctgtgccgttaaacgtcaccgtcaccgtgcgattgccagattgatcgacaccgtacgtggccgtatatccgcccgtcagcgccttattgccgtttttcaccgtcacatactgtgtgatatcggcaccgtcggccacgccagcgaaatcgaccgggtcgacccactgggacaaggtgtcagtgatggaggagaccttgatcttcgcggatgaggtgatgctggaatagatctggccgaatgcttgcgtcagattctcagcattcgtgccatcgaattccttaccgttcactgccttggcttcacgggcgaaatcggacattctattggcgtcagtcgaagccttcaccacataaagcgaaacattactctcccgcctgttggcctcggccagagcggcagcatagttgtaaccgtagtaattatcactaccctcggtacctgcaccatgcacaccctgaggtgtagtacgccaatcatcatcaggattgcacctttttttgctgcacccaatcggataattggatatacggaacgtcggattgccatcggacaagaaaatgatgtgcttcttcacgcccgtgcgtccttgcagatcattcgcctgcttaagcgcagcctcccagttggttccaccatcaggtttgctggacacagctgttttaatcttgctgacagatgtggtgaagctctgcttagtcgaggccttgtcgctgaatgtcacaaccgccatttggacttgttgagattccgataatttggaattcgcctcggtcagtaatttctcagcaagcttatttgccgcgttcttcgcgttagtatcacgattgtcgtttttatcctgcatactgccggacttatccataaccagcacaatgtcggctggcgtgacggtagtggtttcggaagaagcgctatcacccgaagcattcaaatgcaactcgtactggtcgccatcaccatcgaccttttcgatggtcttattgttttgtggcttcacattggaattgataacagtcacatggctggtatcgctcaccttgaaagaatgggtttccgcataggaaccaccatttccatcgttgtgctgcgacaacgcctcaccattcgcggaaacagtgtatttgccggaattcagctcacgcaccgaataggttgtgtcatcagagaaatcattggattgcacacgagcaaattggcctttggccaaagtgatcacaccgttcgaaccggtgttcaaaccagagctgacaacctgattggtggacgcatcgtaaacgctgtatttgccttcatatggcgtttgcgagccattggcgaacagctggaattggaactgttgatcggctggaatagtgcccaatgtctgcttttcaatgtcaatggccttggacggcttcaccggcaaattgaagctgatcttgcagttggatccgccgtcgccgcgttccagatagaagaagctcaaatgatgggttttatatgcagcggaatcccagttcttgcccgcattactgaatgcctggttaattgtcgtcgcgcgatccgaaccataactttgatttcgatcatacgtgatattcccagtagcaaaatcaatcgttccgcgtatcgcctgatggataccacccaaatcaagcaccagcacatcatcgatgaacacccacacatcgtcgtcaccggtgaaatcaaacaccatgttctgattgttgactttgccatctttaggcatatagaaatcggccccaaggttcatgccgaacgaatacctatcggcgtcgctgtcattgccaaacggcgtgaataacgggttacgatccccgctctgggtctgcttggtcaattcgaatcgattgctattgccgttatatttcgcatatttcgacgccgcatcgaaactgtaattcccttgaccatccgaagtcagcaaaccaccgtccggcatgtaattagtcacagccttatcagacgcaccgccgaagagataatccagcgatccgttgccatccgccatggtcggataatcgttagtcagcagaggcttcacaatgcccgcgtacgcacctctgccatcttgaacatagcggttataaccggtttcgtttcctccgctcataaaatgcaacgcatgattattgttgatggagttgcgatcgtaatcatgcagaccaatgctgataccattctgctgctcaacagtggcattgacgtcatcggccagcgcggcagaagtggtggcgtagcccatgccaccaagcatggcgaccgcggctaccgcagctacgattcgcttggcaaagttcccctttggctttgcctcagattcatgtacatgcctcatatgcattgtccccttaataccgcgcttcaacgcggtttccgtctctaacaccgtccgcgcatcgcgcaccggcacatgccatgtccagtacggatacacttccagcgctccaacctcgaacataggagaaaagacgtcgggagatgcacaccctaagtgcgggaaagtcgaggtaccataccaccgtcaaccgttgcaatcgcaacgtttcacaatatgggtgatacccgaataaaaaagccggcagggggcatcggcaaacagcggtcgttagccacgcttcggccaccaagccgcatgcctacggatatgccacggtcgcccgcgcaaccatgccagcagcagaccgagcagcaacgtgaccaccgcggccgtggtcgcaatcgttcgcgcatccttcgccgcatcatgctccgccggcaccacgtcgggaatcggcgagcgcaccgcagaaaccaacagtcgatgcgtattaacgccgtacggcgtgcacgtcatcaacgtcacccggtcttcgccgggaacgattttcagcttcgacgtatcgctcggctcgattacggaaatgcggtccacctggtagccgagcgtgcggcccatcacttcgatgtagaagtagtcgccgacgcgcatttcatccaatcgggtgaacatcatcgcgtccacaagtccgcgatgcccggtgattacggcatgagtgtccttgccgcccaccggcagactactgccatacaaatgccccgcaccggacgcgagtgccgactgcgacgtgccatggtagatcggcagtttcacagaaattttcggaatgcggatagtgcccatcacaccgctgccggaatccaacaggctttgatattccgtatctttggcgctggcgctgtctgattcgttggaaccggattcgctggaccgcgaactgccctgcacctgggagaacgggtctttcgcttcgccgagaatcggctgccccgatgtggcaagccgttcgttgtattccttggccgctgcgattgcgtcgtccgcttgcggatacggccagcccgcaaccgcacgtgcggattggtccgacgtgttcgacagttcgtgtgccgaccggtattgcagcatcgtcgggaatccgccgatacagattgcgatgacgatcagcagtgccgcggagacacgcatggcgacggttttcctacgacggccacgccgtctgcgcatgtcgtcggaaacgtcgattatctcgttgaaagacggttctgcgccttccgtacgttccatgtttttcatacgtttcgcacgcatcactggatgaacttccgcagcacgcgttccagctcgtcgatacgcaacgcctgcttggctatcagcatgtcgcatttgttgatggtcagctgtgcctgtgcaagtttcgacagcatatcctgcgatgcgcgcgattcctgcaacttgtccgagccttgcgattgcacgccgttgcttcccgacgcgccaacgtttctcgtcgcgacgtcgcttcccgacgtccctgccgcgccagcgccataaagatccaccacggactgatccacatcgtctccgcgcagttcgatggcttccagctcgtcatcacaatcctgcatgtaatggttcgtatgttcgttcctgcgcttgttccgctcctcctgctgcttccagcgcgcgatgcaccgttccacgcgcttgtagccgatcagcttggggtcgagacccgcctcccgaaagatggccgacggcgattcgcccgcgttgtaccggcacatgacctcgaccttaaagcgatcggtataccggatatgggatgggctcacgcttttgaccgctggcaggctggccagatacgcacgctcctttgctgtgaatttgccatcaatcattttttacaccccctaaatcgcctaaacagctcgattcagcatcatatcgggctctttccattaacaccctcgttaaaaccctcgaacgaaagacccatccccttcaacgaaaagagggggccaaccttcaaacaaaacagtcccgccattttccacggataataaaagctcatagacccccccccccataaaattaacaaaaacttaacctcacccccagcgcgtcatgggggtcaccgcgtatccgagcaccgtcacgcagactcactaggctggaaacatgacgcaagagctcgtttcattaaccatcatcatggcggtggcggccgtcagcccaatcgtggcgcagctgatcccgggcaagttcattccgcaaaccgtgctgctgctcgccgccggaaccgcgctcggcccgtacggactaggcgtgatcgaagtaaacgacgccgtgaaactcttgaacgagctcggcatggcgttcctgttcctgctcgccggctacgaaatcgaccccaaacgactcgccggacatcaaggcaaagtcggactgcttacatggggaatcacgctaggcctcgcctggctggtcgtgacattccttccgttcttcaccaagcaaggcatcaacggcatcgccacggtaatcgcacttaccaccaccgctctcggcacgctcatgccgattctcaaggaacgcagcctcgaaggcacccccatcggcgacgccatcatctcgtacggaacgtggggcgaactcggcccaatcctcgccatggccatcctgctatccacccgaaccggctggcagaccatgctcgtgctcggcgcgttcctcgccatctgcctactgtgcgcgatgctacctacgaaagcactgaaaaccggccatcgcctgtaccgtttccttacggaaaacgcgaacacgtcatcgcaaacgctcatgcgactgaccacattcctgctcatcttccttgtcaccatttccgcactgttcgaacttgacgcggtgctcggcgcgttcgccgcaggcttcatcctgcgttacatcatccccgacggcagcaagtcgctggaaatgaaactggaaggcgtcggctacggcttccttattcctgtgttcttcgtggtgtcaggcgccgcgatcaacgtgcgcgccgtggcaggccggcccgcactgctcgtcgcgttcatcgtcatgctcatgctgattcgcgcggtgcccgtatatgttgcgttgtcgctcgacaaacgcgagaatccgctgtcatcgcatcatcgcgtcaccgtagccctgtattgcacgaccgcgctgccgatcatcgtcgccgtcacgtcgctggcggtgaaggtcggcaccatgcaaagcgacaccgcgtcgacactggtcgcagccggcgcgattacagtgttcctaatgccgctgctcggctcgattacatatcaggtggccgacgtgcatccggtcaccgcggttcgggagattgcgcacacgccatccgattggcggacgatcgtacgcgaacatgcacaggtgcgtgcgctgctgcaccatcaggaccggctcaagcgtatggcggagatgttggaatcgctggaaaagcaggaggggctgaacggtttggacagccgtcgcgccgaacttgtggaacgtgcgcgcctcgaaatcgaccgccaactcaaggaactcggcctggacccgcagctcaccacccaactcccccacaactaccgctacccgaagaactgagagggcttcggaggggcgctactccacggacttgagggagctgatggggtcgatgcggtcgaggacggggttgacgaacagctgcacgagcagcgcgaaggccatggtcgccacggccgcgatcacgtagctcagcggcttgacctccacctcgaaatacaacgagggcatgttgagcgccatcgtcagcatgccgccgacgagccggccgagcggcaggcccagtatcacacccatgacggtgaggatcatcatctcgcggttcacgtaatggtgcacttcgcggtcgaagaagccaagcaccttgagcgtggccatctcgcgcacgcgttccgacacgttcgtattggcgagcgtgaacagcaccaccagtgccagaccgccggcaagcgccacgatcagcgccaccaccgcgcccatgaggtcgaatttgaagctgtcggccatgtgcgcgcagcttacggccttcatcaccgaattgtcctcttcgagcgattccgcatagtcggtttgcgaagtgtcggagccggaaagcttggcgagcatggcgttccacgtcagagcctcggaatcctcggaactcttggaattcttggtgttcttcgcgtctttcgagtcgaaaagcttggcgtagtaggtttcgcttacatacacatccgagccgatgaggttgcgattcaccgcgctcaccttcgccgtcgcctgcacgccgtcgccgttggtcagtcgcaccttggaaccggccttgacgcccagcgcgcttgccgccgactgcgcgacgatcacgccatcgtcatcgagtttcagcgaaccggttttgccgacgccggacgtgcccagtatgccggacgagaccggctgcaacgtgaccatttcgcccaaatcggacagatgcttttccggcaccgcgaccagctggatgctttcgctgccgctgctgccggccttgccgctgtcaccgtcgccactgcccgcaaccgtcaaatcgcccgactctatgcgcacgtcaagcgatgacgtgacgcgcccgtctgacgcgactttcgtgcgcatcgccgacgcgtccgaatcgtcggaaaccaccatcaggtcgtactggtagatgtcgcggtattgcttgatgccgaggtcggcgacggtgtcgttgatggccaggccgcagacgatcagcgcggtgcagccggcgacgccgccgaccgtcatgatgaggcgcgacttgaagcggaaaatgttgcgcgcggtcactttgctgaggaagcccatgcgattccagaccggccgaatccgttccagcagaatgcgcgagccggcgcgcggcgctttcggacgcagcagcgaggcgggcgtctgcctcatttcctgcacgcacgcgtagatggtggcggcgagcacgccgaccacgaacagcgcgatgccgagcgagccgtacagccagtcgtattccagccgcagaccgggcatcacatacatgccttgcaatacgaccagcaggaacgcaggaatgccaaggaagccggcgatcaggccgaggccgccgccgatgaggcaggcgagcaacgcgaacagcaggtagcgcgacgcgaccgccagccgcccgtagccgagccccacgtacgtgccgatgagcgagcggtcctcttcgaccatgcgcgccatggcggtcaggctcatcattacggccaccagcaggaacacaatcgggaacgcgttgccgagcgactggatggagtcgaggtcggatttgagcgcgctgaacccgccgagcgactgccggtcctgcacataccagcgcacttgcggaatgctggttttcagctcgttttccttggttttcagcgtttgttcggtacttgccttctgctcgttcaattgcgattgcgcctggtcgagctgctgcttggcttgcgtcagttcgggactagcggcgatgatggtttcacgcattgtttcacgcgtggtttcgtcaagttggggggtagttgcacctgcggccgccgccgcacctgcgttcgcgccgtttgtcgcagctcccgcagccgccgcgcccgcctgcatgctgacaatctggtcgacctgctggttgaattgctgccgattcgcgtcgatttgcgactgcgcgtccgcgaacttcttgtcggcttccgcacgcgcgtcggcgatcttcttgttgcccgcgtcgagcagttcctgccgacgggccttctggcggtcggttttcacggtgccgtcgatgcggtcggtcacctgcttgacagtgttttcgtacgattcgtcgaacgtgctttcggcggccgcacccttgacgagcagcgtggcggacgtgtagagggtgccggtcacgccatcggacggcgcgaagaacgtgtagtcggtggtggcggtggaacggaacgaggtcatggcggagtagccgtccgggttgctcaggttctgcggatcgagcaccacgcccacgatggtgagcttggtcgggaagctcggcgcctcgtccgtgccgttcgtttcattcgtgccgtccgcaccgttcgtatcgttcgtatcgttcgtatcggaagtatcggaggaagccgattcgggggttacggtgaggcggctgccgatacgcttgcccgaatcgcgaataaatttcctggttaccgcgatttcgccggctttcttcggcatgcgcccttcctgcaagtatggctggtcaatgccgttcgtgccgatttcctgcatggtcgccgacttgcggccgtccaaatcgaacgtcacttcctgcgaccgttccgcctgcactttcgcaacaccgttcaccttgcgcaacgcggcgatatcgccgttcgacaggcccgcggtggacagcacctggacgtcgtgcaggccctgcgcgtcgaaaaagcggtcggtgctgcggaacgcgtcacggcagcccgcgtaaatgccggtgagcacggccacaccgagcaacgtgatcatggcgatggaaatgaatcttttccacgaatgcgcccacattcgcagcatgtccttgacgaatgccatgtcgacctccgttcgtagcccctcattccattgaacaccatgaagcttggaaagacgcgccaaaccgcacatccgcaacacgtgtccaaatcgcgcgttcgaatcgcacagcaatcgcgcgaatcgaacttctaaaccaaacaacccgttaagcaaaccagacattccggaacgaacaaaccaacactttgcccgccgcttcccgctacaatcgggaacgttccctcacaaagggcgaatcgcaaaaaagcaagcaaaacaagcacatgcaagcgtgcaacagcacgcaacgcaagcagcgagcgcaacgcacaacgcgcaatcgcaaggaaacagagaagaggaaatctccatgagcgacgtcaccgccgcaaagaagccgcgtggaaccgacgatgtaccggttccgccgacgctccgtaaatcgttgaaaaaccgccatatccagctcatcgcgctaggtggcgccatcggcaccggcctgttctacggctccagcgaatccatccagctggccggcccgtccattctgctcgcctacctcgtcggcggtctcgcgatcttcatgatcgtgcgcgctctgagcgaaatggcggtcgaggatccgaaggctggcgcgttcagctactacgcgacgcgctactggtcacggcgagcgggcttcatttccggctggaactactggttcaactacgtgctggtggccatggtggagcttgccgtggtcggctcgttcgtgaactactggttcccgaacattccgaagtgggtgtcggcggcggtgttcctcgtggccatcgcggcgctgaatctcatgggcgtgaacaagttcggcgaattcgaattctggttcgccatcatcaagatcgtggccgtgctggccatgattctcggcggcctgtatgtcgtgatcgccaacgtgccgaccgcgtcgggcattcgcgcgagcttcgccaactggttcaccgtggacggcggattcttgccgcacggcctgatgacccgcaacgccgacggcacgtggaccggcctgctgatggcgctcgtcgtggtgatgttcagcttcggcggcaccgaactcatcggcatcaccgccggcgaaaccgagaatccgcgcaccaccattccgaaggccacgaacggcatcatctggcgtattctcgtcttctacatctgcgcgctcggcgtaatcatggcggtgattccgtggagcaagatcgacggcgattccagcccgttcgtgcagatcttcgattccgtcggcgtgcacgcggccgccggcatccttaatttcgtgtgcctgaccgctgtgatgagcgtctacaattccggcctgtacgccaactcccgcatgctgtattcgctggcaaagcagggcaacgcgccggcttacctgggtaagctcagcaagaaaggcgtgccggtcgggggtgttatcacttccgcgataattattgcgattgccgttgtcgtcgtgttcgtatggccggaattcgcgttcaattacctgatgtcgatcgccacgatcgcggctgcgatcaactggatcatgattatgatcacggagatcaagttccgtcgcatggttgcggctggcgatggcccggccgaacttaaggggctgaagggcaaggaagcgctcgacaagatcgcgttcaagctgccgttcgccaatgtgacgccgtacgtggtgatcgcgttcatgctgctggtcgtagtgctcatgtgcttctccgcaagctaccgcatcgccgtgatcgccggcgtcatctggctggcggtgctgttcgccgcgtaccagctcacgcaggtcggccgcaagcaggcggacgcgtccgccgcggacgccgaatgaccgcgcttccttacgcacttccttacacgattccttaaaggaacggcaaaaggaacgacaagccccacgcgggaagcgtccataagcaacataaaacggccttcccgtccgtatggaaatcaccggatcaatcgatccgcggtgacaacatacggacgggaaggccgttttttacgccggctgatggaggctcagccctgcttcttggccgccggtgcgatggacagactcgggtcgcgcagcggaatcatcatggactgcgtcgcgtggtacaggtcggacttgcccggccacacggtgccgatcggctggttggtgcggtcgagctggtggaaccaggatccgttgacgtgatccatcaccgtgctgtccgcgtactcgaggaacgtcgcataccacttggcgtacgattccttgccggtcacgcgggcgagcgtggaggacgtgttgatgccctcggccagcgtccaatgcatacggtcgtgcacgacgggcttgccgtcccagtcggtggtgtatacgaggccgggcgcaccgtccgcgttccacgcatcctcgaccgcacggttgaacagatgctccgcggcgtcgatgtacggggccgcggccgccggatcggacggataggtgctggtggcccactgggtgatcaggcgggcccattcgatgccgtggcccggagtcgcgccgtacggcttgaactggtcgtccggcttctcgcggttgcattcgaggtcgagcgaccagtcggaatggaagtgttcggggatgcgccagttgttggccttcgcccagccgagcacgtgctcgatgatgcggcccgcgcgcttgcgccaggtctcgtcgccggtcacgtcggccacggcgaggaacgcctcgacggaatgcatgttggcgttgaggccgcggtacgggtcgagttcggtgaattcggtgttccacgtgtcgacggacaggccggtctcgtcgtcccagaacttgtcgaggaagaccttttcggcatggtcgagcagttcggcggcaccggggcgaccgagcagggtcgcggacgatgaggccagcagcacgaaagcgtgtgcatagcactgcttggtgggcgtgtagccgccttcgggggtgatttccggataccagccatcgttgacgtcgtcatgcagcgcgcccttgagacccttcagaccggcgtcgaccagctcctcggcacccgggaaaccgacgaatgcgcccaggcagtacacgtgggtcatgcggcaggtgatccaagtggcgcgattgcggtccttccatggggtgccgtcgtcgcccagccagtaggagctgccgtcgggagccgggaacttcgtgccgaagttcagcagattgtcgcgggccgcgtcgaggaacgccttgttttccgccgttcccagctgatattttttgtctttgacagccatgtcaaatcctttcctgatttcctgcgatcgcgcacttggttttcacgcaacgcacgttccggcgcgccgatgagcgacgcgccgcatgtgcatgcgccccttgcgttcgcaccttgttcggttatgcgctcgggaaacttcgtcatattccctcgccgctgtgccctactgtagtgattaagcgcttaagctgcaagtgggacacgccatccgcgccgtcaagtccttcatccgcgcctccggcatcgacgacgattgccgtctcaaccggcgcggatggccgcgggaatccgggaatcagtacagcggcggaagggtattggccatacggatgaaaggatgcttggtgaaacggcggaaatcagccgcataacgcgacccctccaccggagtgccgtatgcgccggttccagcggcgcccggatcgttgcgccacggcatgtaccacagcacccgacgcgtatcgctgttggcgagcgcggcggtgagcaggtagcgcgtccacggcgaatcggattcggacggcgcagctgtctgggctgttccggagccgacagcattcgattcgccatgggcagcgcaaccatcatccgcggcactggcacaagcgccggcgccggccagcgcggcttcgtcttccgcgctcatcacgtaccgcgacgcgaattcgccaggcgagcccacttcggtggcggcggcgatcttgccgcgttcacgggcgagccgcccgaccaccgtcagcatgatgatcagatcgtcgtgccgttcacgcggccgctctgcctcgacgtcggcgggcgcgatgtcccagtagtcgtcgaatccgagtacgtccacatagtcatcgcccgggtaggcgtagagatacccggcctcgcatgtgctttccgagctcatgtcgatacggctacggtcgggcgagtaggcgtagagcacgttgtgtaggccgcacgagtcgcgcaggtagtccacggtcatgcgccacagggcgacgaattgttccggcgtggtgtcggtgggttgcgcgggtgacccggtgcaccaccagaaccagtcgccggtgtgctcgtggaacgggcggaatacgatcggcacggattcgccgctgacgccgtccaccaccgagtccaggaacgaggccacgcggtccagccattcgaggaactgcccgtgccgtgcgccgccgggcagcacagccgccacggaaccgggcgccatattgtgcccgtacccgccgaaggtgatcggattggcggaatgccagctcatggtcgtcaccgcgcccatggtgtaggcgcgcagcagttcgtcgcggacgtcgcccatggagaagccgtcgatattggtggtttcgtcgcgttccacgccgctcaggtcgctgccccacagcgcggggtaggtgccggtgaccgcgtgtacgtcggaatcggtgttcggaccgatcacgttgctggtttcgttctggtggccgaacatggcgaatttgccgcttgcctggtgcaaggatcggaacaacgtacgggtcagcgtgttcaggtgcgggtcgaccggctgcggatcgacggaccgcaagttttccccgcccatcgtttccccgctcatcacagcgcctcgaattcaaggatcacggtctgcataggacgcagcggcgtgaccttcagcgtcatcgcatccagctgggccagactggtctcatcgccggaaatgccgaaatcacggccccaatattcgacttgcggcatctcgttttccggcgtcttcagcacgacgcagacgccatcgcggcgcagcacgacatgtggtccctgatcaaacatcattgtctccttgggctgtttcaagcggttaccacggcaaaggactcgacctcgccatgagcgcaattgacttttacggaaaaccagtatatattaagcgcttaagtggagcaaatggcggcaagccatcacaggcaccgcagcaacgaggcatcgcagcgacgcagggaggcggaagcaggcatggaatcgtccacaccatacaaaggcggcgaaatcgacagccggcaggccgaagccatcgacacactctcctcggccaacgaataccaaggccaatcacgcatccaaacactgcggaaactgccatggaaccgcaaatggaagtacttccgcgaccagttgctggcacgcaccgtggttatcgcggccatcgtctgcgtggtcgtatacatcgccgtgcagatcctcgcacccgcaccagggccgaaactgtacgtggcggtgttcgacgatgccgtcggccagcagggggcagcaagcctgcagtcgcaggtcgcgaaacggctggacctgccggaaggccgcaagggcggagtgctcgtcgacacctatttttccaacgacgagaacgacatcagcaagctgcagaccatgatcgccaatcatgagatagacgcgatcgtggccacgccgaagaccttcaagcagctgtccggctacggctatctgaccaatctcgattcgtcgctgaccaagcggcagcgcacgttgctttccggcgatttcgtcacgatgaagggcttcaaggattccgacgatcccgatttcgaaggcggcggcaaaggcaaggccgagccgttcggtctttcgatgaccgacttccggcagtggaaccggctgaaatcagccaagtccaacgcactcatcggcatcgtgcgggaatcgccgaatcccacaaccgcgcaacggctcatcgactatctcagcgcatagcggttccggcaaccgcctgcacagcaccacaaaaaccacccacggaggagaccatggccagcattttcagtcaggacaatccattcaacgacttcatgagcaccgtcggcgatatggcgatgatcagcatcgcctggaccatctgctccattcccgttgtgacggtcggcgcttcgaccgcggcggcctgcgaagtggcgcgcgaactgcaaagcggctcctgcaagggcatcttccgcagcttctgggcggctttcaagcgccgcttcccgaccacgcttgccctgacggcggtaatcgccgcgttctgcggattggcgctgttcgacctgtggtacctgtcgagacaatccaccgacaccgtagccgtcctttatggcgtaaccatcgtggtcatcgcggtcgtcggctcggcgctggctttcgtgctgcctttgaccggccgcagcaagctgagcgtcggcgagcagctcacgcaatccgcccggctcgccctgggcaagccacatatcgccttcgccgcgcttctgctgaacatctggccgatcatcgtggtgctgatcgcgccggagcagacgctgatgctggtgccgctgctgtggatattcgtcggcgccggagccagcttctgggtgcagatgaatctaatccgcaagaccttctcgctcgactagattccgtccgaatcccgcgaatccgcccaaaatccttcacgcaacgcgaaaacacacgaaaacgccgcacggccatatggccatgcggcgttttcgcttcatggttccacgccatcgcgcgatcaacgcgcaatcaccacgcgttcatcgcccagcgggagcgggaccagtggattcgcgcgcacgccgctcgtacggctcctccatgatatggccgaccttctcaccgtcgatgagcctgagcatcagccgtgcggccgtcttgccggtgtccaccacgttgcggcccatggccgtcagattcggataggccgcggtgcacatgaaggaatcgtcccaagacatgagcgacaattcgtcaggcacggcgatgcctttcacgttggccacgccaagaccggccaacgccatcacgtcattgtcgtagatgatggcggtcggacgctctccgaaacccagcaggcgattggtggcctcacgtccggattcaggcgtgtagtcggtatgcaggcagcggtaccgtatgcccaattcggcggccacgtcggagaacgcggcgtcacggatatacgagtgggccaacgcctcaggaccgcccacacgcgcgatatgccgatggccgaggtcatacagatactgcaccgcctgacgcacagcgtcggcgtcggcgctggacaggctcggcaggttgccggccacggaagcgtcggaaatcgcaaggaccggcacatccgggttcttctcaagcagggagacgcacgggtcgccaagctccacgttgaccagcagcagtccatcgacgttgccggtggcgatccaatccttgatgatcgccagtttggcgtcctcgccgacggccatacggaccagaatggaataatcatgcttttccagctcggcacccaagccggagatcagctccatcatgaaagattcgacggacagcagctcgggatcgtaatccagcaccaagccgatgcgctgcgtcttcgccttggccagcgcctgggccgcgccgttcggcttccagcccaattcatgggccacctgcagcaccttggcacgggttccctcggagactccgggtttgccgttgagggcatacgagacggcgctgctggaaacgcctgacgccttggcgacatcgaaaatcgtcaccttgtttttttgaactggcatacccacatcttctctttgctgaaatcgaacttaaacggttcacctacatcatacagcaaaggcgccaccgacccccgcaggaagccagtgcttacggcactttgcttcgtagggtcggcggcgccttcacttaatttttcacttaagcggaactgtcatgctgaaatgttcagcggaatgccctcctcatccatcgttccggagggcattccccggacagcggccaagacgtcaccactcgcgtttgagatcgttggcactgcgcagcacgttggccgctgcgaacgcggccggatcggagaccgcgtcggtggcgatgtgcagcgtgacgctctcgccggccagcagggagaccatgccttcggtgacggacgccttggcatcgaccttgtcgaccatgcagaacaggtcgcgcacgtagcttctggcggtaaccgtaagctccacgccgccttcaacggccttggcggaggtttcgaacgcgtcggcgggagcggcgagcttctggtcgatgatctcggccgggttgaagaccacgcgggcgaaggcgttgtcggacggggtggccacgaccagctcattgccggcgtccccataggagacgatgtcctcgttgagcggcagtccgatatgggaaaccgcgcctagctcgacgtcatcgaagctttgggaagcgagcacctcgccggacaggttcacgcgctcgaccttccaggagcccttccacgccttgcgggtgtcgttgagcacgatcagctcgaagtggtcgttggcggtcttcacgccttcccagctgtgggtctcacggtattcctcggagacgcgcggctggatggtggccaggtgcggcgcgaagaagtcgcgggacgcataccagaccggcttgcggtgtccgttgaaatcgaccgcggcccaggagacgaccggccagtcgtcgttcagctgccaaatcagcgcgccggcgttcaccggctcgagggagcgcatgtgctccacgccgaagcgcatggcctgcgcctgctgcagctggcatgcccagtgccagtcctcgatatcggcccagttgtcggtggggatcagccagctgtgctcgccgtcggacggcttgccgttgaccacgccgccgaaactcacgtcgtcgaggtggccgggggtgatgtgcgagcgcatgccgcgcgccagtttgtagttgccgccagaggccttctgatgcaccagcatctgcttgccgaacggttccagcttgccgtcgtgcacggcaccggtgagggtgctccatgccggcggagcctggtagccgaattcgtcggcgaagcgcggggtgtactgcgcgtacacggtgtagtcggcgcggttccaagcatcccagatgtgcatggtgccgtcggtgtcgaggttggcgcccgtgaacttggtgaagctcatcggggagctcggcaggtaggcggagcggctcggatcgagttcggccaacagggacgggaacagttcggaatagtagtagtcgccccacggcttctcgccgtatccgtatgcgttcggcttgcggtcgtcgtcgcgcagggcctgcttgtaaccgccccactcggagtaggccacgtagttctcgttggagccgttccacacgatgaggctggcatgttcggacaggcgggtgatgtgctcgcgggcctcggcctcgacttcggccttggtttcggcgtcctccggataggcggcgcaggccagcatgaagtcctgccacaccatgatgccgtactcgtcgcacaggtcgtagaactcgtcggactcgtagatgccgccgccccaggcgcgcaccatattggagttggattccacaagatcgcggatgccgcgctcgtagtcgcgctgggagacacgggagatgaaggcgtcgtcgggaatccagttgtagccgtgcgcgtgcaccggcacgtcgttgacgtagatctggaacggacggccgatgttgtcggcacgggtgtccacatgcacggtacggaagccgacatggccgttccagaacgcttccttggcatcaccggcggtgacgtcgacatcgtacaacggttggtcgccgtagccgacgggccaccacagcttcgcttccggcacggcgatcgtcagcacggcctcgttgcggccttcggccacgacgccatcgacggacagattcgtgccgaagccggagatttcggcgtgcaccggcacggcctgacggaccggatgggaatcgtacggggacatgacgcgtcctttgccggcgcgttcgatttcgacgtgcacgttgagcagtccggtgccgtcggcggtgacgtcgaccagcggacggacggatgcgatgcgtacgccggaccaggagtcgatgccgatctcacgccagatgccggcgttggccacgtcgatgccccaatcccagccgaaggaatagctcggcttgcggatctggttgaaggcgtggtgttcggtgtgcggatagtagccacgggcctgttccatgtggtcggattcacgcacgggggatgtgaaggtgacggtcagttcgttggcgccgtctctgagcagaccgcgcacatcccaacggtaggaacggtggaagttgcgggtggaggcgaccgggcggccgttcaatgcgatgtcggcgatggtgtcgaggccgtaggccaccaggtcgtgacggtcggagccgtcatcctgccaatcgaaacggcaggtgaatcgccaatcgacatcgccgatccactgctgcttgttctcgttgtcgccgtcgaacgggtcgtcgatcagaccggcgttgagcaggtcaagcgtggcctctcccggcacagtggccggaatgcccgcggcgagcgtcgcgcgcagtgcctcaggagcggcttccgggttgacggcggtcaacgtccagccctcgttcagaggagcaaacgtgctggggatgtgagacatggtgaatccttctaacaaatattctggaaagaaaagggccgcaccgcgatatgaatcttggcgcggcccttggttgtggaaaaaggaagttggaggttacgttttttattccttcacggagccggctgcgatgccgctgtagatctgcttctggaagatcaggaacaggatcagcatcggcagcagcgtgatgatcacgccggcgcagatcaggttgtacttgctgcccatcgggccggtgaaggagtacagcgcgatggcgatggtcttcagattcgcgtcctgcaggtaaaggttggcggcgtagtactcgttgtacacaccgacgcccttcaggatggcgcaggtcacgatcgccggcttcagcagcggcagcaggatcttgtagtagacggtgaagtaggaggcgccgtccatgatggcggcctcatccagggaggtcgagatgttctcgaagaactggatgaacacgtagatggagatcacgtcggtgccgcacatcatcacaatgtagccccacatcgtgttgacggcgtggaagttgaccatcatcttgtacagcgcgacttgcatggcgatgcccggaagcagtgccgcaagggcgaacatgccacggatcaggccgttgccggggaactggaagcggctcagcacgtaggccagcatggtgccgatgatcgtggtgaccaccaggaccaccaccaccacgatgatggagttgcggaaggcgaccgccatgttcgacgcgacgaacgcctgcacgtagttgtcgaagttgaaccagttcttcggcatgtccatgacggacgtgctctggtattccttgtccgtcttggctgcggtcacgaagcagctgaccagcggcagcagcatcatgaaagcgacgaagatcagagagaaatacttgaggaatacggccaccccgatcttgaacttgtaccagaagcccgcggtcttggctgcggaacgttccttagcgagtgcgactgcgtcagtcatcatgccaccgccttttccttgttgctcggtccgttcttgaagaccgaagcgttcttcctggccatgcgggcgcgctggcgctcgatcttggccgcctgcttccttgccttctccacgccgtcatcggcatccttgaacacgtacttgaagaacaggttctgcaacagcgcgcagatgaggatgatgatcagcaggacgattgccatggcggatgccaagccgaccttctggctggtgtgggcgagacggtccatgcgcacgaagtaggtggcggtgccgttggcgccggaggtgatgacgtacgggccttcgaaggcggacagcgagccggtgatcgaaaggatgacgttcagcaccaggatggtcttgatgcccggcaggatgatgtgcttgaactgctgccacttgttggcgccgtcgatttcggccgcctcgtacagcgtcgaatcgatcgacatcatggcgccgatgaacaggatcacgttctggccgagataacgccagacagaggcgcccaccagagaccagttgttaacgctttggtctttcagccagtatggcaggttgtcgagttggaatccgcaccattggagcacggtgtcgaacacgtatccgcgggtgtagaagaacttgaagatgaagccgaccgcgatgccgttgatcagatacgggaagaagtagatggccttgaacgcgctgccgccacggaccttgaacgccagcatggtggacagatacagcgccagcgccacctggatcagcgcgccgaccatgtagtagaggctcagcttcagggaggaaagcgtgtcgggacgggtgaagacgtcgatgtagttctggaggccgacgaattggcgcgggccgatgtacttcatcttgtagaacgagtagccgatcatggatccgaatggccagtaagtgaagattacgagcagtgcgaccggaatcgcggaaaaggcgacgatgacgcccgccttacgccaatctcggggctgcttgttgaatggaatctcggccttctcggtcggttccactgctgctgcagtcatgatatccccctctttgggttgcttctctgcctaacgaaaaattgcgatggaagaggacttcggcttggttccgccgagaacgagccgaagtcctcagtgatggatgcgcgacttcacgccgtcacgcctggcgttccggaatcacttggtgtcgacgccttcggaatcaagggcgtcgttccacttctggttccactccttgacgaggtcgttgtaggactcgtctttattggccgcgtgctcgacgatgctctggacacgggagtcgccgccggtgttgatgttgagttcggaatcggagttgaggtcgttgaacagatcctcctcgccgtcaggagccggttcgtcggcgatgagcttgacgttcttgaagtcggagtagaggtccggcagcttgtcgtcgtcggccgcgatcgagacgccgccttcgttgtaggcgtagttggacttctcggtcagccacttgacgaagatcatggccgcttcctggttggtggtggaggagttcttgttgatgccgtacgcgtagtcagaagcggaggtggcgtactgcttgcccttgacggagatcgggaacggcatgtagccgacgtccttggcgttgtcgcctgcggactggatctgggagaccgcccaggagccgagcaccatggtggcgatgtcgccgctgttcagcttgttcttggaagtttcccaatcggtggtggagtaatcgtcctcggtcaggccatcggccacggcgtcatacaggatcttgtagacgttgtaggcgtgggtgccgtcacccggatccttgaacgggttcttggtgtgggtgaagacgttgttcatgtagttgggatcgccggtggccgtgccgccgatgtacgcgtcccaggcgcccatggtccaaccagccgcgtagttggtgtacagcggagtggccttggtcttctccttgatggccttcaggtcggagatgaattccttcggggtggtcggcagcttgtcgatgccggcctccttgaagatcctcttgttgtagacgatgccggaggcgttgccgaccgaagccacgccgtagaccttcttctggtaggactggttgacagcgtacttgatctccttgttcatgtctccgagggagccgtaggagatgaagtagttctgcagttcggccctgtcgaccgccggaatcatcatgatgtcgccccagtcaccgccctgcagacgggtcatggcgctgttggcatagtcgctgttggcttcgacggtgaccttgatgttcggataggtcttgttgaattcggcgatgtactgcttccaggtcgttcccggatagtcgttcttgagcatatcggtacgatggctgaacagcttcagattggccttgatgtccttgccggtctgaccaagcttgatgtccttgtactgtatgtcggtgaccttggaggagccactgccgctgccaccgcaggccgccatgctcaccgcgcagacagccgcgatgccggctgcgacgatcttcttgagattcatcttccgatccttccttgtgaatccttgtccatcacttccggagtctcggcaccgatgctccattggtgatgcctttttcatctcaggcctctctgcctgcctttgatgaactggtagttataccataaatgaaccccttaagtttgtcaagcgcttaagttgcgctccgcgccctcgccgcacagccgcagtgccgtcgcaaccctatggtcaacccgcttcaaatacagaaaacaccaatcgtttcaatacatcgaagcggtttgatgtccatcccccacaacccgcgaccgttcacgttaagagggttaatgtaaatttttttaccggagtgtcgttaagcgcttaagtatacgtatgcaaaatcctgcagcagcgaaaaacggcggaatcgcaacgaaaacggcgtgccacgccatgaatggacgcggcacgccgttcatggaacaacgcgcgacggcgatcgccggacgctcagcccttgcgggaagccaggaaatcgcggtaccacatgaagctgtccttcgggatgcgctcctgcgtggcgtagtcgacgtatgtgatgccgaatcgcttggcatagccgaaataccattcgaaattgtcaagcagcgaccacacgaaatagccggtcagcggcacgccttcgtcaatggcgcgcttcgccgcggcgaaatgacgcttgagatagtcgatgcggtccggatcatgcaccgatttcgtgccgtcctcgttcaccgtcagctggtccttgcaggccatgccgttctcggtgaccaccagatcgacctccggatagttgtcgtgcacgcgcaccagcaggtcatgcaggccgtccggatcgatgttccagcccatgtcggtgtgcgggccctcggtgggcagccagtccacgtcggacgctccaggggcggtggacgcctcggtgctttgcgggaactgcggacggtcggacatggccacccggttggtggaatagtagttgatgcccaacacgtcgatcggctggtggatgagctcgaggtctccggactggatgaagtcccagtcgcagatgcccttggtgatggagaacagttcgtccgggtaacggccgcgcagcatcgggtcgaggaaagcgcggttggagatcaggtcgaggcgatggcaggcgtcggcgtcgccacggttgaactgcagattcaacgtgaccgaacacttggccttgtcccccacttcggcgcggacggcctgcgtcatcagaccatgcgccagattcaggtggtggaccgccgggaaggcgccgggaccgaggcccaggcccggcgcgtgctccttggctccgtagctcaggtaggacgaacaccacggctcgttcagcgtggtccaggtgtcgacgcggtcgccgaggcgcttggccacgatacccgcgtagtcggcgagcgcataggcggttctgcggttcagccagccgccctcgtcgccgaggtattgcggcaaatcccagtggtacagcgtcacgaccggcttgatgccggcctccagcagggcgtccacgacgccttcgtagaagtcgaggcctttttcgttgggcacgccatcaggcgtcgatatgatgcggggcacggcgatcgagaagcggtaggcgtccacgccgaggtccttgagcagcgcgaggtcctcgcgccaacgatggtaggaatcggtggccacatcgccggtgtcgccggcgatggtggctcccggcgtatggctgaaggtgtcccagatggaggggcaacggccatcctcggtcaccgcgccttcgatctgataggccgctgtggccgtgccgaatgtgaaatcttgtggaaaagttagcgtcattgcgtgtcctttactgaagcggttaagatattgatgaggttaaccgatgtcatagattgtttgcaaacgacacgccccgttccgcggagcgggagacaccatcgattcgttccaaggaagggccatgaacaccaccacccaagcatcgcgattcattccaatcaccaatccggaccttcggttcatggggcgcatcgaccgcacccccgccgaccatcagacctgggcgttcccctacacgcaggtatcgttccgttgcaccggcaccagcatcggcgtgcgcctcgtcaaccattgggggtacggcgacgcgtatctcggcgccatcatcgacggcatgcaggtcaaggcgcgcgtgcccatcgacggcgcgcatgacggcatcagcatggaaaacggctatccaagccgcatggaaccgaccggacagcaggacgacggaccgcgccatccggtcgacgtggcaatcgccgccgatctgccgaacatcgaacatgaagtgacgatctttaaacggcaggacgagggcaacaatcgttttgacgtgtatggcattctgctggacgagggagcgaagctcatgccgacggcgacgccgctgccggagcgccgcatcgaagtgtacggcgattccgtaacgtgcggcgagcgctgcgaagcggcctgctacgtgggacaggccgatccggaggtggatctgagcccgtacagcaacgcttggtattcgtacgccgccatcaccgcacgcaatctcggcgcgcaggcgcacttggtctcgcagggcggcacgaccctgctggacggcatcggctggttccacgcgccggactacatcggcatggaaagcatctgggacaaatccgtctacaacacgcagctgggcggcacgtccccttgggatttcgcgcaatacacgccgcatgtcgtcgtggtcgcgctgggtcagaacgatgcgcatccccgcgatttcatggcggacgactatgacggcgaggaagccacgcattggcgggcccggtacgtcgatttcgtgcacgcgctgcgcggaaaatatccgcatgcgctgatcgtgctcgccaccaccgtgctcatccacgacccgtcctgggatcgcgcgatcgacgaggtgtgccatacggtcaacgacgaaggcgacgaccgcgtacgcactttcctgtactcgcgcaacgcggcggccacacccggccatccgcgcgtggcggaacagcaggcaatggccgacgagctgaccgcgtatctggagtccttcggccccgatctgtggaagtgacctcgaggcggccctcatagcggcctcggaacgactccaacaaccacaacaaccccatagcgaaaccggccgcccctcgaatcgaagggacggccggttttccatatcgtcactcggttatcatcacctggtggcgtcacgccacggcatcactcaccgtcgtcattcgacgccgtgtgatccgtcagattaagccggaacggctgggcgggcaatccatcgctgttgaacagcggagccggcccccagctgcgccatgcgtaccgcatcgacatcggttccggcacatccggacatgccagcgtgatcgtgccgatgctgcggctgttgacgggaatgccgaattcggtggcgttgtaatcgaccacgttcaccttggaattgacgaggtcgtcgatatcgcaatccacgaaaatcgccgcggtggccggatggaacacgccgtccgcgcccgcaagctcgaaaccggagctctccggcgaacgcaccagcgaaggcggctccgcatcggagccctgattcctgctgccgggcgtggtgccgtcgaaatgcaggccgtgcgcgtaacggaagaacagccgtacgcggccgttcggatcgcaacggaagcccaacaccgtcggcccgtacacgggaatgcgggacatgccgtaaacctgcttcaacgcgcaatcggcgagccgttcgcccggagtgcgcttgtcgacgggatggatgttgtcgtactcgccacaatcgatggtgcagatgacgtacacgttgtcgatggactgcgccgcgtcccattgggcctcgcgcagcaccggccacagcatcggatcgccttcggtctcgtccaccttcttgtcgatccattgcggaagctgcacgatgaggaacggcaggttctcgctccagatggcgcgccactcgccgatcagcatgcccagcagctcacggtaggacccacaatacggttcgtcctcctcgccttggtaccacaggaaaccagccagcgagtatggcgcgatgcgttccagcatggcgcggaacggtccggtcggacggtactgcgacgtcggcgtgaccggcggcggccacgggcatgcgccgtactgttcgttcagcgtatcccacgtcacgtcgggatcggcttccttggcggccgcgatattcgcgttccaagcatcgaatctcgtctgccattcgtcggtttccagcttgaactgctcctgcgtcttgccggcgatcgcacgctcgtaccgggtgagatagccacgtcctgcctcgctggaattcaacgcgtcctcgctcatccagcacgtgatcgacgtgccgccgatatagcagttcacgatgccgatcggcagatcggggtcgagttcggagcgcagcttgtgcgcgaaataataggcgacggcgctcatcacaccgctgttttccggcgatgattcctgccagctcgccgcgttctccgcattgcggttgatgacgccggttttcggcacgttgtagaaacgcagcagcggatcggcgcaattctcaagggccgcttcggcgttctcgctgttgcgcagctcaagttccatattgctttggccgccggcaagccacacctcgccgatcagcacgtcctcgaattcgaggaaatcgttgcccgcggtgacgcggagcgtgtacggaccgccctccggctgcgcgggaagcatcacgcgccacggcgaaagaccgtccttgagatccttcgaagcgtacgcgtgggcctgcgcgaccatcgacccgtcgaaatcgcgaatctgcgcgacgacttccatacctgcgcaatcggcatccaacgcaccgaacacggcgttggacttgttgcgctgcaataccatatgcgaggcgaaaatcgccgccacatgcaacacaccggccgagctacgttcctcgacctcatcggcttccgcagtcagttcagatcccggcgcgggaccagtcacagcaaccatggcatctcttcctactagaaatacgacatgcctatcctatgccattcccggccgaggatacgcgaatccatcatccagtgagcagtggattttttacggtttctcggctcactttgtggactggatacgtaccaaaacggccgctccggtaggatggaccccagtttgcaggacaaaatccatgcacgaaaccacgaatttcatctgcgaatggtagaaacccgaacgctttccaagcgttcaccccactacacaaaaggagtgccaagtacaatggctgcacaaatctggtatgagaacgacggcgatctctcggtcctcgaaggcaagaaggttgccatcatcggttacggttcccagggccacgcccatgcgctgaacctgcgcgattccggcgtcgacgtcgtcgtcggcctgcgcccgacctccaagtctgtcgagcacgccaaggagcagggtctggaagtcaagtccgttccggaagccgccgccgaggccgacatcatcatgattctggctcccgatcagtaccagcgcaccatctgggccaacgacatcgaaccgaacatcaagccgggcgccgccgtcgccttcgctcatggcttcaacatccactacggctacatcaagccgaccgaggaccacccggtcttcatggtcgccccgaagggcccgggccacatcgtgcgtcgtgagtacgccaacggccgtggcgtcccggtcgtcgtggctgtcgaacaggatccgcgcggcgacgcttgggacatcaccctggcttacgccaaggctctgggcgcgctgcgtgcaggcgccatcaagaccaccttcaccgaggagaccgagaccgatctgttcggcgagcagaacgtgctcatgggcggcgtgaacaagctcgttgaaatgggcttcgaggtcctcactgacgctggctaccagccggagatcgcttacttcgaggtctgccacgagctgaagatgctcgtcgacctcatgaacgagggtggcctgaacaaggcccgttggtcctgctccgacaccgctcagtacggcgactacaccaacaccgtcatcaacgaagactgccgcaagcgcatgcagtaccatctgagccgcatccaggacggctccttcgccaaggagttcatcgacgatcaggacgctggcgctccgaagttcaagcagctgcaggaagaatatggcaacgtgcgcatcgagaccgtcggtccgaagctgcgcgccatgttctcttggaacaacggcaaggatgacgacgctgacatggccactttcaccggcaagatcgcccgtggctgagtaacgtctcgcattcattgcgattaatcgcattaactgcgattgaaggccgccgcccaagttgggtggcggcctttcgttatgccggaacgtacgcaaccgtcgcacgcacgacaatatgcaaaaagcgccgtccgcacgaagcgggcgacgctttctaattcgctaaatagcttatgcagctagcgaagcaatctcactgaacctgggtacgagcgatcttgccgttgaaggactcggccatatcggcatcggcgtccacctggttgttccaggagaacatggcgcgcagcttcgggccaacggtctccaggtgcgggtggctgtactcttcctgcagcttcttgaacttcggagcgccagcggcctggtcatccatgaactccttggcgaaggagccgtcctggatgcgcttgagctggtactgcatgcgcttcttggtctcctcggtgatgaccgtggaggtgtagtcgccgtactgggcggtgtcggagcaggaccaacgagccttgttcaggccaccctcgttggccaggtcgaccagcatcttcagctcgtggaacacctcgaagtaggcgatctccggctggtagccagcctcggtcagcacatcgaagcccatatcaacgagcttgttcacgccacccatgaggacgtcctgctcgccgaacagatcggtctcggtctcctcggtgaaggtggtcttgatggcgcctgcacgcagcgcgcccagagccttggcgtaagccagggtgatgtcccaagcgtcgccgcgcggatcctgctcgacggccacgacgaccgggacgccacggccagcggcgtactcacgacgcacgatgtggcccgggcccttcggggcgaccatgaagaccggatgatcctcggacggcttgatgtagccatagtggatgttgaagccatgagcgaaggccagagcagcgcccggcttcaggttcggctcgacgtccttcttgtacacggcggcctggtactggtcaggcagcaggatcatcaccacgtcggcttcggcaacggcctcggcaacaggcttgacctcaaggccctgctccttggcatactccacggacttggaggtaggacgcaggccgacgacgacgtcgacgccggaatcgcgcaggttcagcgcatgggcgtggccctgggaaccgtaaccgaggatggccaccttcttgccatcgaacacggacagatcggcgtccttttcgtaccagatagttgctgccataattggcgctcctttattgtttcttgcgattcggaacttgctttttccgaacaaactcgctattttctattcttttttcggttgttatcacggcgagtgattcctaggatgttgctccccccggattgtgtccgaggaaccactccgcctctcctgcggaactgttctagtaccgctttctttatgatgtctgttggcgttcacatagtggctatattcacgtcaaacgattttttctaaggctccgagccaccccaagcgaagcagcccggcaagccggtcggcgtcacttggtgaagtcgacgttcttcgtttccttgcagctcaacaccgcgatgaggcagcacagggccatcacaccgaggtacaggcccacggaatgcacgccccaatgatgggacagccaagtggcgatggtcggcacgaaggccgcgccgacgatggcagccaggttgtagccgatgccggagccggagtaacgcacgttcgcgtcgaacagttccggcaggaaggcgccgatcggaccgaacgcggtacccatcagagcgaagccgatgcacaggaacagcaggttggtggcgaagttgcgctgaccgacgaccgccggatcaagcaggaacgggaacagcagggcgaacgcgataaggcagcaggaggagatgatgatcacgcgcttgcggccgaacttgtcggcgttcacgcaggagatcacgatgaacgcggcgaacacgcagacggcgatcatcagcatgagcagatactcctggttggtgaagcccaggttgccgccaccctgctcgacggtcttggtgccccaagcgagggaccaggttgccagcgtgtagaacagcgtgtaggtgacggccaccaggaacgtggcctggatgacttccttccagctcttcttgaacacttcggtaagcggggacttgacgaccttcttctgctcctgggccatacggaagatcggggtctcctccatctggacgcggacgacgaggccgacgatcacgaggatggaggacagcaggaacggcacgcgccagccccaggcaagcatcgcgtcattgtcgttgaaggtctccagcaggaagtaggtgccgttcgacaggaagaagccgatcggggcgcccagctccgggaaggagccgtatagcgcgcgcttgtcttccggagcgttctcggtggccaccaacgcggcgccggaccattcgccgccaaggccgatgccctgcacgaagcggcataggcacagcacggcgacggccgcgacaccccattggttgtaggtcggcaggcagccgatcaggaaggtggcaatgcccatggtgagcagggagaccaccagcgtggtcttgcggcccatacggtcgccgaagtggccgaacaccaacgagcccagcggacgggcgatgaacgcgatggcgaaggtcagcaggctggccagcagcgcgacggtcggattggtggtgtctccgaagaacaccttcgggaaataattcgcagcggcggtgccgtatgcgtaaaagtcgtagaactcgatggcggtgccgaccatggatgctgcgatcacggttttgaccgaatcgcggaccatcgcctgcgctttgccagcggccgcttcgactgtactcattgatgtactccctgtacgtcctgctaccggctcccaacttccgccgataacgatgttgtttgtagtttttctgttttctgttgtgcgctatgccggccggcttcaaaaggttttcgctgcgtctgccttgtgggctgcaacaaaaagaccccgcatcatgcagggccatcaacgtgtgtgttacgcgcgcctcaaaccctgccttcgttggcgagggattgaagccgctatgctcgaatcagtccgccaacgaaagcggaataataattcgtgcggacagcagtacgcgtgcaaccattccgttcatcgtggcgaacctcctttcgcaaagtcatttccccgggcgggatttccgctcgaactaagccgtaaacataggcgcgtccatctcccctatccactaaaggttcactatgtggacgcgccgtttcgctttattttccaatcattggcgatctagcactgtcatagtcgccgtcattgttgcgatttcaaccgcaatgtcagcagacccgccaacagcatcgaaacagtggcgacagcgaagatcagcacggtggcaccggtcgccacaatcaccgcggcgcaggcagcgacgcccagtatcgtgccgaacgtattggccagactataagcggcaagcgatcggcccacggaacgcacatccggcagcatcgcaagatccaagctttggctggcgccatcgaacaccacgtatgcgaagccggcaagcagggcgtacagcgcaaccgccaggaaaccgtcgtccatcagcaacggcagcagcgcagcgaccatgaacaacacggcggacgcgacggccggaatacgcagatcaccaaacaggctgacgacgcggccaagcagcaacgccgcaatcaaagcaccgacaaacgtgcagatggccatgaccacaaccaccgatccggcaccggcaatgccgaacaaaccggcctcatcggtattgccgacgatattcggcgccagataccactgatatacggcgattccggctgtggctgcaacggcgaacatgcgggccgcgaatgccacagaaaacttcggcgcgttctgcggcggacggtattgcgagaagaaatcgcctttctcaacatccctacgcggcaggtagctgctggccccttcgaacggcagtaccaacagcgtaacgacggccgcgacgacaagccaacccgcgaataccagcatcgcgaaacccgtagtgccatcccaaccttcgccaccggcatgcggcgtcagcgcaacagccacggcgacgccgaccagctggccaagcgccagccccttgccgtgccaggaatcggcgcggtcgcggaacttgtcaggcacacgttcgccgaacgcggcggcgaacggtatggccgccatcgcatacgcagcctgcgtggccagccagaagaacacggcccacgggagaaaatcgcatgcggaaagaatcgccatgcagatagccgccaatacgctgccgctgacgatccatggcgtacggcgcccgaaccggcagtaggaatggtcggaaccgacggcgatgcatgcgttcagcaggaacgtcatgatggcacctgcgatgacgagcatcgccaaatccgtgacgcggttgattcccgacaaacggctgacggtttgcggaatgagcaccgtgttgaacgccgccatcggagcggacagcagcattgagccaagcgcaaaacccgcaacgagccggttggcctgcattgcggtcggcttggtgccgtccggagcggtcatcgggtcgcgcaggtcgaggaaggacgattcgaggttcggcacagccacgtcaagatgcgcggccgcggttaggggcgctccaccttccgatgcgatgcgcgcggcctgggtttccggacgctcgttggacgcttccggaatacgcggatgctgctgcaccgacagccggcgcatggccgccttcgcttcgggagtcagggtcttctcataatcggggcgatcgtcgatgcccgggcggatgaacacctggccgggcagcggctgcggtttgaattcgttattctgattgtcttcggtcatatctgctgttttcttggcttatcgcgttttctgcttgtcgtgtttcatgtgcttcgatactccacgcatgcgcccgcccgctacgagcgacacatacgaaaatcgcccggacgcattgcttcagcgcattcgggcgattcttcaacgcaacttacgataccaacacgtgcggccactgccgtccgcccgacggaccgggtgcgacggaccgggtgcgacggaccgggtgcgcgaccgcaaggtggaacgcaatcgcaaggccgtacgtaatcgcaagaaaatacgtaatcgcaagaaattttccgtcaggcgacgacaggcggattggcgatcagatcatccgaacggtggtctcccgcggaatcctcccattccaacatggcgaccggcgtagtgttgtccacaccgagaccgcgcttcggctcgaacgtcagcgtggcctggctggtttcgccgcgccaggtgaagctgatggacgtgtcgtcatcggtggtgtacgagaacgtgccgtcgaacgcgtcaagctcgttgcggaacttggcgagcgcgttcagggccttaacgaccggacgcttgagattctcgtcgatttccgcggtggagtagtagtgacgattgatgtcgcggccgttattcgtcttacgcagcagctccatgtcgttcttgccggcgagcgcgccgacatagtagacctgcggcacgccgggcaggaagaactgcaccgcgcgggcggcgatgtagtgctggtcgttgcatccgagcgccgaatagtaggtgctgttgacctggtagaggtcgagattggatgcggcggcgccagtggctgcctgggactcgccgtgggtgttggcgtggatggtgttgacgagattgtcgacgtcctcatccggcacgagacccttgagcgagcggtcgagctggtcggagccgatgtcgatcacgccgatgccgtcgtgcgtatcgagcacggtgacggcgttgttcgggcggatgtcggtccagtgggcgacgggctcgacgtggccggtgctcagcgcgtgcagcagcagcggaggcagggcgaagtcgtagacgcggtccaccttggatgcgatttcgacctgcttcttgtagtaggagtgcacttcgatgaggatttccaggccgcgcttgacgccttcctcgcgcaggcgggagatcagcttgaaggtcttcggggtcatgaagcagctggtgccggcctccttggcgccgtagccgacggcgtcgaggcggatgtagctgacgtgggaagccgccatctggtcgaagatcgacatcaggtattcccaacccttgtcggaatcggtgtcgatgtccacctgctgcggggtgaaactcacccagaccaagcgcgtcttgccggcgaacttgtagtgggtgaacggcaggcccggacgcggacggtagatgccggccaggtcctcttcggtggcgccgttcgggaagacggagctcatggtgaggaacatcgggtagtactcggattcctcgcccttggccagcacgtcttggaactgcttggattcccagctcatgtggttgacgatggcgtcgaccatgatgttgtgggtcttggagagttcggcgacgtcgtcccagctgccgagacgttcgtcgaccttggtgtggtcgatcgggtcgaagcctgcgtcggcgccgtcgaacggggtgaagaacggcaggatgtgaacgccgtcgtacacgccgtcgaagcgggtgcgcagaatgtcggtcatcgacttgatggtgccgtcgccaaggcggtcggcgtaagtgatgagctgcaccttgtttttcatggagcctccttcggttccaaaaagtcgttgcgagattctttgcgggagtccttacggccattcccacggttgtgtcgaaccggttcgatattaccgcaaaatggggctcgacaccaaaaccgcaaccggtgttcgggcgtgtcgaaccggctttcggccgaatcgcggcgcatgtctccggcgcccgattcgaaagcgacggacatgcgggggcagccgcgagcgcagggccctcagccttgggcacaggacttcaactgcgggcgcagtccgtaagctggccgacctgcttaaagtagcggtcgggttcgaggccgtcgacggtcgccacgttcgtcatatgcacgccgtcgaggccgccgtattcgacaatcacgtccagcacgcgctcctgccacgtcggttcaagatacgggtcgacggcgttgctgcccaacgcgcgcatcgcacagacaagcgcgtgcgcgccccaattcgacgtgccggccaccaccagctggtcggtcggcaccatgcaggcgatgttctcgccgtggtcgaccaccccttcgatggcgtagtcctccacacggcccatgccgatctcgttgccgccgtcgcccacgccgatcgtgtgcaggccgagcagcgcgagctggctcagcggcgcggtccattcggtgatgtcgatgccgcgcatgttgtgcgggctgccgtcgcgcgccgggccgacgcgttcgatgtagacgagcgtatcgatatgttcggttttggcaaggtcgatgacgccgttgagccaggcgtcaaaaccgcccttgggattggcattcggcgcgatcagcacgtggtcgtccggcaggaaacccaatgcggacgggcgaatcaccggcgcgcagcattcgtcgctgaccagccatgcgtcgccgccaatcgcacgcaatgccatgcatacttccagcgcacccaacgggccgtccgtttccgcagcgggttgcgcggccttcggaatgtagaagccggtgaccaccagcgcgcgggcaggccgaccttccttgctgttcgacaagtggcgtgcggctcggaacaaatcgccgcgcgaatacgtcatcaacgtttcggaaccgcgtccgacgtcggctcccgccatgcgtgcgatacgcgcgattttcggataataccgccaatccagcatgctcatgttgcgttccttccgtggtctgggttttgtttttgcgattgcgatgcgttgcgcgtaaggggcgtgcggttcacccgacggccggcagccgtgtcagccggccgccgcgttaactgatggcgccgagggggtcgccgtattgcgcggtgtcgccgacctgcgccgatcggtgcagtatgccggcaacgggggcggtgatttcggtttccatcttcatcgcctcgagtacgacgatcggctcgttttcctcaacgtgcgcgccatcatcggcgagccagcggacgaccgtgccggtgatggtcgattcgataggggtgtcttgggtgcttgcgatatccgagtttgcggcgatctgcgtgcccgatcctgctggaacggacttttgataggcgttcagcagggcttggatgaccgattcgccagaatcggacgtgagggcagggtcccccgttgcgccggctccagccaatccggccagccccgcgcccagcgcggcgacggaggcgagcgaagcgggcaggcccaatcgcacgcgtttgccatcgacctcgacccagctttccaccggttcgggcgctgcggcccggcgacccggtttgccgtcggccagcgtgcgcacgtccacggaaggcaggaattcctcttcgatccagcgcgtgtagacgccgaaatcgccgtccgtcgccacgaaagctggctgttcgagcacggcctggtcgaatttgcggaccgttggcacgccggcaatcgccagctcatccaatgcgtggcgggcgcgcgtcagacaggccgaacgcgacggcgcggagacgatcagtttggcgatcatcgaatcgaactgccccggaatcgcgccgtcttgcgcaacgccggaatcgaagcggatgcccggtccggtcggcacgttcagccgctcgacgatgccggggaacggtacgaaaccaagggatggatcctccgcgttgatgcggaactcgatcgcatgcccatgcggaacgggggtgccgtgttccaagccgggaatgtcggtgacatgcgcgccttcggcgatcgccagctgtgcggccaccagatcgacgccggtcacctcttctgtgacggggtgttcgacctgaatacgcgtgttgacttccatgaacgacatcgtgccgtccggatcgaccagaaactcaacggttccagcgctttcgtagtgcgcacgggagcagatggcgacggccgcgtcttccagcgcccgggtggtttcagggggtaggaacggcgctggtgcctcttcgatgagtttctgattgcggcgctgcagcgagcagtcgcgcgtgccgacggccacaacgttgcccgcgccgtcgccgaggatctgcacttcgacgtggcgcgggcgggcgaggaatcgttcgatgaagcagtcgccgttgccgaacgccagctcggcctcgtgcgtggcggatacgaacgcctcgcgcacgtcttccagccggtgcaccactttcagacctcgaccgccacccccgtagacggctttgatggccagtggcaggccgtgttccttggcgaacgtgataacttcggcggggtcgtgcaccggttccgtggtgccgggggccatgggcgcgccgacttcggccgcgatgcggcgcgcttcgactttcgagccgagcgcgcggatggtggcgggctgcggaccgatccacgtcatgccggcgtcgatgaccgcctgcgcgaattccgcgttttcggcaaggaaaccgtacccggggtggacggcgtcgacatgcgccttgtgcgcggtttccacgatggccgcgatgttgagatacgtgctttgcgcgtcggatccgcccagtgcgtaggcctcgtcggcggcgtgcacgaacagcgcgtccgcgtcggggtcggcataggcggcgatggcgatgcggccggtgtcatggcaggcgtggatgacgcgcatggcgatttcgccacggttggcgatgaggatgcgccgtagtttcggggttgcgggcgatggcgacgacaatgatggcgacggggatgggagcgccgttgcggatggtgcagtcgatgcggatggcattatcgaacctccttggtggggtacgcaggttgcggagtagacgtggcatgggcggaaacgacgtggaagcggacgcatgcgcctggtggcaactgcccggccacgtccaacgattccggttcaagcacggcgattaccggatatccgccggttacaggctggtcgcgcagaaaaatgaccggttgtccgctggtcggcacttcgattgcgccggatggcgtggcctcgctggccagttcgcgcgtgtcggtgcgttccacgggtgccgctcccgaaagtcgcaggccaacacggttcgactgcgcggtcactgtccacgtttgcgtcaggaatgcggacaggccggctgcggtgaaccagtcgtcgcgcggtcccaatcgcacgtataaatccgtaggtctgccgggtttcggcaggtcggtcggccatggctgcggcaggccgacgccggcatcgcacgccgtggacgcggtacgtatggcgagccgctgtttggctgcgatcggacgtgggccgatgccgctcatcgtgtccgttgcagccgaaccgagggttgtcgcgacgccgaaaccgccgcgtacggccacataatcgcgcaggccgctggtcggcggggcgattgacagcacgtccccgtcacgcagcagaaccggttgttgcatggcgattgtggtgcggtcggcggcatcgttcgatgcgttcaagacggtccggccactgcatccaccgggggaatttggggtgaacgtgccgtttgagccgccttgactatcttgcgattgccggcttccggtaatcgtcacatccgccgaagcgcccgtcaccgccacgaccacactgccgatggcacgcatgcgcacgccaccaccggtgatttccaacacgggggtattagcggggttgccgaccagtgcgttggccaagtgggaagacgtgcgatcggcggcgccggaaccggtcacgcccatgttcgcggcgacacggccatcatcctggaaggtggtgagcaggcccgagcggaggacttcgagagccggagtcgaggccgagacggacatggaatctggcgcctgcgaaacttgaacggaatcggacacagaggcagaaacagaagccgaaccgccggaaacggcgtcacgcacgggcgtaaaacgcacggtgtcgccgggctgcaacagcgcgggcgggtcggcccgctcgtcccacatcggcgtttccgtgtggcccagcaactgccagccgcccgagctgacgcgcggatacacgccggaaaacgtgccggcaagccccaccgcgcccgcgggcacgctcagccgtggcactttgcggcgtggcacatcgaatatcgggtcgccgccggtcaggtatgcgaaaccgggcgcgaagccgacgaacgccacggaccaggcggcatcgcaatgccggcgcacaacctcgtcaacggagatgcccagcaggtcggctacgtccgccatatcctcgccatcgtaaatcaccggaatttcaacgattcgggaatgccgttccatgtcggcggcaacgttcagcgcgcgaatcgcggcggtcagttcgacacgcgacgaaagcagcggatcgaaggcgacgtagacggtgcgcgcagcgggaatgagttgtttcacgccggcgaaaacggaggtcgcgctcggctgtgcggcccgctcgggcgattccgcagtttgttccatggcatgtttcacggcgctctgcaacacggcgaacacccgcagggtctcgtccaaatcggtgagctccacgagtatgccgtccgcaccgcaggtcaggaatcgcatgtcgccaccgccttaatcccgcgcggccgatgcggctgcgtcgcctgcgaacgcgcgtatcgcaacgccttccgactccaagcgggcgcggacggcacgcgccatcgccacagccgagggcgaatcgccatgcacacagacggaatcggcgttgagcggcaccacggtgccatcgatcgccaccacctcatgctcgcgcaccatgcgcagcacgcgcgccgccacttcggccggatcggcgatcactgcatccggcaagcggcgcgacaccagcgtgccgtccgcgttgtacgcgcggtcggcgaacgcctcgtggaacacacgaagcccggcctgcgcggccaggcggccgaccacggcgcccggctgcgtcagtatcgccagcgatgcgtccacggcgcggatcgcgtcgaccacggcggcggcctgcgattcgtcgcggacgatccggttgtacagcgcgccatgaggtttcacgtaccgcacctgcgcgcccaccgaccgcgccatgccttccaacgcggcgatctggtacatcacgtccgccttgagctcgtcgggggactcgtccacatagcggcgcccgaatccggccaggtcgcggtacgccacatgcgccccgaccattaccccccgcgacgccgcgtatgacaacgttctcagcatgacggacgggtcgcccgcatggaagccgcacgccacgttcgcgctggaaaccacgtcgagcaatgcctcgtcatcgcccaatttccagcgtccgaagctttcgcccatatcgctgttcatatcgattcgcatagccgtctgccttccgtctgtttcctgcacagccatcgtttccattccttccgtcgcctttccgtcgttctaccgtcgcagcgttcttcagccgcgacgtcccttctgccgcagtcgccgcagcacgcatctcatgccgcgccccgcaacctgccgctcggcctcacaccatgtattccaaatcgcgtttgctggtgatgaacatgtgccccggcgcgtgcgtgatcgcgaattccggtttggacgccatcaccgcggcctgcggggtcacgccgcacgcccagaacaccggcacatcgcccggctccaacacgggggcatcgccatagtcgggatgcatgatgtcgtcgatgccgatcgcggacgggtcgcccacacatacgggggcaccgtgcacggacgggtaatagccggaaatccggcatgcgtcggccacctgcgtagacggaatgccacgcatcgacacgaccatcgtcgaatggaacgcgccggccgaacggcactcgatcgacgtgtcgtacatcggcacgttgcggcctgccgtgatgtgccgcaccggcacgcccgcctccatcagcggaaactcgaatgtgaaactgcagccaatcacaaacgtgaccaaatcggatcgccaatactcgcgaatatcgggcacttcggctaccagttcgccacgcttccacacgcggtacaacggcacgtcggtacggatgtcggcgcccggcgcggtgacgagtgcggtgacgcccggctccatcacttccagcagcggacaaggtttgggattgcgctgcgcgaacagcagaaaatcgaatgcctgctccttgggcagaatcatcagattcgcctgcgcgtagccttgcgcgatgccgcaggtcgggcggaccaggccgtcacggaacgcggcgcgcgcctgttcgggcgtgctcgccgcgccaagttcggttgttcccatatcggacatcccatccaccattgcgctcacctttcccgtcggccgccgtccggccttttccgaacgaactgccgacgaaccccgaaatccgattccgcagaaacggacgttcagagtcgctttccctcaccttggtcgccgaacgttacgggagccgcgcgattcatgacgcgtatgtttccgcattgcaaattggcggtaccaagcggaaacaaaccatggttaggttggacgccgaagacgcacgcgaacgctgacgcaacacaacagcgcaacagcaataaagcggcaatcaaaagacgcggagcgcggaagagaggttcccatgagttcgatcgttctggcagtcggtaacggcaagacgctattcggaggcgcaggcgtggcgcccgacgcggatctggttcgtttcgtcgatccggaaagccccatcatcaacgcgttcgatttgtgcgcactgcgcggcgacggcattttcgaagcgaccacggtatggaagggtttcccggtctcgttggagaaccatctgaagcgtctcgccaattccgcccgcctggtggacatgcccgagccgaacattccagcgctcacccgcgcagtccagctggtcatcgaccagtacgacgatccggaacccggcccgatgctacgcatcatcgtctcccgtggtctcgatccggacaccggcgtgggcaaggcggccgaccgcacgccgaccgtctacatcttccttgacgcgaagggcacgctgcattcgctggagccgatcaccatggcttcgatgacgcgcggctacccgtcggacatcaccgcacgcgccccgtggctgctcaacggcgcgaagacgctgagctacgcgttcaactgcgccgtgcaccgcgaatgcgcccgccgtggcgtcggcgacgcgattctgttcacggaggacggctacacgatggaatgcccgaattcgtcgatcgtggcacgctatggcgatacgttcgtcacgcccgacccgcgcatcggcattctgaatggcacatcacagcgcgaaatgttcgcctgggcgcttgaagaaggcaagaaggcggagtacaggaagctgccgatcgccgagctgcgcgaagcggacagcctgtacatgacgcacggcggatggtcgattccgatcagcgagatcgatggacgcgcgcttgccgtggatgcggcggagattcaggcgatcaacgatgcgatccattcgggccgcacgcatgaggacgcgttgaagatcggtccgaccggcgattacgagtaaggcgaaacgacctgcttagcaggtgaaacggcccgtcaaatgatgggcgatacggaccgcttagcgggtggtatcgcccagtttgagcgtcacgggaatcagcacgtccggctcgtacggcttgcgtcccgtggcgcttgtcgcatctgccttggcatccccttccttggcgatcgcacgaacgatattgccgaccgcgacctgcgcgattttgtcgaaattctgcgccaccgcggtcattttcataccggccaggtcagtcagatacgtgccgtcgtaggcgatgatctgcaggtcgcgcggaatcgaaatatgcctccacatcgcttcgcgcacgcaaagcgcggcaccgatatcggagctgatcactgcgtcgataccgtccgtcggcatacggttgagcacatcgttcaccgcgttcttatacccttggaaatcctccacattgccggcttcgacatactcgtaccgcacgccggccgccttcagctcctgctccaacgtaaggtagtagcggacggccgggaacgttgtcttgtgcaggtcgaaatcgtccgggctgtctccattgcgcgccgccaaatcgaagaactggtcgcgcgggccgccgatcatcaccacgtggtgcgcgccggtgttgaccagcctgtgcgccatgagccggccgccctgctcatggtcggagccgatcgacgcgatgccgccgcccagcacacggtcgaaggcgacgatcgggcggtggatggacgtccagtaatcgttcggatgggtggtgtgcgagcagacgatgatgccgtccatcatgtgacggcgcagcatgtccacgtattcgacctcgccgttttccgcgtcggcggtggagcacagcatggtgcgcagtccttgcgcggccagctcgcgttgcagatgcgcggtaagggtggcaaagaaggggtggcggatggtcggcacgatcacgccgaccaggttcgtgcggttcttgtacaggttgcgtgccagctcgttgggcacgtaattgagctctttcatggcggctttgacgcgcgcgcgcatgtcgtcggacacgtagcccgtcttgttgaccaccagcgaaaccgtgctcagcgagactccggcctctttcgccacgtcgcgcatgccgaccattgcccaacacctctcccccgcatcgtcgggatgtttccttacaaatcgcgatattatgtgttattttacatgcatctgtaacgtttctttgcagtcgttcgcacaatatgaactatcaattgacgaaagacgccctccccctcttcaattcccccgaaaaatccactttttcacccgtgaacgacgtatgtttcacgacgcgttccacgtatcttccacgcacgccccgcatgtactccacacgcgttccgcccgcaaaaggggcggtgcgacacttgcgatcatctcgcttgcgtcgcaccgccccttgcgttgcatggcctggccgtcagccgtcacgtccggccatcacgtcagtccgcaccacggacgaaccgaccgtcaggccgtcggcacggagccttcctgggagtggtcgaagaccggcttgttgtcggcgtcgtacttgtagacgccgatggaagccgagctcggatcatgcgcgtcgttgaacgcgccgatgccggtctggccctggtactgaatctccttgccgtccttcagcagagcaacgcaggccttgtaggaatcgcacttctcgcccttggtggatccggagacggccgccatattggcctggatggtcttgccatcggcactgccgcccttctgtgcggcgagcgcggcgaggatgatgccgtcataggtttcagcaccgtaggtggtggtgttcttcaggtcgacaccggtggattcgaggcgcttgacgaagtcgtcagacggattgacacccgggatggtgcccttcgagccttccagcaggcccgcgtcgagttcgctggaatagtcggaggtgttgccgtccacgaagtacagcttcttggtgttgactccggcggaggcgagcgccttcagcagcggtttggtctgatcgaaggcgatgacgagcgtcgcgtccggattggatgccttaattgcggttgcaattgaggagaagttcgtttcggtcgggtcgaaggtatccttttctccatagacgatattgacgccggcctcggatgcggttttgacgattgtgtcgcgcaggccggtaccgtattcgtcgttgaagaccgcgatggcgagcttctgcacgccgtcctgggcaatcaggttgcccatgaccgcgccctgcacggtatcgggggcgacggtgcggaagaagtagtcgctaaggccggagaagccggccgaggtggcgcccatcgacagcatcggaacgttttgcgaggtgatggacttgtaggtgttcttaaccacggagctggaggccgggccgatgatgaacgacgggttcttgctgaggacggattgggcggcggaggtgttctggtcggcgtggtccgcgtcggaggtgtcggcgtcgacggtggtgattttgttgccgagcacgccaccagcgtcgttgatgtctttgacggcaagtttttcggcggccagttccggcggggccaggtaggccagtgagccggtttccggccataggccaccaagcacgaacttactggttttggtgccggaggtgcttgccgaactgctggatgaactggacgagttggatgaaccgcagccggcgagcgccatgactgcggcggccaccatggcggtggctgtgatggacagtttcctcatgcccttcatgttgatcttcttcatttgaatcaccgtttcctctcttggctccgctgattgccgaacccttggtgacgattatcgagatgtgttgctcgaccatcttgaatcgcactataagtgccgaggaaaccgaatgtgtatgcgtgaagttaaccgaaggtgaagcccgaaaactgttggaaacacaaggatttgtacccattttcaagcatgccaaaaccgtcggcggagggtattccgtcgacggtaaagcggtactctatctgccttcctcttccacttcctcctcaaggttgcccaggtagagggagacgactttcggatcgttcatcaggtcgcggcccttgccggagtaggcgttgcggccttggtcgaggacgtagccgcggtcgcagatctgcaggcagcggcgggcgttctgttcgacgatgaccacggatacgccggctttgttgacttggcgcacgcggatgaaggtctcgtcctggagcattggggacaggcctgcggagggctcgtcgagcaggaggacggatggtttcatcatgagggctcgggccatggccaccatctgacgttcgccgccggaaagctggccggcgagctggttcttgcgctggccgagtttggggaagatggagcacacgtagtcgaagcgttcgttgaacagtttcggtgcttggaacgcgcccatgtgcaggttttccgcgatggtcaggctggggaagacgttttcggtctgcggcacgaagccgacgccacgggagacgagtttgtcggcgcgcaggttggtgatgtcctcgcctttcagcagcagcttgccggagtggatgtgtaccaggccgaacaatgatttgagcagggtggatttgcctgcgccgttcgggccgatgatgccgacgatctcgccttcatgcagggtcagggatgcgccgttcaggatgttcacgccgggaatgtatccggccaccaaatcgaccgcgtcgagcaacggttcgccttcgggctcgcccatgtggatctgcgcgcgggtcagcggctcgtcggccacgcttgcgatgtcgctcatttcaggcctccttcaggtcttccagcacggaatcgtcgcccaggtccacgttcgcgtgggcgcccaggtatgcgtcgatcacggccggatcgttcatcacgctcttcggttggccttcggccacgatcttgccttccgccatcacggtgacccagtcggcgatgtgtctcaccatgttgatgtcgtgttcgacgaacagcactgtggtgccttcctcgcgcaacgccatgatgtggtcgagcagcgactgtttcagcgcggggttcacgccggccatcggctcgtccagcatgaccagtttcgggtcggacatcagcgctcgtgccatttccagcagcttgcgttggccgccggaaagcgcgccggcgtaatcgtccttctttttgatcagcaggaagcgttccagcagcgcttccgctttttcgatgttcgcctgctcctgctttttccacatgccagggaacagtgcacggaacatgccttcgcccggctgtacgggggcgccgaggagcatgttgtcgagcacggtcagacggctcatgaccttggtcagctggaaggtgcggaccatgcccatgcgcgccactttttcgggctgcacgtgggccatgtccttgccgtcgaactgccaggtgccggtgttcggcgtatcgaagccggtcatcaggttgaagaacgtggttttgccggcgccgttcggtccgatcagcgcggtgatgccgtgccgttcgatttcgaagtggctcacgtccacggcggtcatgccgccgaatttgcgggtcacgttgtcggccacgaggatcgggtcgggcttgtgcacgcccggcttgttttcgacgaatttcagatcgtcggtgactttgtcgcgataggcggtggagatgagggtctcgccttccggagctttggtggcccatttggtgaggtcctggaatggtacgccgggctgcacaccggatacgggttgcacgccggttgcgggttgcgtggccggctgcacgccagtggtcggagaattcgttggttcaggcatggaaagccaactcctttcggtcgcccaacagaccttgtggtctgaagatcaccaggcacatcagcgcgacgccgacgatcacccagccgagagcttcgatctggttggaagagatgagggtttcgggaacggtgttgcgcatgacctccttgacgaaggtgagcagcacccacagcacgcaggagccaagcaccgggccgagaatcgtggccgcgccgcccagcagcagaatcgtccacacgtagaaggtgacggtgcggccgagcgaatcgggctgtacggaacgcggcaggacgaagatgatgccggcgatcgcgccgaacaggccgcccagaatcagcgattccatcttgtatcgcgtcaccggcttgccgagcgaacggatcgcattctcgtcctcgcggatgcccttgagcatgcggccccacggcgagtggaaccagcgccagcacagcagcgccgcgatcaccaccaaaacccatgccacgatgcgcagccaccaggagttggcgatgttgttgctgtacgtccacagcaggaacgtggtcgaaccgtccggcagcggcgaaagcgattcgaatttctcggtgaagtcctgcggcgagatgcccgcggaaccgccggtgaagttcgtcatgaccgtcgatctgccgatgatgcggatgatttccgcggcggccaatgtgaccatggccagatagtcgggtccgagcttcagcgtcggaatgcccagcagcagcgcgtagatgaccgcgagcgcgagcgccgcgcatacggaggcgaacaggttgcagcccatcgactgcgtgatggcgaatccgtatgcgccgaggagcatgaaaccggcctggcccatgttcatcaggcccgtcatgccgaagtgaatgttcaaaccgattgcggcgagtacgtacgccgctgtggtcggggcgatcagttcgcccgccgcgttggagatgattgtcatgatgtccatggatcagcccatcctttgctgcttgccgaagatgccctgcgggcgcaccagcagaacgatgatgaggattgccagcgcgctggcgtaacgcatatcgttggggatgacgagcgagctcatgtccgccacgatgccgatgaccagcgagccgatcaacgcgccattagcggtgccgaggccgccgagcgtcaccgcggcgaacatcagcaggatcagggtcgcgccggtgttccaggagatgccgttcaggtagacgccgagcagcacgccggacagggctgccatcgcgcacgagaggatccagaccacgcggaccacctggtccacgttgatgccggatgccgcggcgagtgccgcgttgtcggacacggctcgtgtggcgcggccgagtcgcgtcttgtaaaggaacagggtgacgccgacgatcacgcagatggcgatgagcgcggagaccagcgtcggcatgtcggtggtgatcggtccgagctggaagctgtccggcaccgatttgacgatgcctttgatgtcgccaccgaagaagaactggaacgtgtactgcaacgccatggacaggccgatggtgacgatcatctgctgcatggtgccgacgtggcgtctgcgtagcggcccccaaacgatttcgttttggatgaagccggtcagcgcgccgatgacgatggcgaagatggcggaggcgatgagcggcatgtgcagcatctgcgtgccgacgtatgccatgaggccgccgagcgtcacctgttcgccgtgtgagaacgactgcaggccggtggtgccgtagacgaggttcatgccgacggacatgaggcccagcatcaggccgaagataatgccggaatacagttgctgccagatgcgtttgccgacattggagccgtcttttttgactggcgattgcgtggccgccgtcgatccggatgtgccggtcgcgcctttcgtgccgtttgccgagccggacgatccggatgtgccggacgtgccgctgccggcggaatcgcccgcctggtcgaatcggacaacgccgcgctgcttgtcgaagctggctttcctgattgtcaccgttgcgctgcttgccttcaggccgtgctctttcgcaacggacgcgtcgatggtgacggtgtaatcgccgtcatcggcaacggagaaggcccatttgccgtccgccgcggttttggtttccgcggttgccttgccggacagcgtgatggtgacgtcggcgatcggcttcttgtcggcgtcctgcaggatgccgttgacgcagccgttgctggcggtcggattgcattcatcgacggcctgcgcgccggaatcggctgcggacgcgatggcgggagggagtacgaaaagcatcgagagaacggcgacaatcgaacagagtatgacgattcccggtcgacgatgccgtgtgagatacgttacggctgtcataggtttttcctctcttgttgttttcacaacgtaggagaggaaacagctcgcgcggttgcgctcagatttcctgaacgttacccgatgaccgcccgtgtaacgtgaaaattacgcgcggccgagccggtgacagctatgcgtggccgcccagcatggcgatgccgaatccgagcgccacgcaggcgagcggcaccgcgaccgtggcagcgccatagcccagggccatggcgaaacggcgtttgcgaatcagcgacagcacctcgttgatcgccgacgagaatgttgagaatccgccgaggaaccccacaacgaacgtcattaccgtgcccatatcaaccgactgcgcatagtacgacatcatggcgatgccggcgcacagggaggcgacgccgttgatgacgagcgtggccagggggaagctgtggttgccgtcacggttccagctgcgttggatcgacacgtcaagcacataacgggccatggcgccgatgccgccgaacaggcagatcatccaggtcatcagcgcacctcccctgtggtcgggtcggcgacgagcgggatttccgcggtgaccggcttgggttcgaagctgggcagaggtgcgacgggttgcgatgactgcggctgcgattcgattttcggcacctgcccggtctgcgcgacctgctgggcgacctgggccgcctgctgtgccgcctgcgcggcctccaacgcggcctgcgcggccgaatgcgccgcatccgccaccttcacgtggcgcacgccctgcgcgtccggcacgttgttctgcacattttgcgcggccggcacgtccgattcgcccgaatcggccatggggaccgtctgcgtaacactctgcgtagccgatactgcagtgtcggtcatctggacgtcctgcacgatgccgtacgcgtccgaatcgcccgaatcggacattgaggatacggaagccgtggaggcatcggcgatcgcgttacggacccgcttgcgtgtgccgcgcgccagcaacgcctgcatcagcgccacgccaaccgcggccgcgatcagaccgccagcgaaacttcccgcaagatagccgagcgcgctgccgaaacgctgctcgcgcatgccttccatggtttccaacatcacgccggacatcgtcgacagtccgccaagcaaaccaagcccgacgccacggctgacgacctgccgcaccctgcggcgcagccacgacgcggtcgccatgtattcggtcagcatcgcaaacaggaagcaggcgagcatattcgacacgaacgtgcccaccacgaacggcgaaccgttcaccgacggcagcagcaggtccgtggcgcgacggaaaccgacgccgacgaagccgccgacgaacaccacgagatacatcagaccatcggcaagagggttgaatcgcgcctgcatgcgtttcatcggcgcgagcggaatctgcggcggatgcttggatgcggcggcaccggacgggcgcacatccgcgcgcgccacttcggcgacgtcgatcgactgtgtggcgggattcggctcatcacccgcgtttggcgagtctgccgcccgttgttcttgcgattccatcacgttccccttgtacttggctttccgcggacagcgtcgttccaccccagccatacggcaacgagctggccgcaggtgccgtcttcctaaccttgtacgagtctacacgtgcattgcaaccaaacatcgaacatgtccgattcggtggataactgtggataacttcgggtggccctagacgtctacgaatggttatggaagacagtaaggccgcgtcagacggacacgtcgcacaaccgccgcatcgcatgccgtgcgtcgctttcgtcctcgccgctgaacaacacgaccagatagtcgccggcgcgcagccgcgtatcgccatgcggcacgatctgccgttctccgcgacgcaggccgatcaccagacagccgtacggccagcgcacgtcacgcatcagcttgccgtccgcggtcgcacccatttccacaggcagttccatgatgccgttgtcgatgcgattggcgattgccgtcgtgcctccttgcgcgcgcatgtaccgttccagcagctcgccgtagatcggtttcgtacgcagcaggtcggagacgagcaatgcgatgaacgcgacggcggcgaccggcagcatgtgcgtcaacgtgccggacatttccacggccagcagaatcgacgtgatcggtgttttcacggacgcggccagcgtgcccgtcatcacgcataccgagaaaatcgccacggaatcggacggcaggttgccgaactggcgcaacgtctcgccgcagataccgccggcgagtgagccaaccgcgagaatcggcatgaaaatgccgccgggagcgcctgaaccgaagctggtggaggtgaacagcactttcgccacgaacagcacgcacagcatgcccaagccgacgcgcgcatgctcggccatggcgatcaggttcgagccgccgccgagcacgtcaggcagccaaatgccgattggcagcgcgagtgcgatcgcgatcaaagggcggctccatgcgggaagcttgccgtacagcgtttggaagccgagcagcgaacggttcatcagcgaaccaaccaaaccggccaccaatcccagcggaatcagccacccgtattcgccgagcggcagttggccgatggtgccgaagtcaagcaccggacgcaggccgaaacagtatttcgatacgaaatcggcggtcagggacgcggcggtggcgcccatcagaatcgcgggcgaaaaactgcgatgcaccccttccaaagcgaacatcatgccggacagcggtgcgctgaacgcggcggacaggccggccgcggcaccggcggtgaccagataatgctcctgcatgtcctcacgtttcttgccgcgcagccggtgcgataggaactgcgcgcccgatgcgccgatttggatggacggtccttcgcggccgagcgagaggccgaagagcgatccgagcaggcctccgatgaagcgaaccggcagaatcgtctgccatcgcattttcaggccgcagatcaccacgccgttggtttgcggaatgccgctgccgccggccatcggctcttttttgaccatccatgcgatggcgagcgcggctgcgattgcggcgaccgcccacggtgcgaccagccacggggtttcgcggatgcgcgcgtagatccagcgcgcggtgtcggtgccgtattcgatgccgagacggtagaggacgacgaggaagccggaaatcaggccgacgagaatgccggcagcggccatcttccatttcaggtggtcgaatcgcgggaccagtttgctgaacctgtcaaacctgtcgaacctgtcgttaggcggcattgcagtcatcgcactccccttttccgttcctccgccgcgcaccccgtcggtgtgtatgcggtgtgcgtcatacgcgaacgccatcgcacgcaccatacgcaaagtgccggcaggcacaggcccaccggcacttgtcattgacgttcgttgccgacgttcatatcgacgaatcagccgaatcagcttcagtcgatcagcgagttgatctggatgatgtggtcgcgctgcgggccggtgccgatcacggaaatgcggcagccggacagttcctcaagacgcttgacgtaatcctggcaggtcttcggcagatcgttgaagtcgtggacctgggaaatgtcctcgtcccagcccggcatggactcgtaaatcggcttcgcggcggcgaattcggcctggtcggtcggcatatcgtcgcgacgctcgccgttgacgtcgtacgccacgcacagcgggatttccttgaggccggtgagcacgtcgagcttggtgagcacgatgtcggtcaggccgttgacctgggccgcgtaacggttgacgaccgcgtcgaaccaaccgcagcgacgcggacggccggtggtcacgccgtactcgtggccttgggcgcgcagccattcgccgtcctcgccgaacagttcggtcgggaacgggccttcgcccacgcgggtcacatacgccttggagacgccgatcacgcgggtgatcttggtcgggccaacgccggtgccggtgcaggcgccgccggcggtcgggttggaggaagtcacgaacgggtaggtgccgtggtccacgtcgagcatggtggcctggccgccttcgaacagcacggtcttgccctcgtcgagcgccttgttgagcaccagggaggtgttggccacgtacggcttcaggcgttcgccgagcttgagcagctcgtcggtggtctcgtccacgtcgatcgggcgacggttgtacagcttgacgagcatctggttcttctgatgcaggctggcctcgaccttgtcatgcaggtgctccgcgttgaacaggtcgtgcacgcggatgcccacgcggttgatcttgtcggcgtatgccgggccgatgccacggccggtggtgccgatcttgtgcttgccgaggaagcgttcggtcaccttgtcgagcacgcggtggtacggggcgatgatgtgcgcgctttcgctcaccagcagtcgggagcagtccacgccacggctttcaaggccgtcgatctcctggaacagcacttccggatcgacgacgacgccgttgccgatgacgggggtggtgttggggctgatgatgccggacggcagcaggtgcagtgcgtacgattcgtcgccgacgaccacagtatggccagcgttattgccgccgttgaaacgggcgacgtagtcgaccttcgtgccgatcagatccgttgccttacctttgccctcgtctccccactgggcaccgatcaaaacaattccaggcatgttgttgcacctccgtgcgtacgcgattctgccttaagccttgcgcctaaagccttacaaaggttactcttcaccctctaccgggtctgagggatgctcacggctccggaccgaccgtaatcggattgcaaccggtccgaaaaacagaccagaaaacgcccgaaaacagttcgaaagaccgttggctagttcagcgcgcgcccggcactgccgagctgcttgcatgcttcgaccacacgcgcggccatcgcggattcagcttcacgaccccaggatcgcggatcgtacagcttcttgttgcccacctcaccgtcgattttgagcaccgaatcatagttggagaacatgtgaccggccaccgcacggctgaatgcgtactgcgtatcggtgtcgatgttcatcttcaccacgccgtagctcacggcctgcgcgatctcctccggcgcggagccggaaccgccgtggaacaccagggcgaacggcttaccgggagcgacatccagcgagtgcgcggggtcgggcatttcgccggccttgatcgcgagcgcgaccgtggtctggatttcgtcgagcagttcggggcgcagtttcaccacgcccggcttgtatgcgccgtgcacgttgccgaaggtgaaggcggccatgtagcgtccgcgctcgccgaggccgagtcgttgcgcgacggtgatgccttgcgcgggcgtggaatacagtttgtcattgatttcggcgctgtgcccgtcttcttcgccaccgaccgcgccgatttcgatttccagcacggtgtgcgcggcttgggatttgtcgagcagttcttctgcgatgtcgaggttttcatccagcggcactgtggaaccgtcccacatgtgtgactggaaggtcggttcctgaccgtgcttcacctgttcgacttcatggtcgagcaagaggcgcacccattcgtccaaatactgtttggcgcagtggtcggtgtgcagggcgatggtgatgttggggtatttcgccgcgacttcgtgcgcgaaggctgcgaaggcaagcgagccggtgacgcggtcgttgacgcgttgcccggagaagtaggcggcgccgcctacggagacttggatgatgccatcggattccgcctcggcgaaaccctggagtgcggcgttcagggtctgcgtgctggtcacattgatcgcgggataggcgtaaccgccgcggcgtgcggcgtccagcatttgcgcataacgttccggcgttgcaatagtcatgcctccattatcgcccaaccctatcccacttgtcatgtgacaacattcgccatctttcctttccgttttcccgaccgtccgctccatatccaggtcgcccgccccactagagccatatgccgagcgttttcgtctcatatcccgacacttgcgggaccgaccaataaacatggcgaaaccattgcgatcgttccatcggaagtcatagaatgtccaccagatcgcgcgacgaagagcccaaccgggtgttccccgcacgggcatgccgccgcacgtagatgttgcgaccaatacccgcgaggaggcttgatgcaccaggttttcgccatcttccttcgagacgtgaaacgcattctgaagaaccccgtggcgctcgtcgtcacgctgggtgtggccatcatcccatcactgtacgcatggtgcaatatcctcgccaactgggacccgtacgcgaacacgggcaacatccaagtcgctgtggcgaacgaggataagggcacaacctccacgctggtcggccatctcgacgctggccagcagaccgtcaaccagcttaagaagaaccatcagctcggctggcgtttcgttcccaagcagcaagccatcgaaggcgtggaatccggcaaatactatgcggcgatcgtactgccggaagacttcagctccagactaatcggtaccgtcaccggtaaaggcgaccgaccgtcgatcacgtactacatcaacgaaaagctgaacgcgatcgcgccgaaaatcaccgatacgggcgcgaccacgatcgacgagcagatcaacaccactttcgtttccagcgtggccgacgccgtggcaaaggaagtgaaggaggcagcgggagaaaccaccggcagcgtgaaaagcgcgcaaagcgacgtcgtcaacgatctgaccgacaccatcaaccagctcgaaaccgtccaacagcagctgcgcgacacccgctccacgctcgacaaggccctcaccaccatcgattcggccaaacagtccaacatcgcgctcgcctcggaactcaccaactcgcttgacaccgtcggcaaggcgtccgacttgctgagcgagacgcgcacacaaaccgaacgattctcgaacacactggtcggagcgctcgacaacggcagcacgcaactgtccggcctgcaggtcaacgtgagcaatgccaccggcaccgtgctcagcggactgaacaccacgcaggacgcgctcgaccaagtgtccagcaccatgcatcacgtcaacgccaccaccggcaatgtgctcgacggcgtggagaaggcgttgcaggccagccagctggatccgaacagccaaacgtataaggatctttccgcgcagctcgccgaagcccgcaaacagctgacgttccagcagcagcgcatcgacgccttcgatcaggacaccacggctgcgatcaacgcggggaagaacaccgcgaacgggttcaacgacgatgtcaccacgctggcgaagaacggcacggcgtcgatggcgagcgcacacacgaccatcaccggcacggtcatgccgaatctcaacaccgggctcgatacactcagcctggccaatgggtcgctgtccggcacgcttaccacgctgcaaagcacgctggaacagggcaacgggctgctcgaccagttgtcgcgcaccgtgacccaaacgaacaccaccattgctggcacgcagacacagctcgccaatctcgccaaacagctcaacaccacgcgcaccgatgtggccgcgttgagcagttcggcgatgttccagcagctttcccaagcgctcggacttgacgcgagcgaggtcggctcgttcgtgggcgagccggtgcatttggacgaacaggtcctctacccggtcaaaaactatggttccgcggtcacgccgttctacacgaatcttgcgctgtgggtcggcggattcgtgctcgtcgcgatctacaagcttgaagtggaccgcgatgagaagatccgcatgtacacgccacgccaaggctatatgggccgttggctgctgttcgtcacggtcggattcctgcaggcgatcatcgccacgatcggcgatctcgcgctgggcatccaatgcgagcatccgttcctgttcatcctcgccggcattttcgcctcgttcgtctacgtgaacatcatttacgcgctcgccgtggcgttccggcatatcggcaaggccgtcgccgtgattctggtgatcatccagattccgggcgcggcaggcctctaccccatcgagatgatgccggaattcttccgccgtctgaaaccgttcctaccgttcacctacggcatcaacgcgatgcgcgggccgatcggcggcatgtatgccaaccattattggatcgacatgctctcgctgttctggtatctgcctgtggcgctgttcatcggcttggtggtccgcaagctggcgttgaacctcaaccgcctgttcgacaaccgtctggcggacactgatctgatgatcaccgaacataacgaaggcacggtggaaccgttgcggctcaccgagaccgcgcagcagatcgccgaggagttccccgaactcgcccgcagacgggcgattcatttcttccgcctgtacccgcgcctggtgcgttggggattcctcgcgctggcggtactgccgttcgtgttcctgctattgctattcatcacgcgcatgaagctcgccatgctgctcggttggatcatttcgatcatcgccatcgacacgtatctcatcgtggtggagtatctgcgcgaacggtatgcgaattatctgggcgaggaagcgatgagtgcggaagagttccgcagcgcgatcctgcacgagaacctgctgttccggccgggcatgcattacaagccgatgcatgccgtacgtacgaggctgtatgaggctgcacatggtggttcggccggacatgcgactgaacatgcggctgagtatgcggctggaaacacggacggaaatgctggcaggagtctgcgtgaggaggggaacgaacagtgaaaataatctggggcatcttcaagcgggacatgtgccatgccacccgcaacgtgatcgccgtgatcgtctcgatgggcctggtggtggtgccggcgctgtacgcctggttcaacatcgcggccagctgggacccctacggcaacaccaaggcattgaaggtcgccgtggccaataacgacaagggttacaagtcggatctcataccggtgcgcgtcaacgtgggcgaaaccatcatcagcacactgcacgccaacgaccagctggactggcagttcgtgaaaagcgacaaggcaatcgacggggtgaaatccggcgaatactatgcggcgatcgtaattccgaaaggtttcagcgccgacatgatgacgctgttctcccccgacatcaaacacgcgcagctcaagtactatctgaacgagaaaatcaacccgatcgccccgcatatcaccgatcagggcgcgacaaccgtggtcaacacgatcgacaaaaccttcgccaaaacgattgcgcaagtcggactcgacctggcctcaagcatcctacactattcgcaaagcccgcaaatggccgaatacatgcgcaacctcaacggcaatctcaccaccatggcggatacgctgagcggcgcatcgcagcaggtgacgtcgtattcgcagctgctcggctcggcgaacgacatcgtggattccacgggcaaactgctcgcctcggcgaccaaggcgggcaaacaggcccagaacgcgttgaagcaaggcaaatcaggtgccacgtcactcacttctgcaggtgcgaacgtcacctcctcggtgaacaccgcgctcgaccaggtgtcaggcgcgttcgaccaagtagctgccaaggtgaacaaggcgttcgacgcgatcggcaaggactcagacaccgcagccagccagttggcaacgttgagcgaacaaatctccagcggcgaatcgctgtacgacacgtacatcacaagcctcaaccacatgcgcgaatcggtggaacaactaccggacagtgattccgcgaaacaggcgctgctggaagccatcgaccgggagatcacgctgctggaagccgccaaaggcgattcgcagaagctcgcgcagcagctgaaagacgcttccacgcaggtcacgcaagataccgcagccgcggaacgctcccgcaaggagatcctgaaccgcatcacctccgcgaagcagtcgatcagcaatgtgcgcgacgattacgccacgaacgtcaagccgaaaatcgacgcgctcgcctccacagtcagcacgctgatctcccaaaccgacagcatgatcacccagctgagcggcaccgccgacgatctggacgatgtgacgggcgatgcggggacgaatgtgacgtccatccgttccacgctcggcgcgatcgcgaagaaactcgactcgtcggcagcgacggtgaaggagctgatcacgaagctggagacgggcgggaacgccggtgacggcaacagcgatggtggcgacggtgacaacgacgccgattcgggcgaatcggacgaactacgtgcactggccaccgccaacgcgtccacactgtccacgctgatttccgcgcccgtcgcactgcatcgcgtctcggtgtacccgatcgcgaactacggttcggccatggcgccgttctatacgatcctgtcaatctgggtgggtgcgatcatcctgtgcgccatgctgaaagtgacaatttcggaccgcgagaaggcgcatgtgctgggcttgggcgacacgctgccgcgcatcgccggcccgtccggcccggggaacgcctcacgttggggactgcgtctcgaccacgagtatttcggacggtacgcgatcttcgcgctgctcgcgttgctgcagggcacactggtttgcctgggtgacatgtatttccttggcgtgcaggcgaatcatgcgctgcagttccttgccgtggggtggcttgccgcgctcgtgttctcgaatatcgtgtatacgctgaccgtgtcgttcggcgatatcggcaaggctgtggccgtggtgctgctggtgatgcaggtcgccggttcgggcggtacgttccctatcgagacgctgccgaagttcttccaaatgctctacccgttcctaccgttcccgcacgccatcgatgccatgcacgccgcgatggccggatcgtacggcaatgagtacctgcttgatatggtgtatctcgccttgttcctgattccttcgctgctgctgggattggtgttgcgcaagccggtgatccggttgaacaactgggtgagccgcaatctggagtccaccaaggtgatgtgacgaggcggatttgaacgggctggtttgagccggtttagatcggtttcggctggtacacgtgaacgcgctgcccgccatcatcgacgacctgaaaacccaaagccacgaattcgtcaccatcgaccagccggcaaaaacctaagctagcgtggaggcgtagggcattgtcctgcccagtcacttcccttacgtaccgctgcgccatcccggcgctcctctgcgccgccactaccccacatgtcgcctcctcacgcaccaacaagtgtccgaccccccgaatcagctacccacgcgtcatccggtcaccccaggttgtccgattcgggagaaacggacactcaggggcaccgtgcaaaccacacgttgatcagagaaccggcaaccaccagcacaacaccgatccagaacggcatgcccagcgccacgcccaacagaagcgtgctagaagccgtggaaaacagcggagtcgcgtacgaaccaatcgcaagcgtttccatactgccgtgcaacatgccgtatccccagcacgcgtagccgcccgaaatcgaagcggcgcacgcaatcagcgcagcatatccaccgatgccgggcgccgtgtccggcaaaccgtctcccgaaacgaaatggatggtccacagtacaacggccacacagcagaagaaaatcgtcgtgccgtcgtaaccgccggacaacgacggcgtaaaagtcgcataaatcgcccaaataaaggcgccaacaaacgcgagcacatacggtagggggttactggcgatattgtggaccgcttcctgcatatcaaggctttctccgccaaccgccatcgccacaccgatggttgcgatcaccgcgccaggaatcgctttggcgaccgcaccacgtttgtgcgataccgctgcggtcatcagcaccagcagcgtcggccacaagtagttgacaaggctgacttccacggattgcgcgttcgttgtggccaggccgatcgacagcgagattgacgcctcgtatgcgatgaacatgagtccgcctgcgatgaggtacttgcatggcgcttcgcggattggtttcggacggcgcacaatgaacagcatgacaccaccgacggtgtagatgagcgccgaaccgagcgtggcgccgaacgattcggagaccagtcgcacgaggccggccatgaagccccacaggacgattgcgaacaggccgatgagtgtcgccgcgtgtgatgtggcatggccgagtagcggattgcaggagttgccggtggggtggtttgcgccggaatcggagggggacttctggttcgtgttcacgggctccagcctacccatcgccctccacgagtgtccgattctgcagaatcggacactcctgcaacctgcgatgccgcgaacccgattacccccggaaccgcaccaacagcagagtcaaccaccccatccgacgctgccacaccagccgtatcggcagccaagtccatgcgtcccgcatccacacagcccacgcgtcccgcacctccacggcccgccgacgcgcacacgtcgcccatgaccaaatcatccaacgtcacaccgaacatgtcgcaaagcatcagcagcttgtcacaaacgtcgcgttccacgccaccatcttgcggttgcattgcgattcgcaaccaaattttgcgacgcaaccgacagttgcgcgacgcgaagttggcttcacgggtcttttacgacaatagaaaaacccttgaaattccaacgattccaagggtttcgaatggagcggatgacgggagtcgaacccgcctttaaagcttgggaagctttcgttctaccgatgaactacatccgcaaggtgtgccttttgggcacgagccattagtctagcacgcaacggatgcgtatgcggacacagaccgacatgcgataccaattttccgcaatatcacggagactcaaccacgcggccgctgcgaatagtcgcgagaatatctgccagccgagccgcccgaatcatgcgcgaatccatactgcgttccaaattgcggcccaccggcaccagccatcgcagaacgtccgccttgccgaatatccgccgccgcaacgccgctcgtggcatagccaccggccaaatatccggactgcacgccctgctgacgcatctcctgccccatctgcatcagccgcgcaatgcgatccgaggtcggcgggtgcgtagaaaacagcttggagaaaccttccgccgaaaacggactggcgatcatcatcgcagccactgactgcgtgccggcggtcttctccatcggcatcgcggctgcgccgccggaaatcttgctcaacgcggaagcgagcgcttccggatcctccgtcaacttggaaccgtcttcgtcggcgtcgtattcgcgtgtgcgggagattgccatctgtatcagcgacgctgcgatcggcgccagaatcgcgctcagcagcacacccaacaatcccaagccgccggacgccgaatcgtcgcggtcgtcacgcgaacggccgccgccgaaatacatgagcgagtagccgaggtacgagatgacggtggccatggcggaggcgattgcggacgtcagaatgtcgtggttgtagacgtgcatgagttcgtgtccgagcacgccgcgaatctcacgttcgttaagcgtctgtaggatgccttgcgtgcagcagaccgccgcgtgtcgttcgttgcgccccgtcgcgaacgcgttggggctcatggtgggggcgatgtagatgcgcggcatcggcttgcctgccttcgccgatagctcgcggacgatcttgtatagtacgggggcttcctgctcgctcacctgtcgagcgtgcatgctggcgatcgccagtttgtcggaaaaccagtaggagacgaacgtggagcccaggccgatgagaatgtagtagccgagcgtgctttgactggcgccggtcgcccaccagatgagcatgatgacgccccacatcaacgcgaacaaaagcgttgttttcaagccattgcaatggccgtgcacctgcaatttgccgttcatggccaccagcctaggaattcaggctgggattttgctgtatacaagctgaagggcggatttgcaacatctagaaacatgccacgcaacgacgctacagcatcggccatagacctatctgcggcacggcgagagtcaccccaacttgaaacgtattacccccgcatatcccccgaatgcactgcgtcgagcgtgccgatcaggctggtcagcaaatcgttgcggccgcacgcgttcgtcagcaccgccagcacgtacgtgcccgactacgacatcaccagtccggcatcgttcagcgcgtacaaatcgccttcgccgttgatccatccggccttcgtgtacacggtgtccgcatcgccaagggccgcgtggatgcaggagttcagcgaattcgtcatgtctccggacagccattgcagcgattcgggcgtgatgttctgcacccccgccgtttgcccggcgaacaggaaaccgtatccggcggtccacagtttggccatgtcgcgcgcggaggtgaacaggtacccgccgcgatcacccattctggaagccgcgcccgcctgttcggcccacgtgttgaagcagtcgaggccatacgttttgtacagccagtcgtaagacgcgttgtcggaattgcgcaggacggcgtcgaccttttggtggacggtggcggactgcgcgtcagcggattgggccacgctgttcaggtcgacggtgcccgttgagaacagcgatatcaggtatggcgcctccgccgacgaggccgaatagatctgtgcatcggcgttgtatgcgatcgtgcggccggtcgtgatgtcggcgagcacgaatgatgcggtatatccgtcggcttcgaaagtggcgatttgagactgcacggcggcctgcgaatcggcgcttagcgtgaagccctgcgttgtgatcgtggcgctgccctcgactgcggaaatgccgtccagcgcgacctgcgtcggcgacgagacggcttgtgtctgcgattgcggcgcgctgttttgcttaagcgcgcccgacgtggaggacgtttccgaagacgttcccgaggacgccgctgcgtgggcttcctcttcgagatgcacatcgacaagacccacgcccatggcgaagccgatcaggcaggcgatcaacaggcccacgacggacacggaacagcagtacagtgccttgcgcttgacgtgttttccaaagttcatgccgacttcacaaccttagatttcaatgcccacatccgtttgcgatgatattgcgcaccgcgtttcactggggtcagcctagcgcatggacccgaacttcgggggtaataggtcaaaacgaccgcgtacgtccgattctggagaaacgggcggttgtgcgatcgaaaacgcacgctacgcgaccagtccgccgaaaatcgaccactaaagcggcaaaaactaacgccctgcacgtccgattcagaggaatcggacgtgcagggcgttactagattgcgttaaaaggcttggagttagggtgtcaggaagtcagcactcccaccctaattccagccggcctgattcaggcatgcgccagcgcgcgcatctgctccgggtcgatgaccttcttgtgctcgcggccttccttcgcgccttcggcacgttcgaacgcgtcgaccttcttccagccggcgaagtcgatcggcttgacaccgcgggaagccagcagacggtcgatggattccggatcgcggtcagcggccacgcgaccgccttcggcggccttggacaggtcctccagcatgttggtgacgatgagcagcgcgtcggacttggtggagccgatcaggccgaccggaccacgcttggcccaaccggtggcgtacagacgctcacgcacctgcgcgccctcaccggaggcctccgtggtgatgcggccgtcgccgttcgcgttggccaggtgcgcgcgacgctcgtcgtacgcgatgcccggcgcggtggccggcttgtagccgattgcgtgatacacggcctgcaccgggtactcttcgaattcgccggtgcgagtcatcttgccgtccgcggaagtcgtcgtcttctccacgcgaatcgccttgaccttgccgtccgcgcccagcacttcgaccggagcggaattgaagtggatgtagtacttgcgatccgccgggttgccttcgaaatcggtgtcgccgtcgtcttccatgtcctcggccatctcgcggatggcgaacagctcctcgaccatctgacgggtcagcttgtccttgccggcctcctcgatggtgtcgtcgtccagatcgaagtcgtcctcgttgatgatcagctgcacacccggcagcttctccatctcgcgcagctcctgcacggagaacttggcctgggccacgccacggcggatgaacaggtgcagggtcttcgccttgttggccttgatgccctcgtacacgttgtccggaatgtcggtgcgttccttcaggtcgtcggcgttgcgcatcagctcgcgcgccacgtccatggccacgttgccgccgccgatcacagcgacttcctctgcatcgagcggccattcgcgggcgccggtcgggtaaccgtcgtaccattccacgaacttggcggcaccgtacacgccgtccaagtcggcgcccggcaggccgagcggcttgtcttcgacggcaccagtggcgaacagcaccgcgtcgtaacgttccagcagctcgtcaagcgtcacgtccttgccgaattccacgtcgcagtacaggtggatgtccgggttgtcgagcgtcttctcgagagcggatgcgatgaatttgatggaagggtggtcgggggccacgccgtagcgcaccaggccgaacggcaccggcagcttttcgaacaggtcgatgcgggccttggtgcccagtcccagctcttcgccgagcttgcccagctggcgcaggaaaatatcggaagagtagacgcctgcggggccggcgccgattacagcaatacgaagttcgttggtttcgctcatatgttccagcctaatatattccctgcatttccaacagggggcatacggcactttcttgcgattcccttacttgcctcgcaacgcgcagcccggcccatgtgccggcgcaggagaacgtacaatcgcagaagatcacaatcggtccctcactaaagaaggtccttatcgtaagagggtgggcatatgcgcattcacatcacgtataccggcggcaccatcggtatggtcgagtcaccgaacggtctggttccgggcgccgatatgcgcggctggctgcgccggctgattgaggacgcgcatctggacccgagcttgttctcgttcaccgagctggacccgctgatcgattcgtcgaacgcgacgcccgacaattggcagacgatggcggacgacctgcgcgcgcaccgcgatgacgccgacgcatttgtggtgttgcacggcaccgatacgatgagctattcgagcgccgcgctgtcttacgcgctgaccggtttcggcaagcctgtgattttcacggggtcgcagcatccgctcggcaaaatcgaatcggacgccaccgcgaacgtcacgggtgcgctgaacgccgcgatgagcggacgttttcatggcgtcggtctgttcttcggccatcatctgttcgccggcaaccgtgtgagcaaatcgtcaagctgggcgttcgaagggttttcggcgccgtccaccggcccgctggcacgtaccggcacgccgtggcattggtatgcgggcgattcggccggctccggttgcggttgggcgtcgccgctgccctactcccgtcacgatgtggccgtgatcgacatggctcccggcatttccgccgcgcgattggccgcgatgctcgaccctcgtccggaagcggtgctgttgcgcgcgtacggcgttggcaatgtgccgagcgacgagccaggactgaccgacgtgatcgccgacgtgctgcatgacggcgtgcctgtcgtcatcgcatcgcaatgccagcaggcggaagtgctgctcggccattacgagacgggcgacgcgatcgcccgcgccggcgcgatcggatcgggcgacatgacgctggaagccgcatacgcgaagatcatgttcctgctgtcgcagggcgtggacgcggccgatttcggcacgtggatacgccggaacatcgccggcgaaatctcgcccagctcgatgtagcacggcgcaacgcggttcagcctccgcacggctcgtcgccgcaaccggcgctactcgcggtcgagcagggcggtgagcgcccacaggatgctgaccacgtcgatcgcctcctgcatgaacgcgccgacgaccaccggaatgaggttgaacgcggccgcgaccatgccgataatcgccaatccaaggccgaccagcaccgcctgcagcatcactttcttcgtgcggctggcgatggcgatggcgcgcggcacggaggcgatgtcgtcgttcatgatgaccacctgcgccgattcggacgcggcggtggacgtgccgtcggtcatggccatgccgatgtccgcaaccgccagtacaggggcatcgttcacgccgtcgccgaccatcatcgtcacctgtcgggtcatggattcgccgaccacgcgctgtacgaccttgtcccacgccggctggttttggtgcgcgtcttccgtggcgttcttgacggccgcgaccttgccttcggggaagagttcggattgcacgtcgtcgatgccgacctcgcccgcgatgatgcgtgcggaagcctccttgtcgccggtgagcatggacagtttcttcacgccgagccggcgcagtttttcaagggacgatttcgcgttttcgcgaggcacgtcacgcagcacgatacgcgcggcgagcttgccgtcgatcgccacgtacgcggccatttcgtccggctcgagcggggcgaacagcgagttcacctccggcttcttggaagcgccggcagcggtaccggtcgccgaatcgccaaccgcgctatcggccacagcaccagccgcaataccggccgccgcacctgcgcccagcacatgcgtgaagccggcctcgtcggccgtcacgtacgcgaaacgacccacgcgcacggcatgcccgttcacctcgccggacacacccttgcccgactgttcctcgatgttcttcaccacggggtaatcgcgtccatgccccggcagatcgcgttcggcgcacagccgctgcccgttctcatagcgcgcgtacagttcctgcatggccttctgcccggccgccgcgatgcccttcgacagaatgtgcaccgagtagccttccaccacgccggccatcatcagaatgtggttctcgtcgtacggcgagctgttttcgaacggcttctcgacgcgcacgacctgcggctgcttgacggtaagcgtgccggttttgtcgaagaagatatgcgatacgcggcccaagttttccagcacgtcctgcgctttgataagaatgcccgccttggcaaggcgaccggtgccggccacatacgcgacgggagcggcgatcagcagcgggcagggcgtggccaaaaccagcacctgcgcgaatcgcaatggcgtgcctgcgacggcccacgcgatgccggcgatcgccagcgaaagaatggtgaacggcaccgccagcacatcggcggttttgacgacggtcgggcgcgattcctgcgccgacgacaccagttcgaggatcttctgatactgcgaatcctgcgccaattgcgtggcacgcatcgtcagcgcggtcgatccgttgaccgcacccgacagcacgcgcgcgcccgcatacacttcgcgcggcaccggctcgccgttgatattgctcagatccaacgtggcgacgcccgacagcagttcgccgtcgaccggcaccgtttcgcccggcagcacgaggatcacgtcgccaagcttgacctggtcgaccggaacggtttcgaaatgctcgccggccgcgtcgtaaggcttggtttgggtggtggacttattcgtttccgcagcgttaggcacatccacactggcgaccttgcgaaagccgtccgccgtcatgtcgccctcagcatcaccggcagtaccgtcggccccggcagccgccgcacgtgcacccacgcccggcaacgtcaccacgtgcgcggtccgcggcgccgcatcaaccagcgccgtcaggttgccttccgccttcgactgtgcgaattcctcaatcgcctcgccggaggaaatcatcagcaccacggcccacgcagcccagtattcctgcaccgccaccgtcgacgcgatcgcaataaccgcaagcaaatccacaccgacgtgaccgtgccgcaaatcgtcaatcatgccgatcacagtcaccacaatcgtgtacacgaccagcgcgatcacgatccactgcccgacacccggattgaacggtccgaaagtcagcgagacgcccgcagcctcccacggacgccacgaacccagcaatgccaacggaatcgcggcaatgatggcgatcggcagcagcggaacttctttgcaaatggaaatgattctacgcatgagaatctccttacgctcgtatcggacgccttgttaacccatcggcgccccgcctgcgcggaccctcgatacacggcgtaaaaagatatttccagcataacagagcattgcgattgccgcggccgtttgcgtgtgcttccgttcgtcgcgcgcgttccgcgcatacgaaaagggccgtgcgattgctcgcacagcccttgttttccgtcgtttttcggcttgttcagcgttttccgcgattacgcggattgcggttgcggcttcgccgtcagcctatcgggtggcagccacccgtatcgctgtcggcatgaacgccgcacaccgtacgttgccgtacgatgccgcgcatccggctttaccacagaccgaacggatcgaacaggccaccgccgtcgccgttgttgccgttaccgccattctggccgttctggctgccgccattctggccgttgccgttatcgtcgttgccgttgttctgctgacgctgttcctgcttgttggaggagttcgtcttggtctcttcctggtcgagcgtcacttcgagatccatggtgttgccgccgcgcacaacggtcagcttcaccttgtctcccatggcggaggcgcgcacgtaaccgagcagcgagtagttgttgttcactgcctttccgttgaacgccacgatggagtcgccggccttcacgccggccttggacgccgggccaccgtcggtcacggcctgcacctgggcgcagccgcgggtcacaccgtccgcttccaccgaggagctcttgatggtgatgccgagcgccacatgcttcacggaaccattgtcgatgatctcgttggtcacgcgcttgacgaggttcgacgggatggcgaagccaataccaatcgaaccggcagtaccggacgagctcgcagtggaggcgatggacgagttgatgccgatcacctggccggccgcattaaaggtcgggccgccggagttgcccgggttgatggccgcgtcgatctgcacggcattggtgacgatggcgttgttgtcatcatcggtcacggtcaccgggcggttgagcgcggacacgatgccggtggtggcggtgtcgtcgtagccgagcggattgccgatcgccatgacggcctcgccgacggcgagattgtcggaatcggcgaattccgcgactttcagatcgctcggcggattgtcaagcttgatcacggccaaatcggtggtggtgtcggtgccgaccaccttcgcggaatagacggcgccgctggcgagcgtcacctgaatctgctgcgcgccggaaatcacgtggttattggtggcgatatagcccttgtcgctgatcaccacgccggagcccttggcttcgccgtcgctggtcgccacgtcgatggccaccacggaatcggacacttccttggccaccgcggtccaatcgaccgccgtaccggacttcgccttggcggaaccggaaccggacgtgttggacttgacgtcggacagcgagctggaggtcggcacatgcacccaaccgttggtgatcgcggtgaagccgacgccgaggcacagcgcgccggacaccagtgcggccacaacggcggtgaccacatggctggtcatgccggacttctgcttggtgacgaccggcgtctggttcggctggttcgggaagccctgccccggagcgccgaacggattgcggttgcccggtcccgcagggggcatgttcgcgccgtactgcggctgctgctgattgttctgctgcgcgccgttctgcgcggacgagccgccaaacggattgccgaacggattgccattgttccgctgattgccggtcgtatacgggttgccgaaagcgccgaagaacgacggacggttgtcctgcggctggccctgctgctgcgcgccgtactgcggttgctggacggtctggccgctggcatcgccagccggcggcgtcggcaccggaccgtacgcgccgtattcgggcgccggacggtactgttcggtcggcgcatcctgcgtcgcgttgttgatcaccgtgcgttcaccggcagcggaagcataatccggcgtatcgtcagcggtattgcctgccgtgccatccgccgcgtccacggtaggaagggcggtggtgggctgctcgcccgcgttcggcactgcaatcggttcggtaacggaagtctgtgcttcgtcggcgacgttctcgctcggcgtctgcggcgcggtctgctgcgtgccatcctgcggctgggcgatgttctgatcgctattatcttcagccattgttgctccttattcgtctcgcggcattcaacatgatcagcaatcgtgccgctcgaactgctatctaagagtaaagatacctgctctggaagtttcctgaatgtttgttgaaagtagcaatcgaatcgcttggcagtttgctccatacgatgccaccgtcgaccgccgatggcgccaccgcggcaatcggcgctatcgcatacagttgagagcatgacaagcttgaacgaaccacagaccggcgcggtggcgcacgagacctcagcggccaacgcggcagcccgcgcaacgcacgacgcagcaggcaacacgaccagcgcggcatcgaccgaaaaccttattgagcatccccgcggcgcggaacccggcaagcccggccgccgcgacgcattttactttgagcagaaaacccgcctgccagatgcggctgacggtaagggacgcggcggcgcacgatacggccgcaccggcatcatccacaccccccacggcgacatccacaccccggcgttcgtgccggtggccacgcaggccgcgatgaaagccgtgctgcctgaaaccatgaaggatctcggcgcacaatgcttgctgtccaacgcgtttcacctgtatgaacgtcccggtgaacaagtgctcgacgaagccggcggccttgccaaattcatgaattggaacggtccgaccttcaccgattccggcggtttccaagtgctttcgctcggcgcgggcttcaagaagacgctcgccatggatgtgaccggcatgaaatcagacgacgtgatcgccgaaggcaaggagcgcctcgcgttcgtggacgaggacggcgtaacgttcaaatcgccgctcaacggctcactgcaccgtttttccgccgaaatttcaatgggaatccagcataagatcggcgccgacatcatgttcgcgttcgacgagctgaccacactgatgaacacgcgcggctaccaggaacgttccgtggaacgcacctaccgttgggcgcaacgttgcgttgccgagcataagaggcttaccgaggagcgtctcggcaagccgtaccaggcgctgtatggcgtggtgcagggcgcgaattatgaggatctgcgcagacatgccgccgagcagatcgcttcgcttgatttcgacggcgtcggcatcggcggcgcgatcgaaaaacgcatcatcggcgacacctgcgcctggatctgcgacgcgatgccggaaagccgaccacgccacgtgctcggcatcgccgcggtcgacgacatcttcgcctgcgtggagaacggcggcgatacgttcgactgtgtggccccggcccgctgcggccgcaacggcgcgattttcacgcgccacggccgttacaacatcaagcgcgcgcagttcaagcacgatttcagtccgcttgaagagggttgcgattgctacacctgcacgcactacacgcgcgcctacgtggaccatgcgttgcgcgcccgcgaattcaacggtttcacgttggccacgattcacaacgagcacttcttcgtgaagctgctcgacgatatccgcgaatcaatcgacggtggctatttcaacgaattccgtgacgagacactcgcgaagttctacgagaacggttcgaagggctgagtgtgaaccaacgcgacgccgccgctgattcatcagacgttccttccagctcgtacccataaaccatgcatagaccatgccagccccacgtgcggaccgcgcgtcccgtgcacctcacgcataccccacggatgtccgattcgggagaatcggacacgtaaagcgcattccgcgctgatgatctccgataaatggaaggtgctgatcctgcgtgatctgttggacggcaccaaacgattcagcgaattgcgccgttcggtcggcagtgtgtcgcagaaggtgctgacggcgaatctgcgtcagatggagcgcgatggattggtgcatcgcgaggtgtatccggaagtgccgccgcgcgtggagtattcgctgacggaaaccgggcggacgctgcaaccgattatcgaggcgatgaaggactggggcacgcagtacaaggctgaacatgccgcctaatccggcctcttcactcccatttgccaatcgcgacacgccgatttgttacttaggatgaagcggtgtaaatttgtcgattgtctgcgagcgtggcggaatggtagacgcgctgtcttcaggtggcagtgagtgtatgctcgtgggggttcaactccccccgctcgcacgggccgaaaagggctggaatccaacgattccagcccttttgctttatccaaaacgtatgaaatgtgacaaaaaagtactaaaaatgcgccgaaagcccagctatctcagcagaaacagacaaacggacatccaaacccaaaaccagcaccacaaatgtccgattctccagaaaacacaatccgaataaccaattcggcagaatcgaacacatagccacccaaaaccacacttcacgtgaccggttggaaaaacagatacgtaacgcattgcagaccaatcccatgcgtccgattctgaagaaaaacgaaattcgccgtacgacttttccgcgcacgcaatcgcaagcatttcccggtatttcactgtgagcataaccgcggaatgagcaggacacggaagagttgggtgaagtgaaaggtcaaggtcaggagcccgggagggttccggatgcggcaacgaacccggtcgccgatctcgctggatggtgacgccgcagcgataatcgcacggccggctgccaagccgcattactccgcgcacagaacgcgcatttgcttaaggagtaccgattatggcaatgtttccggctttgatgaatgacacgatgttctccgatctgttcgacgatccgttcttcgagggttggcgcaacatggaccgcgcagccgcatgcgatccgaacatgtccgcaggcatgatgagcaccgatgtgcgtgagaccgacaagggctacatggtcgacatcgacatgcctggcttcaagaaggacgacatttcgctggacctgcagaacggctatctgaccgtttccgcgcatcgcaacagctcgcacgaggacaaggacgacaacggccgctggctgcgtcgcgaacgctacgccggctcttgctctcgtagcttctacgttggcgaggacgtgaaggattccgacattcacgccagctacaaggacggcaccctgtgcctggaaatgccgaagcccgaagcgcagcagcaggttgagaccaagcatcagattgcgattgaaggctgattttccagctgccgtacgtcatattcgcacgtcgtaagtcacggtaatcgctaagcaaagcgaagccggacgcccgtaagtggatgtccggcttttttgtttgtccgcacgccgccgcccgaaaagcaacgcccgtcacggcacttaacgcaccaaaaacaccatgatgagaatcatcacgaatccaaccaaatcggtcggttcgaacaccgcgtccgtccatgccaccgcggaaatcgtggccatcaccggttcgctggtgccgagcatggtggcacgcatcgaaccgacgcgcaccacgccggccatgtacagccagaacgcgccgaatgtgccgccgatcacggtgaacgccatcagccccacacccagccaatccaactgcggcgccgtagcccacggccgcacgaacggcagcagcacaagcccggaaatcaggaacgcgatgccattgacggtgaagttgccccaacgttcgatgagcttgaccggaagaaacaccatggccgccgtggacgccgcgttgatagcgccccaaatcaggccgaccaacggcagtttcagcgtggtgaagtcgccgccggtcgcaatcagcacggttcccgcgaaggcgagcgccacgccgatgccttcccgtacgccgggcagtcgccgcccgcgcaggcatacgacccccaagacgaacagcaggttcaggctttgcagcacggtcgcggtgccggagttggtccagttgatcgattcgaggtaggcgacctgcaccagcagcacgcatatgatggcggtggccagcagccgcggatatgatttgcgatcgcgtagcgcgccggtaagcagtttcggcgtcatgatggccgagcaggtgaggaaaagcacgccggctgccagttcgcgcacgcatgcgatccacagcggcgaggcatgatacgtgcccatgaggattttggagacggtggcgttgacgccccacagcacgccgccgcacagggtcattgcgatgccgataatcaggtctttcggcgtgcgttcgaacgttttttccgccactgcggctccttccccttcactgttcgctcatcgcacaccgtacacgccgcatgtgtcttgcagtggcagccgctcacagactgtccgcgggcgcgctgaggaagtcgagaatcttgttcacatacggtccgaccaccgtgttcggcatggagaagatctcgtgcaacgacttgccgtaccgtattttttcgattgatccgccaccttcgcgcacgcgttccacgaaatcgtcctgcggtccgttgagcacccaaatgtcgcgtccggcttggaacagcagcatcggggtttcgattgcgccgcacatgtccggtttgagtatggcgcgggacagcgccatcgcctgatgcgcccattcgaaggtggccgcgttggtctggcatgccacgtcgtcgacgcgctgcttgtggaaccagcgaacgcgcgcctcggacgcgcccttatgctcgtcgagatcgagttcgggggaaaaatcggtgtgaccgaatacgcgcgctttgccgaatcccaagccgcacaacgcgcctgtagcgatgcgtgcgatccatgtcggcatgccgacgacgggggcgatcatgggtgcggacagcacggccttgtcgaacaggctcggatagtgttccatcacggccgcgccgatgccgccgcccatcgaatggcagtacaggttcagtggctcgccgcacgcgtattcgcggcccacagtgtcggcgaaggctgcgaaatcggccacgtaccgacgccaatcgtcgatccacaccaggctgggattgctcacgtcgtgtgcggaatggccgtgcccgcggtgttcgaggatgcatacggaatagccggccagcaggaaataccatgccatctcgctgtattttcgcgcgaattcggtgaatccgtgcgaaatgacgatcgcaccgcggaacacgcccgaagcgccgtcctcacgcagcgcatcgaatttggccgcgtcgtaacagcaatagtgcaaccggccgggttcgtccagtttgggcagcgcgtcgccgttccagtcaacggtggctggatccatccatccttccgtcatgcaggcgtccagcgcgggcagcaccttgctttccatttcggcgtcgtaattcgcctcgtcgagcagcctaagagtcatgctttcatcatacgaatcccacatgaacagccttcagagccccacgcttcggctccacggatcgaacgcgcctcctcactcgtggacgcgctcccccgtacaatgtcggtatgaaaatcatgtcattgtgtgtgtcattcgtcatgctctgcaccatgcagccagccggaacgatggccccttccaacgggaaggctgccatcttcgtcgacgcggcgagaggaaccgcatccgccatcatcgactgcccgccgccgctttactggctgtgtggaaaatgagccatgcgatgaatcccacgaaatccgcagcttccataccaaaaatccaccgtgtagcgctggtcgacaacgatccgcgcgcgttggaatcgctgagccttctcatcgaagcgaaggtccccacggcctacgtggtgtggacggccacttccggcgacgaagcgatcgaacgttgccagaggaacgacgacaatctcaacctgcttgtattggacatgtccatggagggcttgcaggggccggccatctgccatcggatccgtctcatggacaggcatctgccgattctgggcatcaccagcttctccatcaacagctaccgtagcaggctgatggaagccggagcgcagggactgatcggcaaggaggattccgatcagctggcgaaggccatcgagcggctctgtggaggcaacgttatggagggattcgaacctcccgccctggccaacgtgcgcatcagacgcgaggaggagacctcaccgcggctcaccgtgcgcgaggagcaaatcatctccctgtgcgccgacggcatgctggacagggagatcgccgaacaactggacatctccgaaagcaccgtgcgcaagcatatgcagggcattctcaagaagctgaactgcaagacggcacgccaggcagtggcattgtgggtgagatcgcatgcacgctgaacccacaaaacccagacccgtaagcgccttccgctcctggcacaaccatatgcgtgccgaccatccgaaactctggcatccgatccgcataaccatcgtggtcatcaccgtatggtggatcctgttctgcctgctgctcgccccgaccgacaatcccgcggcgatcgtctggaccatcatcgaaatcgcggtgctgctgctgtcaccgttctttccgaaatcgatgtcgctgctgtttctgatcatgagccagtcgggaccttggctcatacccggagccgacgtcaattcgctgccgggaatcctctacacgttcggcatgctcgcctacgaaaccaacaaccttgtggcgctgctgctgctcgcttattccataggcgaccagctgttccgtcaactggtccttgatacgagccgcagcaatcccgtggccatcatcgccatggtcagcctggtactgatgctcggatgcggtttgcgatggaacgcgaccatgaccgccagccgcgcggaggcggagcaggcgaagacgcgattacgggagatggaaagccgcaaccacatcgcggaagccatacacgacgccgtgacgggagatctgtccgccgcggctttcgtcgcgcaacgtcgcatcgatgcattgtccggcggagacgatggcgatggcagcgcctcgacggatggtgacgacggcaagaacgcggacgaaagacgcgatgagctcgacaaatggacgcaggtcaacgattacatcctgtccgccctgaccaacgtgcatcgcgtcatcgacgaactggatatggacgtcaccgtccttgaggaggatgcggacggcaaggccttctccgacctgctcaaagccacgatggccgacggcgaccggcgtctacgcgcgctcggcttcgacatcacctcgatcctccatgtggcgggcggtgcgccaagcgcctccccgagcctggccggaatcgccaatgatctgcttcgcgagacctacgccaacatcgcgcgtcatgcccagtccggcagcaaagccgacctgtcggtgatactcaagccgaacgccgtcgaaatcacgcagatcaaccaggaaagagccttcccgacggagggcatgcgtccaggaggccacggcctcgcgtatttcggcaaacagctcgaatcgcatggcggcaaactcgaaacgacgcttcacgacggcgaatggacgctgttcgcctatctgccgattccggtgcccgaaaccctgccaccccttgccggacaccccgaatcgtgaccggctccgacggtcgcgagaaacgaaagggtacttcaaagggtgctacacagatgtggtacacccttacttgcagaggtgcccgtcaccgtcctatcttccctaatgagaagggatatgcgtctccctgtgacacgacggatacttggcagtccgtcgaatcgcagggggacgcgttctttttttcttcggctttatcggaacgatggttttaccaggacggtggcttcaccggaacaccgtcagaccagcgcgtcggcgaggaagtcgcgttgcaacagcaacaggttgcgcgccaccgtctcgtcgttggtcatgtgcgtgatgccgttgagcggcaggaacgtgtgcttcctgccggccgccatcagcgcctggctcaatcgcaggctattggcgatcgtcacattgtcgtcggcgaaaccgtggatgagcataagcgggcgactgagtttcggcgcgtccgcgacgatgctgttacgttcgtacgtggccgggtcgagtcccaggtagcgctcggtgtaatgcgtgtcgtacagcgtccagtcggtcggcggggcgcccgcgcaggccgcggcgaacgtgtcgggcgcgtccagcacggcgagcgcggacaggaagccgccgtaggaccagccgatcatcgccacgcggccgaggtcgggtttcggcacggcaacgccggttttggtggcgatcgaggcaagcgcgtcgggcagcgcgtacacggcgtcgacctggtcctcaagcgtcacggctttcatgttttcgtagatcgcgcgatcccacttcggtccgcggccggtggtgccgcgaccgtcggcggtgaccacgatgtagccttggtcggcccaccactgcgcgtcccagtagaacgactggctttccacgacctgctggaaaccggggcctccgtaaggcttcatgaggaccggcaactggtcggcatgcgcgtatgcgctgtcggccgacggcaggatgaccgccgcgtacagggcgcgttcgccgaggcggacgaatcgcacgttcggcatgaaaccgggggtttcggcgtggttttcgatcggcgaaaccaccatcgacatcatgtcggcggcgtcgacgccatcaccatcaccgtccgccgtgcgcacgttcatgcaatgctgcatctgcatcgcggcatcgtccatgccacggccggtcaccacgcaaccgtcgccggcgcggctcatcgtccactgtccgggaacgtaggtgagcggctcccatgtgccgtcgtaacggatcgagaccacgtcgaagctgcgggcgtcgtgatcgtccgcgttggactgccacaggaacggcagatcggcagccggcagcagttccggcgtgcgctgcaccacgcacagcacgtcgtcgtcggtcacgtcgagcacttcgcgcacctgcaggcccttgggtgtgaatggcgtgccgtccacggtcaggcggttggtgtcggcgtccatgtcgttcatcgcgcacacgagacggccgtcaggcgtgtatgcgggggtgccggcgatcaggtcgagccagcagtcgttgctatgttcctcaagcacgcgcgtggtgccgggttcttcgccgggcgcgtattcggggatggcgatggagaaggtctccacttcgctgccgtcctcgtcggtgaagccgttttccggcgcgctcatggtcacgataggctcgcccacgtggacggcgagcacctggtcgtgctgctgaagccggtcctgcacaagtagcagcggctcgtggccttcggtccagctgacggcggccaggtattcgtacgattcgcggtcccattccacgttgtgtgcgatgccgccgtagtagcagccgtccgtatcgtagccgagttccagcagcgtcagatgcacgtcggcgttggccgtcatcgcctgcggatagcggcgggcctgcgcgggtttcgtcggattggccgggtcggcgatgtaccaggtctgttcgtgggatgcgtcgaaggtttcgaagagcacatacttggaatcgggcgaccaccagaagccgtcgtaacggtccatttcctcacctgcggcgaattcggcgagaccgattttccattcgcctgcttgcgattcggccgcgtcgctttgcgcgtcatcttgcgtgccgtcctgcgtatcggcaacgtcgtcagcgtcgtcttgcggaacggacgcgacgatggacaccgcatcgcccgcgtcttcgcctgcgtccgtcgtgtccgacacgtccgcaagatcgacgtccaccaaatacgtgccggtcgtatacatgatgtgtcgtccgtcggggctgatgcgcgggttcagcaccggcttgaattccggttcgtcgatggcgatgccgcgcgtcacgccggccgcgatatccgtcaggaacagctggccgttgatggtgaacgccacgcggttgccggccgcatcgaccgaatagccgacgatgccggaaccaccttcacgcgcacgttcgcggcgcgccttttcctcagccggcacatcctcggcgtcggcgtcagccagcagcgtacgcggatcggcaagcagaatctcgtcggtatcgccatcgctgccgatcacgctcatccacagggaggtgacggtgtcctccggaccgtccgaacgcaggaacagcgcacgcgaaccgtcgccgatcgcgcgggcggaacgtggcgcgccgcaggtgaatcgcaaggtacgggccttcagcccaggaaactcatcaatcgcatcattcataccttccaatctaccgaccgtcacgcaccactcgccgccaataccccggacgcaatccccttcacatgaaatttttgcaagcaagtagccttcgaattggcgctcggcaggctacagcgtaggatagtcaaggacagaaagggacaagtatgagtgttctcgaccgatttgagaagagcgtggaaggcgccgtcaacggggttttcgcgaagttcgggtctaaagacctgaagcccgtcgacctttccagcgctctggaacgcgagatcgacaaagaagccatgcccgtcacgcgcgatcgcaccgtagccccgaacgagtaccgtttcaagctcagcactccggatttcaacaacatcgtcgagtggggcgccgaaacgctcgccaatgaacttgccgacaacctcacccagtatgcgaagagccagaactacgcgttcgtcggcccggtcgtggtgatcttcgaagaggatcttgaactttccaagggcgattaccggctttccagcgaatccgtgcagggcaacaccgtgccggtcacgaccgacgcgcagaccgaggattgcccgatgctggagatcggcgagcaccagtatctgctcaccgaggaaaagaccatcatcggccgtggttctgattgcgacatcgtcatcgacgaccccggcatctcccgtcgtcacatggagatcgacgtcaccgacaacggcaacaccgtcatcgcccgcgacctgaactccaccaacggcatgtacgtcgaaggccatcatgttgaggcggcaacgctgctcgacggcaacacgatcaccatcggccgaacccgcatcctgtactgggcctcctcgcaggagcaggagtaatcagccccaacctggagagccgccttttatgctcactgaattaacgtttgcgatcctcaagtacgggtttctcgtactgctctggatcttcgtggcctgtacggtacgttcgctgtacagggatatcgaaacgctcagcccgcgcaagtcgcgggctcatcgtcgtaaggagcgtgccgcgcgcaaggccgtcgaatcgcctgcgcccgtagccgccgcagccccttcggcaagcgccgcaaccaatgccaaaccaactctgctggtcattatcgatggcccccttgccggcagttccgtccctctggccggcaacaccatcacacttggccgttccgcttcgaacaccgtggtgctggatgatgaattcgtttcctcccaccatgcgcgcgtctacaccgatcccgccaccggccgttgggccatcgaggatctgggatccaccaacggcaccgtcgtcaatcatcaacgtctgaacgcgccgatgattcttggcgcgcgcgtgcctgtgcgcatcggtgcgaccaccttcgaattgaggtgacgtttttgccgacttccaccgcttcgcaacaattgttcatgtattccaccgtcgtctccgacgtgggcaccgtgcgttccaacaaccaggattccgcgttcgccggcgagcatctcatcgccatctgcgacggcatgggcgggcatgccggcggcgacaccgcctccaccatcgccatccggtcgctggcgcacatcgaacaggacaatgttgacggcgatgtgcaggtcgtctcccatatgatggcgacttccgtcatggccgcgcacgacgcgatcgtcggcaaagccaagcgcgaacgccgtcttgccggcatgggcaccaccgtcacgtccgtggcgctggtcgccggctgctgggtattggcgcatatcggcgattcccgcgcgtatctgctgcacgacggccgtctgatccgtatgacgagcgaccacagctacgtgcaacacctcatcgacaccggccgtatcagcgaagccgaggcacgcaaccatccgcaacgcaacgtggtgatgcgcgtgctgggcgatttcgacatcgattcgcgccctgacatcgccatccgcaaggcgcatccgggcgaccgttggctgctgtgctccgacggcctgtgcggtgtgctggaggattccacgcttgaagaagtgctgtccacctgcgccgatcaggaggagtgcgcgcagcggctcgtatcgatggcgttgcgtgcgggcagcaccgacaacgtcaccgcggtgatcgccgacgcgacgctcgcgctcgacgcggacgcgttcgacctgcctcatcagacgccgctggtcggcggcgcggccagcgcaagcttggaaaccatcgcggacatcgtcaacgaaccggtcgcttccgccccgcctctgcgcgaaggcaagcagtcgccggcggcgcgtgccgcggccctgcgcagcggcaaggatcccaacgaggagccgaaacagccggaacagcgcgtcgctcagccgtcgtcggtccgcgaagacaatggcgaccgtgtcaataccgataccggggaaattccgattgtgcagaagcgcaacgggcgtatttctgccgatccgaacgatccggaagtcgccaaggcgattcgcaacgaacatatcgaggaacgtaagacgaaacggtcgcgcaaattccgcaaccgcatcatcaccatactcatcatcattctggtgctgcttggcgttgccggcgtgggcgtgggcacctaccgttggagccaaaccaagtactacatcggcgacaacaacggcaaagtggcgattttccaaggcgtgccgacgagcatcttcggtgtcaaactgtcacatgccgtcaccgacaccaatatgaagaccagcgatctgccgccaagctggcgcgaacagcttgaccagggcatctccttcgacacatacggcgaagcgaaaagccatacccgtctgatcaaaaagcagctgaacgatgcgaagcgcaagcaagaggcgaagcagcaggagaaggccgaagccgagcagaaggcgaaggacgaagcagccgccaagcagaagcagcaggaggaagcggcgaaaaaggccgccgatcaggccgcgcagaccaacaagtcgggcggtgacaagtcatgatcgcaacacgcttgagacagcttggcatgctgctgttcagcatgctgctgtgcgcggtggcgttcttccagatgtttgaacgcaccacgaacggcttcccacaaaactatgtgtggatgctcgcgttcgtaagcgcgctgttcctgaccgcctggggtctgctgctgcgattccagccgcacgccgaccaatcggtcatgtgctgcgtgctggtattgacgggcatcggcgtcacgatgatcgcacgcctcgaccaagacaccaaaaccacagtggcgttccgacagttgctttggttggcgatcgcactggtgtttgccaacctgctggtggtgttcatgagggattaccgcgtattgcggcgattctcgtacgtcagcatggtgatcggcatcgtgctgttgctgtcgccaatgctgccggtggtcggttccgaacagtacggcgcacgcatctgggtgaagattcccggcttgggatcgttccagccgagcgaattcgccaaactgttcctggcgttcttcttcgcttcgtatctgttcgaccatcgcgaccagcttgccgtcggcggaaagaagattctcggcatccaactgccacgcatcaaggatatgggaccgatcatcgtggtgtggatcgtctccatgggcgttctggtcctgcagcatgatctgggcacgtcactgatgttcttcgccatgttcgtgtccatgctgtacgtggccaccgggcgtaaaagctggatcgtcatcggattcatcgccttcgccgccggcgcggtggcggcggcaagcatcttcagccacgtcggctcgcgtgtggacgcctggctccacccgttctccgcggctcaatacaacaaggaatacggcggctcataccagctcgtcaccggcattttcggcttggcttccggcggtctgatgggcaccggcctcggtcagggccacccgtcgatcaccccgatcgcaaattccgactacatttacgcggcattgggcgaggagctgggattgaccggcctgatggccattctcatgctgtatctgctgatcatcgcagccggcatgatcaccgcgatgaaaatcaaggacggcttcggcaagctgcttgcgtccggcttggtgttcaccatggccttccaggtgttcaccgtggtcggcggtatcacgctggtcattccgctgaccggtctgacgcttccctacatggcggccggcggttcgtcgctgatcgcaaactacatgctggccgcgctgctgatcgtcatctccaattccgcgaacaggccggaatccgagatcgacagcgacacattccagcaggaagccgtcagggtgttgcgcgaacgcgagcggaaccgtcgtaccgaaatcgccggcaatacgcgttcgggtgcggcgaaggcttcggccatcccggccgtgcgggcaagccatgcgggcgcagccgggcaagcaggtcatgccgtgcccgccaatcgaaccagccaagccggccacaccagccaagccggccacaccagccaagccggccagaccgatcaatccaatccgacgattccgataaccggagtcctgccgacgatcgaccagcaaggagcatcgcatgaataagtcgctccgccagctgttcaccatcgtggtggccttattcgtcattctgggcatgtccaccaccatcatcatggccatccgagccaaccagctcaccaacgacgcacgtaacgtccgcgcgctgtaccacgaatacggcgcaccgcgcgggtccattctcgccgcggacggatcggtcatcgcaaaatccgatccttccaacgattcgttctcgtaccagcgttcctattccgccggcgaactgtatgcgccggtcaccggattcttctccatcagccagcgtggctggagcggcgtcgaagcgtcccgcagctcgctgctgtcgggccagtcggagcagctgctctggcagcggttcaagtcgctgttcaccgggcaggagaacaagggcgccaatatcgaaacgtccatcgatccgaagattcagcaggccgcatacaacagcctcggcagcacggatggcgccgcagtggccatcgagccgaaaaccggccgtatcctcgccatggtcagcacgcccagctacgacccgaaccagctggccagccatgacatgagccaggcgaacagcaactacggcgtgctgtcccaggacgccaccaatccgatgctcaaccgagccacttcgcagctgtatcctccggggtccacgttcaaaacggtggtggccgccgcggctttggaaaccggccaataccagccggatacgcagattccggcaggagcaagctacacgcttcccggcaccgtcacgcaactgaccaacgccgtaccgcaggccgacggcgctgacggcaagatctccatggaggacgcgctggcatattcgtcgaacaccgcgttcgcccaattgggcgtgtcgttgggcgacaacgccgtctcgtccatggccaagaaacttggttttgacagcccgatcaccgtggacggttccgattacaccggaaccccgtgggtgtcggtcacgtcgaagttccccaccgacatcaacgacgacaagctcgcattggcgtctatcggccagggagacaccgtggtgacaccgttgcagaatgctatggtggccgccgccatagccaatgatggcaagcttatgcagcccacgctggtcgaccgcgtgcgttccgccgacttgtcggtcatttcgcagaccaagcccacggtcatgtcccatgcgttcagtgcggatacggccaacaagctcacccagatgatggaggccgtggtcaccaaggagaacacgaatctggccatcaacggcgtgcaggtggccgtcaagacgggtaccgcgcagattggaaacggcaatacgtccatcgacggctgggtgatcggattcgcaccggcggacgatccgaagatcgcggtggcggtcgtggtgcataacgtggacctgtacggctcgttcgcggcaggaccgattatgaaagcaatgatgcaggaggcgctggcagaatgaaactggttgaaggacagctcatccaccgacgctacaggttggattcccgcctggcccaaggtggtatgggtgaagtgtggaaaggctatgacatccaacttggacgtccggtggccatcaaggcgctacgtggcgatttgggcgtcacccaggaggccaaactgcttcgtctgcgcgcggaagctcataattccgccaatcttgcgcatccgaacatcgctgcgctgttcgaatattacgagcatgacggcatcggattcctcatcatggaatacgtgccgagcaagtcgcttgcagacctgtaccacgagcagaacggcccgatggacccgatcaagctgctgccgattctcattcagaccgcacgcggcctgttcgtcgcgcattcccatggcgtgatccaccgtgacgtgaagccggcgaacatcatggtgtccgattccggcgaggtgaagatcaccgacttcggcgtctcctactccaccaaccaggagcagatcacgcaggacggcatggtcgtgggcaccgcgcagtacatttccccggagcaggcgcagggcaagcatgccacgccgcaatccgatatctattcgcttggcgtcgtcgcctatgagggcctgtgcggacaccgtccgttcacgggcgccacaccggtcgacatcgccgcagcacatgtcaataatccggttccgccgctgcccgacaccgtcgatgtgcagttgcgtgaattcgtcatgtcgatgttggccaaggacccgctggaccgtccgaaggacgcgctggtggtgtcacgcaccctgtcccgcatcgaacgccgtctgctcgaccagcagacgcagctggccgacacgatggtcgtctcttcgggaggaaggcttccccgacgtgtggtcagcaaaccccatatctccgtgagcaatgattggaaggaacagggatgaacatcaacatgcctacctctctggccgggggccgttatcagctcggccaactcgtcggccgtggcggcatggccgaagtgcatgtggcgaccgacacgcgtctggggcgtaccgtcgccgtcaagatcatgcgcgccgatttcgccactgacagcatcttccttgagcgtttccgccgtgaagcccattccgtcgcgcagatgaacaacccgaacatcgtgaacatctacgattcgggcgaggaaaccgtcaccacggaaaccggcgagatcgagcatctgccgtatctggtgatggagtacgtcaagggtcagaccctgcgtgacatcctcaaggtgaatggcgcgctgagccagcgcgacgccgagcaggtgatgatgggcgtgctcaacgcgctcgaatactcgcaccgcatgggcatcatccaccgcgacatcaagcccggcaacatcatgatttccgagcagggcgtggtcaaggtcatggacttcggcatcgcccgcgcgatcgacgattccgcggccacgatgacgcagtcgcagggcgtcgtcggcaccgcgcaatacctgtctccggagcaggcgcgcggcgaaagcgtcgacatgcgttccgacctgtattccgccggctgcgtgctgtacgaaatgctcaccggccggccgccgttcaccggcgattcggcggtggcgatcgcctaccagcatgtgtcggaagtcgccactcccccaagcacgatcgtgccgggcctgccgaagatgtgggattcgatctgcgcgaaggcgatggccaaggatcggcagaaccgttacgccaccgcttccgagttcaagaacgatctgctgacgttcatgaacggcggtgtgccgatggctgccgcgttcaacccgttgaccgacctgaccaacatgaaggcccgcaagcaggccgaaatggatgccgccaccgtgcccatggcgccggcgacggatgcgccgacgcaggcgttcaacccggtcaccggccagttcgaggccgtgccgaatccgaatggcggagtcgaaacgaagacccgtgcggaacagcgtgccaaggccgcgcaggagcgtaagaagaagcagatcatcatcgcttccgtggtcggcagcatcgttgttttgctggccgtcatcggtattttcttcgcgttgaacgggcataagaacactgcggatctggtgtccgtgccggacttcaccgacacgtcgaacatttcccaggcgcgtgtggaagaacagcttaaggcccttggtctgaagcttgacgcccgtgacgatgccacgtccagccagccgaagggcaccatcaccaagcagaacccgaagggcggtaagaaggtggcgaagggctccaccgtctccgtatggttctccaccggcccgcaggcggtcagcgtgcccgacgtgtccggcaagacgcaggaggaagcgaagggcattcttgaggcggcaggcttcaagatcggcaatgtcatgaccgtggacagtgcctccatcgagaaagacaaggtggtgaacaccaatccggccgcgaattcgaagcagaccaagggcaccatcatcacgctgtacatttcgtccggcatgaccaagattccggatggtctggtaggccaggccaaggattcggtcatcgcgcagctcaagcaggctggtctgacgcagatcaccatcgaaagcgagtattccgattcggtgcagtccggtgcagtcacccgcatcgatccgggttccggcagcaccgtcgaggcgggaacggccgtgaccatctgggtgtccaccggcaagcagcaggtgagcgtgccgttcgttgccaactccacacttgccgaagcaaagagcattttggaggccgccggattccaggtaagcgtcaacgggccacaggacgacgatgcgaccgtcgtgtcgatgtctccgaatggcggcagccaggccgacagcggatcgaccatcacgctgaccaccaagaagtcatccagcgacacccccagcaccgacacaagtaacggcaacaacagcaacaaccaacaaggcaactaacaaaatcaggggagggagcggctcaaagccgctccctcccctttctctttccctcaaaaaacaaaagcagccgaaggcagctccataaagccaaaggagctttgcttcccgcaggtcctgttcacgaccgtaagcttggccgaacggccttgagtgtgtcgtgaacaggacctgcgggaagcaaagcggcgccgcaagcaagcaacgctgcgagccaaacagcagccatcacccatcactcattcatcgcaaaaatcgcaattcagcaagctcaaaaaaagaaaactactcgctcaccttaggctgcaatccaatcgacttctcaaccgcggaatcctgcccgcacaccttcagccagttggccagcagacggtagccgtcctgcgtcatcacggactccggatggaactgcaccgcgtacatcggcttgtcgcgatgcttgatgccctgcacgatatgatcgtcctgcgtccacgcggtcaccaccagctcgtccggcacggaatccggttcgacagccagggaatggtaccgtgtggcgaccatcgggttggcgacgccttcgaaaatctcatcgtcgatatgctccaccaaactggtcttgccgtgcatgatggtcggcgcgtggctcactgtggcaccgaacacttcggccaatgcctgcatgccgaggcacacgccgaacatcggcttgttctgtgccgcgcacaggcggatcatgtcctcgctggcgccggattcggccggagcgccggggccgggagaaatcagcacgccgtcgtattcgtcgatcacgcccggggtggacgggtcgatcgcatcgttacgtaccacggtcactgtggcaccaagcgtcttcacatagccgacaatcgtgtaaacgaacgaatcgtagttgtccacgaccagaatacgtgcggaatcggtcatcatgctccaatcaacgtttgaacagcagtgtacgtgcgttccgtgccgcagcaacgtccgcgtctcacgcagcggcagcctttagatggccgtgtagttcgacatctcctgcaacatcggaatagtcgacgcggcccacgggaacagccattcgaagcacgatgcggccgctgcgaaaaccagcagcagcaccagcagcagacggatcggcagcacgcccggctgcagtcgcaccaggctgccgtacaggctgaaatcggccttctttcgtcttcctgcgcgcacgtcggcgagatacggccatcgccaggcgacggcggcggaaataaatatgatcacgtatgcggcgagcgcgccgaagatccacggtttcagcgtatcgatcgacgacaggaacgacgactgttcgttgttgacgaatttgactgtgccgttggcgttttgggaggccagttcctgtgggatgccgtcggagaccttcgcccagtaggagaattcggcgtagctgatccagcggtgcgtcggcgtggagtatttcggttcgcaggtggtcatggtcagcatgcgtttggtcggtgttgcgccggggttttcggggttggccgccaccacttcggtctgtgtcggcagcacgattttgtagctggtgtagtggtacacgtaccagtaatcctgcgtgcggacgatgatcgggtcgccttcctgcagtttgtcgacgtcgccgagcggctgcccgtagccgttgcgatggccggcgaaggcgaagttgccgatttgtccgggcatctgcgaatccgtgtaatggcccaatccgtgcttgttgagctgtgtcaggtccgtgccttccaccaggttgcgctgccattggctgccgaatcgcggtatgtagatttgggcgatgagttcgccttccgtggcgctttgcggctgtacaggcgggtcaccctgctgtgccttcgccacggtgacgttgccggactttcctggatcggaccaagatacggattggcgggtttcgatctggttatgctccgactgcacgcccgtccaccacatctgccatgcgatgtacagcgcgcagatggcggcggcggtcagcatgagttcggcgaggatgccgagtatcgtccacagcgcgcttttggtgcgtccgccacggcttgccacatgtttcatcgattgttatttcccctcttgcgagtcgccgttcttgtcgttttcgagcgctttcgcatactgcaacggctgctgcaacgcgtcggtcgcgtcgaaatgcagtttcgttttctcgtcgacctgccatcccaggccgaacgcgctcacgtactgcttgtagatggacacttcctcggaatcgtcgagcgcttttctcatgccctccactggtccgatcgccgagattttgaacggcggcgaatacttcttgccttgcagcagcagcacgttgccggagcagcgtacggcggagttgaacaatacgcgctggtccatgatctgcatggattcggcgcctcccgcccacagcgcgttgaccacggcttcgatgtcctgctggtgcaccacgtaatcgttgatgttggcgctggatccgttggcgtcgaccatgttctcccatagcggcgaatcgtcgagcgtcaccaccagtcccgggccttccacggcggggagcatggtgccgttgccggcgctttcgctgtcttgcgatccgtcggcgttctggctgtcgagtgttttgctcagatcgttgactctggtgctcagcgcatcgatttcggaccgtagcgagttcacttttttcacgcgctgttccacgagttcggcggtatcgttgctcaccaccacggaacggttgacgcgcaggttggtggacagcaggaatccggagaacagcagcacgaggaacgccgcgacgccggccgccttcgaccgtttcgcgctgtgctttccggtatgcttcgccatacgcgcctttccaaacctgcctgaatccgccgggtttcactgaacaattgtcctgattttgaacagttttacgccgtgagttcgccgctttcgagtctacccactattatgacttttagcctattaaaggagactatgctgatggctgacgaagagctgcacgaaaccaccgcggatgaccagaaggatctgcagtccgccgacgacaccgctgccgtcgaggaaaccaccgaagatgtcgtcgacaagacttccgttgacgaggaccagtccgacgatgacgatctcgatattcctatggaccgtgtcgaagcggtgctgaacgccaccgttgataaggattcgctgtcaccgcagatgcaacgcatgatgaaccgtcaggcggagaacacccgccgtgtggaggaaagcatcaagggcaccaagtccaacccgcgctggttcgtgccgctgttctgcgcgctgatgatcatcggtctggtgtgggccgtggtctactacctgaccaccgattatccgattccgcacatcggcgcttggaacctggccatcgcgttcgcaatcatcatggtcggttttattatgaccatgtggtggcgctgagtcggttttctccgtttcgcctattccatcgaggcttattcaaaagacgccgggtccattgcgatccggcgtctcttttatccgcttcaaccactttacttaccgcgtctgcatcgccccgcttcagctttaggaaaagcggtttcctgtcgagtggacagccgccgcttacccgccgattatctgctgattttcgccgtccgaatcagcacgtggtcgccgccttgcatggtggtgccgaacagataggcgtcgccgccgtcggcgagcttgagtttcttgcgcaattgcggcgcggtgagtgggaaattacgcacggcgatgttggcacggtccaagccggacagcaatcgcttcagctccttcttacccataccgccgatcgtttcgatcgcaaaaccgcgccccggaaaaccatcgaccggctcgtccgatacgaacaggtggctgctcgggccgatctgcaccgccccgaatcgcgcttccaccacgtcgaagcagccggccttcatgatcgacgcgttcggctcgtacaggtagcgcagctcgtgcggcagcggcgcgtccccgatgcgcaggccgcgcgtataggcggccgcatcgtagtcgagccgctgatcgtcgttcacgcagtacacgtgcggcgcacgcgtgtctgccgctgcggcatcggacgttgccccggcagccttgccgtccagcaccagaagcagttccttgcattcgttgccggtggagacgatgtgcacttcggccacagtgcccgcgaaatcgtcgaccgccttgcgccagtcaagcatcggcgacagtttgatcatcacatatcgcgccttagccagcagcagatcgcgcagcgccagcgcgtcgggcgtgcagtcctcgatcgcgtaggtgcgggcgccgtgctcgtcgcggcgggccgggtcgatgtagatcagctgcgccggctccatcgcacgtaggtattcgacgccgtcgccgcacaccacctgtgcttgcgtgaggcccagcgccgccatattgtgcgcggccagttcgcacaggtgcgattggcgttccacgtacgtggcgtgaccgaatccgcgggcgagatatgagaaatcgacgccgaatccgcctgtcaggtccgtcatggtcgcgtcgttggccgtctgtcccgccgattgcggcagagatcgcaacagacgccgggcgatttcggccttgtattgcgctgtgaactgcgatgagcactgttccatggaaatatgcgcgggatagacgatatccgcgcaggcggcccattgcggcagtttgttgcgggcgatttgccagcccgcgatctggtcgagcgcggccggcaggtcgaggtccgccgtccgcttggttttgagcgccaggtcacgcacgtcttcattgcgatgcgcctcggcgaaggcgcgcgtcacgtcgttgagcagtggtccgtcactcatggttcctctccccttcttcgcaagtatctgccatgtcgcacgcatatcgtcgcacgcgtatcctgcgtccgtggcgcatcggtattgcgtccttgtcgattgccttcgtcatcttatctttcctgtggataacaagtggacaaatgtggatgaatgtggataacgcccatattttgtgcctgagtcaacgtcgcaccacgaaataccggcggcgattttccccatttttgtggggtgtggatatcggttatccacaattttcacataggaaattccttatgttccgccattttgtgaatatccttgtggataatccaccacgttatccccgacttacccacaggtttgacctcacttatccacaaagttatccacggatgtggaaaactacatgtgtgtagttcccgcattactggtacagaagtgacatatgcatcagcggattgccggcgttgcatcccacgatgatcgccacgaccaccacgaacaccgtgatgccgtacaccgtggtgcgccacgtcaggcttttgccgcggaacgcatgcaggccggtgaccagcagccacgcaagcacgccgccgacgatgaatccgccgacatgcgcctgccatgcaatgcccggcgtgatcaccggcatcaggaagttgatcagcatccaaatcagcatcgaacgaatatcgatgcctattctcctgtacaccaccagaatcgcggcgaacaggccgaacagcgcgccggacgcgccatacgcggcggtcatccatcccgacggcgagcacacggcccacaccatcagtccggcaccgccgcccaatccggacagcacgtacagcgcgaggtacggccaatgccccatcatgcgttccagcacgggccccacgcaccacaaagtaagcatgttgaacaggatgtgccacagcgaggtcggctggtgcaggaacatcgaggtgatgaaggtccacgggtgccggacggccgtggcgggcagcagcatgccggcgttcacgaacgcgttgccgccttcgggccagacgaggaagagaaccgcttcgatggcccacaccacgatgcagatcgccatgatggcggtggtgatgaccgggtcgccgttgcgccaccggtatcgcagcgatcgggcggagaacagatccttgaacgatggggaatcgggaaacagactgaatcgttggtatgccatagctcaacactaccggcacatgcggtattttccggcgcgtaaatccacccaatcgacacattccacgaattaagatagggaacagagctggcttgaacgagcaggtcagccagtgtttggaaaccttgaaaggagccgtcatggagaacaagtcttctaacggttggaagttcttcgcactgctcttcggagctttgcttgctggcgtcgtcggtctgtacatctacaagcagcagaatcccgactatgacccgtgggaggaaccgtgggagaacagctcctcgccggtcgacctgggcctgaccaaggacgccgagccggaggccgacgccactgccgccgctcctgccgctgagccggaagccgcctgatttcgcctttcccggcacacctatgccgcgttgggtttgttgcttcgccctgtatcttgcgatacagggtttttcttttgctttttcgattgcgattggcttgcggccttccgtcgtactgtcgctgtattgccacgtacgtccggcacgtacgttcggacactaccggcatacgcaatcggacatgcgaaaaacatacgaaaaggcccttggaaaatcccaagggccttcgtcgtcatcacttatccgcccattgcgaaacggacggagcggaagcgatcatgcgtgcgtcggcgatgccggcgacgtttcatgaccgctccataatcacttgagcggaccggtgtgccagatgcgctcgaggtaatcctcgatggagcggtcggagctgaagtagccggagttggccacgttgagcacggccatgcggctccacttcatcggatcgcggtaggtttcctcgatctgggcctggatgtccatgtacgcgcggaagtcggcgagcgtcatgaagtaatccttgttcagccaatcgttgacgaggtccttgtaggtgtccttgtcgccgtcggagaaggtgccgtcggcaaccatatcgatggcggccttgagctgcgggtccttctcgtagtactcgcgggacagacccttggtgtcgtagcccttggcgtacagcgcggagacttccggctcggtcatgccgaacaggaagaagttctcggcgcccacgcgctcacggatctcgacgttggcgccatcgagggtgccgacggtcagagcgccgttgagggcgaacttcatgttgccggtgccggaggcttccttgccggcctgggagatctgctcgtcgaggtcggtggccgggatgaggttcatggccagctcgatgttgtagttccacgggaagtagacgttcagcttgcccttgacgtccgggtcgttgttgatgacgcgggcgacgttgttgatcagctggatggtctgcttggccaggtagtagcccggagcggccttggcgccgaacacgatggtgcgcggcatgatgtcgtcggcggagaccttgccggacttgatgtcggcgtagtcggcgatgacggacaggatcttcagggcctggcgcttgtactcgtgcagacgcttgaccatggtgttgatcatggtgttcgggtcgatgtcgaagccgtacttgcgcttggcgaagttggagaagtcgaccttgttggcctgcttgacggcggcgaacttcttgacgaactcgtcatcgtcggccagcgggatgaggcccttgagcagctcgaggtcggacagccacttgtcggtgccgaggccttcggtgatgacgtcggacagacgcgggttggccagcttgatgaagcggcgaggggtcacgccgttggtcacgttggtgaacttgtccgggtagacgtcggagaagttcttcagggtgacgtccttgagcagctgggagtgcagctcggccacgccgttgacgtgggagccgccgtaggaggccaggaacgccatgcgcacggagtcgccggtgtagatggccatgtccttgatggtggcctcgtcaacgcccttggccttgagctcggcctcgaactggtcgttgatcctctcgatgatctcgaggtgacgcggcagcagttcgccgatgagcttggacggccacacttccagggcttccggaagcagggtgtggcaggtgtagttgaaggtcttgttggtgatcttccaagcggtgtcccaatcgtagccgtactcgtccatgaggacgcgcatgagctccgggatgccgatgaccgggtgggtgtcgttgagctggaaggtgatcttgtccgcgaaggtggtcagatccggcttgtcctggcccgggtagaagacgcggatggcgtcgtggatggaggcggacacgaagaagtactgctgctcgaggcgcagagccttgccctgcggggtggagtcttccggatacaggatcttggagatgttctcagcctcgacctgcggcttgacggcgtccagatactcggacttgttgaaggtgagcagatcgaactcgtcgtagctcttggcggtccacagacgcagggtgttcacacggccggaggcgtagcccggaaccatgtagtcgaccgggacggcgcgcacggaccaagccggcttccagaccttcttgccgttctcttcgacgacttcgccgccgaaggagaccttctggtcgcggttgtaatcgatgtggccccacggctcttcgttggccagccagtaatccggagtctcgatctgcttgccgttctcgtcgaattcctgcttgaagatgccgtacttgtactggatgccgtaaccgaacgccggcacgccaagggaggcgagggagtcgatgaagcaggcggccagacgacccagaccaccattgccgaggcccggctcgtattcggcgtcgatgatttcctgggcggagaatccgaggtccttgacggccttgttgaactggtcggtcagtccggcgttgagcagcgcgttctcgagctgcttgcccatgaggaactcagcggacaggtagcccacggccttggtgttgccgttgaccatgtcggcctgggtcttcatccaggaatccacgagatggcgacgcactgcggcggacgcggcaacgtacacgtcggccggcttggcctgctcgacggtgacgccctgggtgtacttcagctgctcacgaatctcgtcagcgaactgttccgcggtgaccgcggacttcggtgcggtaatttcagtcattgattgactccctttgacggatactctccaggaacattatgccttacttcagcgtccttgcatttgcggccgcatgaacactaagtaacatcatgcatacgttctcatgtacagcatactacgtaatcataaaaagacgaaactcccagcaatcgtaagccggcattcgtttgcaaaaaacattgcaaaaactgcaacgcaacgtatggcgcccattaagcgagggcaccataatcgcaggaaaatcgcccctcaaacccctatttagttacgactacatcgtttgcaaagtcccatcatagtcgtttgcgggctgcacaataccggtatggctgtcatacgagaacaagacttgggcaaaggacgcgccgccttcgaacagtggcaggacgcggcgcacaacattttcagcgagcagctgccggccgatgacgacgccgctttcgatttccggctcaacttctctccgcgtctgccgcgccagctgtgggcgatggcggtgcgctactcgctatacctgctggaaaagaaggctccgggcgaaggcgtggaggtgcgcgtggcaccgtggggcgccatcaagatcctcgacgggccggcgtccgatccgcacaatctcacgccgccggacgtcatcgaactggaccccgacgtgtggatgaggctcgccaccggcatcaccagctggggcgaggaaaaggacaccgggcgcatcaccgccgtcggcgaacgcgacgatctgagcgggttgctgccgctggcataggaataggtcgcggcgcggcgcgacctgcgatggttggcgggacgagcacgacaatcgcccgacaatcgaaatcgaaataataaaaaatggctcgtggttgaaaccacgagccattcgttgaaaaaatctgtgcagtcagtcctgcttcttcggcttcagcgcgctgggcaccggcatcgggatgggcttgtgaggcttcggcgcggcctttgccgccggaaactcgccactcgtggccttcgccgcggcttccgcggcccacttggcgtattcgtcaaggtcatcggcggaatcggaagacgtttgaccgtccccaacggtctcatcttcggcgtccacatcgtgagaatacttggcttcgatatcggcaaacgggtcgaaggaaccagaaccgggctcctgcgcaccgagctccttggcaagctcatcgtaatcggtgtcggtggtcaggtacttgagctttcgggctattttctgctgtttggctttctgacgtccgcggcccatctgaccccctgaaattactgtgctatcaattcatcaaacaagagagtaccacttattgcgcattatttcgttgtcggctcagacttttacgataaaatcgttgattttcttaagaaaaggacacgtatgacggacgaaacccaggagcagcagatcactgctgtcggcaatgaaatgagcgcgagcttcctcgccgcaaagaagcgttccgatgaaatcctcgccgcaatcgaaaagaatccgggcaagttcaccatgctcaccggcgaccgtccgaccggccgtctgcacctcggccactacttcggctccatccgcgagcgcgtggccatgcagaaccgtggcgtgaactcgaacatcatcatcgccgactaccaggtgatcaccgaccgcgacaccaccgagcacatcgaggacaatgtgctcaacctggtgctcgactacatggccgccggcatcgacccgaacaagaccatgatctttacccattccgccgttccggccgagaaccagctcatgctgccgttcctatccctggtcacggaggccgagctgcaccgcaacccgaccgtgaagtccgaaatggaggcttccggccatgcgctgaccggcctgctgctcacctacccggtgcatcaggcttgcgacatcctgttctgcaaggccaacgtggtgccgatcggcaaggacaacctgccgcacgtcgaaatcacccgcaccatcgcacgccgcttcaacgagcgctacgcgaagaagaacccggtgttcccggagccgagcgccatcctgtccgaagcgccggagatcccgggtcttgacggccgcaagatgagcaagtcctacggcaactccatcatgctgggcgccaccgcggaggagaccgccaagctcatcaagaagagcccgaccgattccgagcgccgcatcaccttcgacccgattgcccgcccgcaggtctccgcgctactgaccaccgccggtctggtgaccggccgcgatccgaaggacatcgccgaggaaatcggcgactccggtgcaggcgcgctgaagaagtacgtgatcgaatccgtgaacgagttcctggccccgcaccgcgagcgccgcgccgaattggccaaggatatggattccatccgcgacatcctgcatgacggcaacaagcgcgcgaacgaaatcgccaatgagacgctgcagcaggtgcgcgacgccatgggcatgcgctactaagtttgcaatcggcatcctgacgcgttagcggattggccgtgttcctccgggagcacggccaatccgcttattcatggcagattcagaggctaccgttctgctaggtggcttatttgtggcatggaaaacgggaaaccccgtgtatgtccgtcggaattccaatggacatacacggggtttcctgaatcaggtgccacaaacaggccacttgacatttccctgttgtcggaatctgccataaacaagcgacatggcaccaaaggccgaccttcggcgttgcaggaggtgcaacacccaccgcggggcgattcagatctgcgagcgcttctcccctgcggcgatttctgcggccacaaggtcgtcgtccacgtggcggtcgtccggatcgtcgagatagtggtcgaattcgtgcagcacttccgcgcttggcgcaggcgtgagcagcgagatcaccacgatgaacagcagcgagacgatgaacgccggcagcagctcgtagatggcgaagatgccaccgagcggcttgacgaggttgtgccagatgagcacggtggccgtgccggacagcatgcccgcgatcgcgccgtacttgttggtgcgcctccagtacagcgaggtgagcatcagcggtccgaaggatgcgccgaggccggcccacgcgtacgagaccacttggaagatcgaggagttctggtcgaacgccaccacgatgccgaagatgaacatgacgagcagcgtgatgcgcgccaccatcatcacctggcggtcggtggccttgcggtgcagcagtccgcggaagatgttctcgccgacggccgaggcgccgatgatcatgtacgaggacgaggagctcatggacgcggcgaagatgccggacacgacgatgccgcacatgaagctcggcagcagcgcctgcgacaccacgatgaagatgttctccgcggccgcctgcgtggcgaactgcgtcggcatcatggcacggccgaccaagccgatgcacacgccgcacgccagcgagatcacgcaccacgtggtggcgatgatgcgggatttcttgatttcctcggaactgcggatggacaggaaccgcacgagcacctgcggcatgccgaagtagcccaggccccacgcgagcatggagatgatggtgatgatgccgtagtcggcgggcgcgccgaacatggcctgtccggccttgacgatctgctcgccggcgtcgttgaggatcggcgtggccacatgcgtgccgtcgaggaatcccggaatgcccttgaggaaggcgacggtgttgtcgatgccgccggcggacgccacggagccgatgaacaccacggccagcgcgaagaacatgagcaggccctggatgaagtcggtcacgaccacggacagatagccgccgatgatggtgtacgcgaacacgatggcggcgccgatcaccatggtcaggtggtagtcccagccgaacagcgtggagaagagtttgccgacggtcacgaagcagctgccgacgtacacgcagaagaatacgaggatgatgagcgcagcgatggtggatacgatattgcgatcgtcatggaagcgcttggagaagaagtcgggaatggtgatcgcgtcgccggccaccacggagtagcggcgcagacggcgtgcgacgagtttccagttgaggtaagtaccaagcgccagaccgatggccgtccacatcgggtcggccgcgccggtgaagtaggcgacgcccggcaggcccataagcagccagccgctcatgtcggaggcttccgcgctcaatgccgtcagccacggtccgacgccacgcccacccgcgaaatactgtttggtggaggaattggacctcttggagtagacgaagccgatggtcagcatggccgcgaagtacaagaccatggccagcagcacccagaaatctttggttaccaagtgtttttacccttctgcaggttattaaatgtcgtagcgccaggatttatcggtcactactcgtgccatcgccaggccgatcggcaggcagatgatcaccatgaacgcacggaacgcccaatcgagcgcgttcagcgtatcgaactggccgaggtggaacatggcctggtacatatacaaaccgggcaccatgatcacaatagacggaaccgtcaggcagatgcgcggatatcccaaatgcggagcaagcaggccgtgacgcaccgccgaacgccatgcggaggcgagcaggccggcaaggaacgcgccgatgaacgcgccggcttccgcgggcacgcccaagtcgacgatttccaatcgcaaagtatcagtgatggcgccgatggtggcggcgacgaggcacatgcgctgcggggaattgaacatcacggagaagccccacacaccgatgaacgcgaacagcatgcgcagcaggcagttgatgacggggttcagtccaagcggctcgaatccttgcggattcaggtgcacgatcgaagcgaccatccagcctgccaacgtggccatcagaatgatgcacagcacgtaggtgagtcgttgcacgcctgatgggaagtcgattttcgccatgtcaagtccgccggttatcagcgggaatccggggatgacgaacagcatcgcgccgatatacgcggtgtcgtgctgcaaggcgatcggatcgaacaggccaatcagtcgcagcatgccggtgcatgccagcgcggcgacggccacgcagacgaacgtcacgaagaattggttgagatggtgggcgaacaggcggcgacgcagccagtggccgaggccggcgccgacgaacgcgccgatcatgtcgtacgggccgccgccgagcaggaacacgaaggatgcacaggcgcaggcggacgcgagtcccgcgaaggccggcgaatacagcggtttgcgacgttcgatcatgtcgagtcgctcgtgcgcctgccgtacggtgacgccttgcgattcgcccgcggctttcccgatatggtcgaaatgctcggcatattccttcggcggtttgcagttgcggttcttacgcggcttttccgcgaccgaatcgccattgctacgtccggccgcggccgccgcctcgatatcgcgcatgtgcagcggacgtgcggtggaatcgccttcctgcgcgcgttccgtgaccatttccagcgcgtcgagcacgggatcgtcggaaccttcctggttctgctcggccttctgccgttccttgagctgcttggacagttcggccgacacctgcgaggcgtcgcgcttgtcgagatgctgcatcagcccttcggaaacgtcggattggctgtggtacatagagcctttgccgaggttgacgttgaaccagtcggcgaagtgctcgagcagccagatgcgttcggtgttgacgccagttgtgggtaggtcgacgacttcggtgatgcggtccttgccgtccgtgcaggatgcctcgatgtcggtgaggttcacgtcggcgcgcacgtgcacgcctaacggataggcgatgcggtgcatcatttcgcggacgcggaagcttcccgttccggcgccaaggtcgagcatgccgacacggacgatcacgctggctttcgctgcgattcccgcttcggtgaccggcttgtcccaatcgcgctcgatgtcttccatatcgagcggaatggagtgggtgtggaatttgctgaccgccttcgcgctgctgtcaacgcgttcggcgttctcatcatgttcatgtagtgcgctcacactattcaggtctaacgtgtgggctggtcggatattttccgaacattcccacatgcccattttccggacattcaatgtccacgatgcgaaccattccggcgtttccgtaaccaaactgtcgatttgccgcgcctacaatggtcgagcatttacccaccaagcttagggctgtgggctcgcaacagacggccaaaacaatcgcggaggtgccgcgaaggaccgacagaccgagcaacccgatggtttggagaaggaggtctgatgacaactgaaaacgaacagatcacgcctgcggacgcggctatcgtctcgtccggcaccggcaccaagggccctgaggagcgtgatcttcccgcatccctcaaagaggaaatggatctgtgtctgcagattcttcgcgaggtgctcggtgagttcgatgaaaacctgctggccaagttcgatgaagtgcgcgaacacgcgctgaaggccagtgacgaacgtttctccggcattctttcggatacgaatcccgaccaggacgacctgcagaaggtggtcgacatcgtcgacaagatggatgtccacgacgcccaactgctggctcgcgccttcaccacctacttccatctggccaacctgtgcgaggagaactaccgcgtctccgtactgcacagccgtgaggccgccgtggatgaggatcaggccgtcgatccggtgaacgaaatgacctgcgcctaccaccagctcatcaacgagatgggtccggccagggccaaggagctgctcgaccagctcgagttccatccggtgttcaccgcgcatccgaccgaagcccgccgtaaggccgtggaaggcaagatccgccgtatctcccagctgctcgaagcgcataagctgctcggcggctcggacaagaaggaaaactcccgtcgactcttcaacgagatcgacgcgctgttccgcacctccccgatcgcgctgaagaagccgactccggttgaggaagccgacaccattcttgatatcttcgacaacacgctgttctacaccattccgcaggtctaccgtcgtttcgacgactgggtcctcggagacaaggccggcctcgtgccgccggtgtgcccggcgttcttccatccgggaagctggatcggttccgaccgtgacggcaacccgaacgtcaccgccaaggtgagccgtcaggtggcccgcaagttcagcgaccatgtgctgggcgcgctggagatcgaaacccgccgcgtcggcaagaacctgacgatggaggccgagaccaccccgccgagcgccgagctcaagtccctgtggaaccaccagaaggaaatgagcgagcgtctgaccgacaaggccgcgctgatctccaccaaggagctgcaccgcgccgtcatgctggtcatggcagaccgtctgaaggccaccatcgaccgcgacgccgacctcatgtaccactcctgcgaggactacatcgccgatctgaagaccgtgcagcgctccctcgccgaagccaacgccaagcgttccgcctacggtccgctgcaggacctcatctggcaggccgagaccttcggcttccacatggtcgagatggagttccgtcagcattccgtcgtgcattcccgcgctctggaggacatccgcgagcatggcctgcacggtgagcgtggcgagctgcagccgatgacccacgaggtgctcgacaccttccgcgcgctcggttccatccagaagcgcaatggcatcaaggccgcccgccgttacatcatctccttcaccaagagcgcccagaacatcaaggacgtgtacgaactgaaccgtctggcgttctcccaccccgaggatgttccgaccatcgacgtgatcccgctgttcgagcagcttgaggatctgcagaactcggtggacgtgctcgaggaaatgatcaagatcccggaggtccaggctcgtctgaaggccaccggcggcaagatggaagtcatgctcggctactccgactcctcgaaggacgccggcccgacctccgccacccttgccctgcactccgcgcaggagcgcatcgccaagtgggccgaatcgcacgacatcgacctgaccctgttccatggccgcggcggcgccgtcggtcgtggcggcggcccggccaaccgcgccgtgctcgcacagccggtcggctccgtgaagtgccgtttcaagctcaccgagcagggcgaggtcatcttcgcccgctacggcaacccggtgctggcaatccgccacgtggagtccgtcgcagccgcaacgctgctgcagtccgctccgagcgtggagaagcgcaacacggatatgaccaagaagtacgccgacatggccagcaagctcgacgaggccgcgcacaaccgcttcctcgacctgctgaacaccgacggcttcgcaccgtggttctccaccgtcacgccgctgaccgaaatcggcctgctgccgatcggctcccgtccggcgaagcgtggtctgggcgccaagtccctcgacgatctgcgcaccattccgtggatcttctcctgggcccaggcccgcatcaacctggccgcatggtacggcctcggcaccgcgtgcgagcagttcggcgacctgaacaccttgcgtcaggcgtacgaggagtggccgctgttctccacgttcatcgacaacatcgaaatgtcgctggccaagaccgacgagcgcatcgccaagatgtacctcgccctcggcgaccgtgaggacctcaacaagaaggtcctcgacgagatggagctcacccgcaagtgggtgctcaagatcgtcggcgacgaatggccgctgcagcaccgccacgtgctcggccaggccatccgcatccgctcgccgtacgtggacgcactgtccgtcacccaggtgctcgccctcggctcgctgcgcaagcgcgtggacaaggaagagctcacacacggccagaaggagaactacacctatctgatcctgtgcaccgtttcgggcgtcgccgcaggcctgcagaacacgggctgatcttcggatgaccgattgacaaaagcgagcggggaggttccgtgccgatcgacggcgcgggcctccccgttcgcgtcgcacggccctagactggccggcgacggcgcgcatagaacgggcgcgctggccgagtgacagactcggatgatcggaggggacatggacaagccatcgaatgagcgcgggagcaccgggccgacggacggcatcaaggcggagggcgatgccggaaacgaacgccacatttgcaaagcgaatccggctatgatcgatgacattgggaaaaaacacggcctggaagatacgtcagaaaatttttccggcaagaaatatgctttggcaccgaaagcagctaccaaattccttaaggcgagtagatgctatgtggctttgggcaaagccagacgcgtgctatggtggctgggattactgctgctttcaccagcacttattttgtgggcggaatggggcgccaatggcgatgatgatactataatctgcagagtcttaacgttctcttcctcttcgtgcatgaatttaactacggcaactgagtatgtacgtagacttaccttagtattgattatgggggtagtctgctggattgcggcgcttgtcatctttggcgtgcgttcatatatgcgatctgtatatccggaacttcgtgatcattcctcttccgcctcgcatgtccttgtgggaatcatatcgtttctcgtgctggtcatggtctttcccgttcttgtgataacgctactttccgctctaatgactctatgacgttttaccagaggcgcattgcgtggaatggctgaatcattccacgcagtgcgatcacaatcatgattgattaacggggtagtgcccgaaggtttgcgcacttagggtcgtgcccgtccatgggacgatgatatcatcgtcccatggacgggcacgaccctaagtgcgcaaaccttcgggcactacctggtggtgatgatcggatatggagaggataatgacctgcatcctttggataagcgccatgtcgcgcagcgcttggcaacggctgccgagtcgttggtttatggacgtgatcgcgagccgatggggccgcttcctgtcatggcgattcacaaggatgacggcattgagatctccttcatccatacgggagggggattggtctgcacaggcgacgtgccttttgacatcttggagccgggaggctcgatatatcgggtgaaggctcgtcggtacgattgctatggcggtaacggaaccgggcgtgcgagtggcgcagtgagagagctctccccagtacagtgtcagtttgtcagccaatgaagcatcgatgataacgctattgccgggggcagcgtaaatagttttcgcagttaatcgtgtttgggcggaagtctgtgatttcctgcgtttggaatacttaaatctattcgagagtttcgtaaatatttgcatatagaactttcgcaacaacaattttaagtatttagttaagcgatttgactttcttgaaagttaaaccatataatcaaacagtgctttgactgaaatgctaaagcatttacgaaacatgaagatgtgtgttcgtgcatgtcgccaaaggagaaagacttctgtattcccacatccgatattgaataaggagatgcagcaatgaagtttgaataccatgtcaaaccaaccggcaacgatgctgcgtgcggcgacgcggagcatccgttcgccacgatttccaaggccgcgcagatggcctctccgggggacacggtaatcgtgcatgaaggcgtataccgcgaacaagtcgatccgaaacgcggcggtctgagtgaacatgagcgcatcacctactgcggagccgaaggcgaagcacggccggttatcaaaggctcggaatgcgtgcagggctggacggaattggccgatcacccgcatgtgtggacggtgatgcttgataatacgatgttcggggatttcaatccattcgcgaccccgattttcggtgactggctggaaatgcccaagttcggcaaggatccggacaaacatcttggcgatgtgtatctcaacggtgtttccttcttcgaatcgacgacgttggaaggcgtatacgatccgcaaccgcgtgatacggatgaggatttcgcgttgaagattccctgccctgtgccggatgtggaccgtacacgttatgtatggcatgccgaagtggacgagaatgccggcaccacaacgatctgggcgaatttccaaggtgccgatccgaatgaggaactggtggaggtcagtgttcgtcgcacatgcttcttcccctcccgcaaccatgtcaactacatcaccgtgcgtggctttgaaatggcgcaggccactggagattgggcgccgcctacctcgcagcagtggggcatgatcggcccgaactggtcgtatggctggatcatcgaagacaacgtgctgcatgacgccaaattctccgcggtgtcattgggcaaggaaatctcatccggcgacaacgagtggacgaaaaccgagcgcaagaccggttaccagtaccagttggaggccgtgttcaaggcccgtcgcatcggctgggaaaaggggctgatcggcggtcatatcgtacgcaacaacgacatctacgagtgtggacagaatgccatcgtcggacatatgggcagcgcattctgccgtatcgagcataaccatgtccatcacattgcgttgaagcgtgaattcttcggatgggaagtcgctggcatcaaattccatgccgcattggatacggtcattgccaacaacaacatccacgactgctcgctgggcatgtggatggattggcagacgcagggcacacgcatcacgcgcaatgtgttccacgataacgtccgtgacctcatgattgaagtgagtcatgggccgtatctggtggacaataacgttttcgcctcgccggtgatgttccagaactggtcgcaaggtggtgccttcgtcaacaatctgatttgtggcggcattgaaccgcataccgtccccgaccgttccacgccgtatcactatccgcacaccaccgaggtggccgggtgcgctgtggtatccggcggcgatgagcgttggctgaacaacatgttcgcgccgcaaccggtgaaaccgactgtcggtgaatatggtttgtccgcctacagcgattgcccgatgtcgatgcatgaatacttggaacgccagcgggccatgtgggcagatccttcgcagggtggtggcgagcgcaatcctctgcagtctctatatgcgggcggcaacatctatctgtccggcgcacaggggctgaacaagcaggaaggtgcggccgacgattcggagcgcatgcaggaggacgccccgttcttcggcggcaccgtctccacgagcgttgcgtgtgatgagcccatgccggtgacattggtcgaagaacccgatggactgtatctgcagtgcactgtgccacaggccgtcgccgataccaggatgcaggtcgtcaccagcgatatgctcggcgtgcctcgcatcgtggaggaacgctatgaacagcccgatggcagtgactatgtgctagacaccgacttgctgggacaagccttgaccgcaacggaacgcaaagccggggcgttgaatggtcttgtctccggagagaatcgcatccgaatctgggaatggaacaactgatatgacaaatgcaaccgataccagcaagacattgggcgagtccatgttcgcacagtgcggatatgcccaggacgccatcgataggcgcgtgtcacaggtctggtatgaaattttcgaaggtccgaacaaattctattgggagaacgacgaaggccttgcctatgtgatggacaccggcaacaacgatgtacgtaccgagggtatgagctatgcgatgatgatcgccctgcaatacgaccgtaaggacgtattcgacaagctgtggggctgggtaatgcgtcacatgtacatgaaggacggtcatcatgcgcattatttcgcatggtcggtcgcgccggacggtacgccgaactcgaatggtcctgcacctgacggcgaggaatatttcgcgatggacctgttcctcgcctcccgtcgctggggtgatggcgaggatatctacgaatattccgcatggggacgcgagatcttgagatattgcgttcataagggcgaacgctacgacggcgagcccatgtggaatcccgacaacaagctcatcaagttcattccggaaaccgagtggagcgatccgtcctaccatctgccgcacttctatgaagtattcgccgaagaagccgacgaagaagaccgtccattttggcatgaggcagccgccgcaagccgtcgctatctgcaggcggcctgcgacgagcggaccggcatgaacgctgaatacgcggattatgacggaaagccgcatgttgacgagtccaatcattggcatttctattccgacgcctaccgtaccgcggcgaatatcggactggatgtagcttggaacggtctgcaggaagtgctgtgcgaccgcgtcgccgcgctgcagcgattcttcctgacccacgaccgtactagcgtctacgccatcgacggcaccgccgtggacgaggtcgtgcttcatccggtcggattcctggccgcgaccgcgcaaggctcacttgcggcggtgcattcggcccagcccgacgcggagcataatgcccgtgaatgggtgcgcatgctgtggaatacgccgatgcgaaccggcacgcgtcgttactatgacaatttcctctatgctttcgccatgctggcgttgagcggaaagtatcggtatgaatgatgattacctcaactaatcctacggtctacacggattttcctgatccagacatcatccgggtcggggacgtgtattacatggccactacgactatgcatttcacacccgggtgcgatattctgcgcagctatgacctagtgcattgggaattcattgcgcacgcattgaatatcgtggcggatacccctgaagaacgtttggaatgtgaaggtgccaacgcctacggtcgaggcatgtgggcgccgtcactgcgttaccatcggggcacctggtatgtgttgttcgccgccaacgatacgcatgccagctatctgctgacggcggacgatccatgcggcccatggcgaaagcgtgagcttgacggcttctatcacgacagcggactgttctttgacgacgatgatcgagcctatgtcgtatatgggcagtcgacattgcgcatcacggagttgaatcctgaattaagcgggccgatgccgggtggactcgaccgggtcatcgtgcaggacgatccgcaggctgaccttggttatgagggcagtcacctatacaagcatgatggacgctattacgtcttcacctgtcacttcccgcaaggcaagggcaaaacagaagcctgcttgatggccgaatccttggatggcgctttcgaagcgcgtgaaattatcgacgacgacctgtccttccacggttacggagtcgcgcaaggcggtatggtggacactccggacggcgactggtatgcattcatgatgcaggaccgcggcggtgtgggacgcgtgccgacactgatgccgatgcggttcggcgaggacggattccccgtcgtcggcgagaacggcaaagtgccgcagtcggtcagcgtgccggctgcaagctgtgccgaacctgtcacgcccatcaacggcagcgaattcatagcccggcataacgctgaaggcggagtcgatgccaactgtctgcagccatactggcagttcaatcacatcacacatgacgaatactggtcactgacggaacgtccgggagcattccgcctgcattccggacgcatcagctcgaatctcaatcatgcatggaacacgctgacgcagcgcacgatggggccggtgacggtggccgaagtcaccgtcgacgcgtcgacattgcatgatggcgacttcgccggattggcggcgttccaaggatgctattcctacatcgcgcttacgcgaaggaacggccgcacgatgctgaccgtccaatacaagccggcgaatgacgattccatcttcttcgacaatgattgggacagtccagccgtaacggatgcggaaatcatggcggatgcggattgcatgcgcctgcgcgcggtatatgatttcaccgattgcaaggatgaagtgacgttcttctaccgcgatgcggatacgccggaatccgaatggcgtccattggggacagcgcaccggatggtcttcaaaatggatcatttcacaggttgccgtatcggattgttcctgtattcgacaaaagagaccggtggaatcgccgatttttacgactttgcgtattcgacgccgaatacgaaggaaagagagcaatgaagcgacaggtcatagtggcgcaaggaactgtcgaaggcttggcggctgaagatcagggcatcaccgtgttccgaggggtcccgttcgcccagcctcccgtcggcggtctgcgctggcgtgcgccgcagccggccttgccgtgggatggtgtgctgcaagccttcgatttcgggcctaccgcgatgcagccgacgccgggcgcctccgatgatttctatgatcgtgaatggggcactgatccggccgtgccgatgagcgaggattgcctctacctgaatatttggactccggcattacgcggatatggcgcggatagcatggtagcctccgaaaagctgccggtcatggtctggatctacggcggagcctatcaatgtggcggcacgtttgaaaaggaattcgacggcacacatctcgccgcgaacggcgtcgttgtggtcagtgtggcctatcgtctgaatgcatttgggtttatgacgcaccctttgcttcatgaggaggccgtagaacgcggcgacggcgaaccatatgcgaatttcggattcctggatcagcgtgccggaatccaatgggtgaaggaaaacatcgcgaagttcggcggagatccggaaaacatcacggttttcggccaatcggccggtgccgccagcgtcttggcccatatctgttcgccgatgaatcatggcctgtttcagaaagccatcatgcaatccggcgcaggcctagggcatttcaatgcgcggcaggacacgctggagcatgcgcaggccaacggaatccgtctgttcgaagcattgggtgtctccacgctggagcaggcccgtgcaatcccggcccgaacggtattggaagccgccgagtccctgcctgttccaccggacagcggacgtgaagatgactggtcgatgatcgtcaattgggcgccatgcgtggacggcctgttccttcccgatcaggaggagcgtatcgtcgagggctgcaaggccaacaacgtcgacatgctggtcggcaacacgaccaatgagttcatcgcttcgactgaagatgggaagcctgtgcatgtcggccagctcggcaatctcacgctgatccgcaaatggaccgcaagcggtgggaccgcgccatactactatcatttcgatgtcgctatgccgggggatgatgccggagccttccactcatccgatctgtggttctcctttggaagccttgcgaaatgctggcgtccgttcgttggatggcattacgatctggcaaggcgaatggggctgtactggaccaattttgccgccaatggcgatcccaacggaacggaccgtgacggaacgccgcttcctgtatgggatccttgcatcggtgaggaatgccccgccatgcatttgtgccaagaaccgggcatgcggacggattggcttaccgaaacggatcgaaaagcattcggcatgtgacggcatgccgttgatgtatacatactgatatgtaaacagggacggtctttgcggatcgtccctgccgcataatgatttgccgttgcgcgtgcaggaggatttcgagactgattatccgacttttcaccgtttctgtcgtctggttcgtcggtggcgtctcgcggaggctcgggccattaaagaccctgttcggcgttgtgcaggctaggagctgtttgaagtgttctaggccggacgtttcgccgtataggggcgtgtctgcgtggattccgtcggatgtggcgtctcaattgttggacgttgcggtgagcgtgaacgggggtgattatgaggaagactgaacccccgctcatgaccattgccgacacgatggcctatttgcagtgcagtcgtcggctgtcttgttgggtacccaactcgggtaccttgctgggtaccggaaatgttggcattggcgtacatttccgtacattctctgtttgcgccgtatgttttgaaatcgttggtattccgccgttttggcatgaaaaaagggcttccggatttctccgaaaaccctcaaggcggagtcagagggattcgaaccctcgagccgctaaacacgactaacaccttagcagggtgcccctatcggccactcaggcatgactccactgttgcgttacgacgcaacagcatgtaactatagcatctatccgcgtgcgaaacaccatattgtgaaaaaatgagagaaaaacgtgtggtgatgtcagtgggactcgaactcgtgagccgtgtcgagcggtctcattgatatgcgacacgccggtatgcccgcaggtttcgccatattcgaacatttgttccaaaactgccgaatcgttgtctatcatggaatcatgagcacagcaccaagaatcgcagcggccaaacgtgactggggtcacgatgaggtcggatgcacggtgctgcatatcgacatggacgcttttttcgcatccctcgaagtggcgcggcatccggaatacgccgacaaaccggtaatcatcggcatcggcaaccgttccgtggtgtccgcggcgaactatgaggcacgcaaatacggcatcaattcggcgatggcaagctcccgggcaagaaaactatgcccgaacggcgtctttctgccggtggacatccactactaccgtgagatgtcccgacgtatcttcacagaggtgttctcccgcgtcaccgatcgcatcgaacaggtttccgtggatgaatgctatatggacgtctccggcgcgctgctgcggtggaagagtccccgcgccatcggagcttggatacgcgatcaggtcgccagacggtaccacatcacctgttccgtcggcatcgcggcgaacaagcttgtcgccaaaatggcttcgaccaatgccaaaccggatggcatgctcatgatccccgtggccagacatgccgaattcgtacagatgatgccgttgcgtggcatacctggcatcggtccgtccttggagaaacgactgaacgcatggggcgttgattccgtggctgacttggcgaagatgagcatggaatcgcttgagcaggcgacggggtcagccatcagcgcgcgcgggttgtacatggcggcacgcggattggatgaccgccctgtcgcaccgcgtgcgcaggagaaatccgtcggcgcggaacgcacgttcgacaaggacacccaagacatgcggcaggtgacatccatgctccgctggtgttgcgatgatgtggccggcacgctgcgcagacgagggttgatggcgcgtaaggtcatggtgaagctgcgattcccggatttgagctatgcgacgaaaggacatacgctggactgtccgacggatgcggcaagcatgctgtatccgcaatgtgtcgcattattgctggccatgatgggcatgccggaaagctctatcgacgccatttcgttgaccagaccggtgcgacttgccggcatgagcgcgggcggtttggtcgaagcggcggatgcggcggttcagctttcgcttgatgacatgcttgaagagcagaacgaggcgcagcggggtcgtgggacggatgccgaaccgtcgacccaatcggaacggctacgcggtgcggaagcggcattagacgcggtacggctcaaatacggtaaaggaagcgtgcgtcttggcatatggcgtacggggccatcaggtaatcttgaacattgagagtgatgtgggacatgagaagaaacagggggagtgccatgagatacagggacaaggcggtgcatgcccgcaacccggaagtgctggttgcagggcgtcgcaggctggccatcgtcgcagccgtcgtgcttgttgtattgctggcggtaggtgggtggttcctgacgcggtgcttgcgttcatcacagtcccaagccgggcagggggccacaacgcagatgaacgtggccaagcagaaaaagcatgtggtgaaaaaggccgagccaaaggaacatcacggcaattcgccggactgtccggataccgattgcatcgccatgatggtcaatggcgatctgctgttccaccctggtctgtgggacaacttcgccggtcccaataccgcggcgacggacggtacggcctatgacttcaccagtctgttcgaaccgatgcgcaagtacatcgatgcctccgatatcgcggtgtgcgaattcgaaacgccgatcgcgcctcgcggtggcccctacaccgggtatccggtgttcaacattccctcggaggtcgccgacgcggccgccaaggtggggtatcgcgcatgcacgcatgcgtcgaaccattcgtgggatcaaggcgtggatggcatcacacgcctgtgggataccctcgaccaggacggcatcgcacagacgggctcctacaagaccgaggaagactctaccaaaccgctggtcatcgattccccgaccggtggcggcaaactgggcctgatcgccggtaccgtgtccctgaacgcgcaaacccccgattatgattggcgcgtcgaccgtctgcgcgagagcggcgatccgaaccatcaggccgacatcgacaaagccgtggccaaagccaaagaggcccgtaaacaaggcgccgacgtggtggccatcgccatgcattccgtgcaggaatatcttgactacgccgactcgtggcagcagtccgaagcgcatgagctggccgacaccggtgcgttcgacgtcatctacggtgccggatgccactgcgcgcagcccgttgagaactacaacggcacatggatcatctacggtctgggcaacgcggtgacggtcacgtcctacattccaggcaacgaggtcaacaaccaaggcgtgacggcccgcgtccaattcgccggcaagaaaggcgtggccggctcatggcgggtcaatcgcatcgattgggtgccgacggccaatgtgcgtcaaggccaataccagtggtgtccgatttcggacgaccatccggatggagcctgttggaacgaaacagaagatgccaatcagagacaacgtatctggaacgtgatctattccatgggcgcggaccagaacgtggttcgcgaatggaacatcaccgcagagcaagctggttcatctggaaagtagtttcccgtggcagaatatgcctcgtattcgttaatcgacctgtatggagcgtttccgctcgtgatgtgaggtgaaagaaatggatggagttttcgagacccagccggaccgcaccgacttgccgctggtggtcatgccggtggtcatcgaatcgatgatcggaccgttcaaacagaacttcacgatgctcgaaaacgtggcccgcgtgcgcatgtacgaggatttcacactggacgaggacaccatcgtggaacgctgcaaggatgccgacgccgtcatggtcatcggattccactgcgccgatgccatcctcgacaggctcgacgccaagtgctatgcgttcggaggcaccggcgtcgccagctacatcaatcttgagaaaaccaaggaacgcggcatccgcgtctgcaacgtgctgcattacggcgatcacgccgtcgccgagcacgccatggcgttgctcatggaactgaccaggcacgccggagcgcttgatatgcaggtcaagcaaggcgattgggacggtgccgacggtttcgaactgttcggcaagaagctcggcatcatcggactcggcggcatcgggcagaccgtggccggcatcgccaacgctttcggcatgaaagtatccgcgtggaactcccacgtgccggcacaggtgttcgagaacctgaatgtcactccggtggaagacatgaacgagttgatctcgaattcagacgtggtcagcgtgcatatgccgttgcttgactccacccgtggcatcatcacggcgaagaacctcgacgcgttgcgtccgggaaccctgttcgtcaacaccgcccgcgccgaagtcatcgaacccggcgcactgctcgcaagacttcaacgcggagacattccggcggccttggacgtgttcgatcatgagccgcttgccgccgacgatcctttgtgcaagattcccggcatcgtgctcaccccgcacatcgcatggcgcaccgacggcgcgtatatcggcatgaccaagcaggtggtccaatccatcgccgccttcttcaagggggaggaattcaacgtcgtcgtctgaaaaaataaccgggaagcagcatatgcgcgcggtcggtgaggttaggtaggttgaacagcatgcagaccatactcgattccgccgatcggccggcgcacgacgccttcgtcgaaaagaaatcggaattcatcggagacgcctgtcatatcagctcgttggatgaggcgctcgctttcgttcagacgatccgtgaccagcatccgaaagcccggcatgtcgcctatgccgcggtgtgtggtggatccgatggacgtcttgcggaacgcatgagcgatgatggcgagccgtccggaaccgccggcaagcccattctcgacgtgctgcgggcaaacgaaatgactgattgcgtggtcgcggtcacacggtattttggcggtatcctgcttggttccggcggcctgatccgtgcgtattccacaggtgcgtcaattgcggtcaaggctgcttccaaggcgaaaatcgtaccgtgcggcgaatatcaggtaactcttgattatccgcagttgggcagcttccagaatctgttgtcaacggtggaaggcgagcagaccgacgcgcagtacactgaccgcatcgccttgactgtggtggttccgcaggaacaggcgaatgccttcgaatcccgagttgtggaaactttcaacgccacggtcgttccgcaactggtgggcacgtccaaccgtccggtcaaagtatgagttcacgttgtgagccgcatgcatatagtgtcgtaaggtgaaaatatgagtgatgagaacgagcagcatgagaatgattcgcaggccgacgcctcgaacgccgatgagaccgtggatttcgagccgttgaccgccacatacgagcggctccggcattccactgattccaccgcattaagcgagttcgccagacgtccgctgccggaccggagcgaccaggcggcgttctcccgtgccaccgcattgcttgaggctgtggctggcaacgcgcatacgccggtggaggaccgcgtcttccttgccgaaaccatgccgttcccgaacattctggtcaagctttccaccgacgagtctcctgacgtacgcaaagccgttgcgggaaacgccgatgacaagaactggctggtgggccgactgaccaaggatgagtcgcccgaagtgcgtgccaccgcgctgcgcaacaaacgtacgtcttggaaaatgcgtcttgaaggcgccgaagattccaccatggattccgacacgcttgatttcctgggctcgttgggaacgcaggtcgaaccggacgctccggtggtgcttgcgaccatggtgcgcagggccgtcgccttgaatccgaatgtttccgatcggatgctccagcagttggcgcaggacgcttcaagcgacgtgcagaaggccgctcaacggcagcttgcggaaaaataattgcatacgttgtcatttttatgagattcctgcgcgtggtgcgcatgttttggtcctagactgggaaccatgacagaacagaccgaaaacgcaacgcgtctcgcccgtccgctcattcgtctggcaaagctggtgggtgtcgccaccagctacgtcggtatgagccatgattaccacgaaatcgaagacgatgttctagtggcggtgctcaaggcgcttggtattgacgcttccaacgatgaggcgatcaaccagtccatcacatccatcaagtccgaacgcgaaactcgcgtggtggctcccaccgtgctgcatatcgtgggcaaggaaagcaaggtggaggtgcacggcggcatgttcgatgtgccggaagcctccatcacgctggaaaacggcaagcaattcacgggcaaaatctcccatgagggcggtgagaaaatcgcccatgagatcaatggcagcttcttcttcatgtcgtatctcgtcctgcccgccgatctgcccgaaggctatcacaccctcgaggtcactgtcggcagcgagacggagactgcaaccgttatcagcgctcctgagaaaatcgaactgctcgatgatatgaagaacggctccctgtgggggtggatgagccagctgtactccatccgttccaagggatcctggggcgtgggagacttcgaagatctgaagaccatgctggtcgaggctaaaaagaagaccggctccgacttcatgcttatcaacccgatgcacgccgcggagccggtgcctccgctgacgccatcgccgtatctgccgatttcccgccgtttcatcaatttcagctacatccgtccggagtccatgccggaatatctcacgctgtcccacgaggacagggccgaggtcgatgcgctgcacgagcaggtcgaatcgctgaatgacgacgcgcggctgatcgatcgtgacgccatgtggcgcgtcaagaagcatgcgctgtgggtcatctacaaggccggccgaaccaaggctcgccaggccgaattcgaccgttacctcgccgaatgcggagacgagatcgaatcctacgccacctggtgcctgtgctacgacaagtggggcgctccctccgacgacgccgataattgggtgcgcaaatacaaccgtgattccgaagaagtcgcgcagttgcgtgagaagttcccggacacccttgagttctaccgctggcttgagtgggtcgccaccgatcagttgcacgcggcgcagcaggccgcccgcaaggccggtatgaagatcggcatcgtcgcggatatggccgtcggcgtgcatccggcaggatccgatgtgtggtggaatccggaacgcttcgccaagggcgccacggtcggcgctccgccggacatgttcaaccagcagggtcaggactggagccaaccgccgcttaatccgattgcccttgaacagaccggtttccgggtgtaccgcgatatggtgcatgacatgttcgccaatgccggtgcggtgcgtatcgatcatatccttggtctgttccgcctatggtggattccggaaggcaagcccgccactgatggcacatatgtgcattacgattccgatgtcatgctcggcattctcgcgcttgaggcttcccgtgctggtggcgtggttgttggcgaggatctgggtgtcgtgccggcctatgtgtccaagtcgctgtccgaacatggcattctcggttgtgccgtggaatggttcgaacagatggacggtgtgttccgcactccgaaggattggcgtccgtacgcactggcgtccgtcaatacgcatgacatgcctcctgcggccggttacctcgaatacggccacgtcaagctgcgtgaacagctcggcctgctgtccggaccggtggaggaattccagaagtccgcaaccgccgagcacaatgccatgctgaacatgctggtcgaggagggctatctcgacaaggctgctctggatgacgaagccgccaacgaaaacgagattatcgacgcgctgtaccgtggtctgaaaggttcgccctgcaagctcatggccgcctccatcgtcgacgcggtcggtgagaagcgcacgcagaaccagccgggcaccaataacgagtatccgaattggcgtattccgctggccgatggcgaaggcaacgtggtgccgctcgaaaagctcttcgacgaaccgcgtctgcaggagatcaccgccatcatgcgtggctgatcttctataggcgattccatggggtgtccacaggtccgacggtctgcggacacccttgtttttcgtgttgccgaatgtcaaggcaggcgatatactagtagactgttgtgtttccctacggggtccttcaaagcgcttttcccactcgccatcgaggactttcagggagcccacggataatgagacctgaaaaacggcattattccgcgcccaaccaacgcgtgtaatgctgatggatggtccggaacacaatatatagaaaaggtacatcgtgaaaactttcactccgaagccagctgatctgactcacgactggtacgtcatcgacgccaccgacgtggtgctcggtcgtctcgccactcaggcggcaaccctgctgcgtggcaagaacaagccgacctacgctccgcacgccgattccggcaaccacgtgatcatcctcaacgccgacaagatcgctctgaccggcaacaagttgggcaaggaactgtacatgcactccggtcgtccgggtggcctgcgtcgcgatagctacgcccagctgctcaagaccaaccccgagcgcatcatcaagtctgccatcaagggcatgctgccgaagaaccgtctggccaaggttcagctggatcgtctccacatcgttcgcggtgccgagcatccgtacgctggcatgaagccgcaggttttcgagatcgctcaggtctcgcagcaggctaagtgaaccgaagggagataagaaacatggctgaaaacaccaacgactccgcggttctcgagaccgaagaggagctcacctcgtacaccaccgagaccaacgctggcgctggcaccggtacttccaccatcgctccgggctacggcaccggtcgtcgtaaggaagccgtcgcccgtgttcgcctggttccgggcaccggcaagtggaccatcaatggtcgcaccctggaagagtacttcccggccaagctgctgcagcgtgaggtcaactccccgatcgttctgctcaagctcgaaggcaagttcgacgctatcgtcctcgttgacggtggcggcaccaccggccaggctggcgcaatccgcctgggcgttgcccgcgctctgaacgccatcgatcgtgatgcgaaccgcgccgccctgaagaaggctggcttcctgacccgcgacgcccgcgtcgtggaacgcaagaaggccggtctgcacaaggcacgtcgcgctccgcagttctcgaagcgctaaagcttacagcaagctttattcgaaacccctcggaaacctatggtctccgaggggtttcctcgttattgtgggcaagcgttagatgcgttggacgcaatgggctcgttagatgtgttggacgtatctggcagacgttgcagatgaagcatccgcatctccctcattcgcggcccacccgttaccggacgtttcggatgggccgtttgcgtattgatgtatgcgccgattcgttgcgccgtccgctgcgcgtcaatccgtcgaaatctgcttcatcgcgctgatgctcagagccggcagcgtccacagggtcggatcgtcctcggacaacccgtcgtcagcggagttcagactggcggcattctcatccatctgccaatacatggtattgagacgctgcagatggttgcggaatcgcccggcaggtttgtcctccgcttcctcatcgaactcggccagcttctcgatctgcgtgccctgtccgggatattcgccggcgatttccgccgaggaccagatcatttcccattcgatgtcgttgggcagatggaatctgacgttctcgtcggacccattgaccagaatgagcaggcttggctcgtcgggggagagcagctgcatggcgaacgatcggaccgagggattcgtccaatccgcatcatgcggcgtctttccgttcggcaggaaccagtgcacgcggtcggatttcttcaacagtccgattttgctcagtcgggtgaagaaatcctcatggttgtagaggtcccgggcctttctcagcgctatcagccgggaagtgaggttgaacagcttgagctccacggtctgctcggtgctgtacagccaatcccaatccagccatgtggtctcattgtcctgcgtgtaggcgttgttgttgccgttctgcgagttgccgaattcgtcgccggcaagcagcatcggcgtgcccagggagagcagcagcgtgcccagcatgttcatgatggcccgttctcgttgctgtgtgatgatcggatcactgcacgggccttcatgtccgaaattgacggaatggttgttgtcgctgccgtcccggttgttctctccgttggcttcgttgtgcttatgccgatactgggtcagatcggcggtggtgaagccgtcgtggcatgccacgtagttcacggatgcggtcgatccgcgtccggggtcggtggcgaacagatcggctgagccgcataggcgcgtggccatggactgcatggtcatgtcgccggtttcaccaccacgtgcacgttccacatcggtcagccagaaggtgcgtgtgcaatcgcggaagcggtcgttccattccgcgaaggggatgccgaattgtcccgttctccagccgttcgggccgcaatcccacggttccatgatcatcttgaggttgccgagcagcagatcggagcgcaacgcgtacaggaacgggtggtatcgcgtgaattcgccgtcaagacgcgccagcgtcgccgcaagatcgaatcggaatccgtcgataccaatgcgtttggcccaatagcgcaacgaatccacggcgaacgtggtgacgtgcgtgttggtgaaatcaagcgtgttgccgcaaccggtggtgtcgtacaggcggctgatcttgtctttggtgcgtcggtagtacgagagattgtcaaggcctcgccagcaaatggtcgggccttcggggcctgattcgcaggtgtggttgtacaccacgtccatgatgacctcgaaaccggcctcatgcatggcccgcaccatgtcgatgacctcctgccgcacggcgcccgctcccgcttcctgcgcctgcttggtggcgtacgaggcttcgggggcgaagtagccgagcgtggaatagccccagtaattcgtgcgattgcgttcctgcaggaacagttcggattgcttggcttggatgggcagcagttcgatggatgtcacgccgaggtcctgcagataggagagcgtggccggatgggcgaggccggcataggtgccgcgcaattccggaggaagccatggggcgttcgcggtgaatcctttgacgtgcagttcgtagatgacggttttgctccatggcacatgcgggtgggatggttctcccatatgcttgttgatgtcgcggtcgtcaatggccacggaaacaggcatgtgtcccagagagtccacggtgctcatcggtccgaacggcgaaccggcgaccttgccgtttttgatctcgcattcgtaggcgaaggcgcccgggtcgagttccatcttgccttcgatgcctttggcgtatgggtcgagcagcagtttgtatggattgaagctcacgccatggtttggatcccatgggccgttgacgcggtatccgtattgcatgccgtcccatgcttgcggcacgtgcacgtaccacagtccgtagttgggaccgtccatgcggaacagtgtttcgcgaagattgagcgagggaatgcgtctggtgcagatgcgctgttttttggcctgatcgatgaacgtgagtccgggttcgttgaacagccgtgcggcgtcggcatagaaggcgctcggttggtcaagtggttcaagtacgcaaaaccacacttggtctgctgtttctgagcggacaacggcgtccgcgccaccatcgtcggtgaaatagagacctgggcgggttgcgtagcggtgcaaaggtgggttcttcataacctcattctaaacactttgaaattatctgttgacttgctatgtcgaggctgtcgacgctcgtgccggtctgatccagccgtgagcttgaactcgagcaggtgcaggacttcctcgacggcaaaatcgccgccgcttccaaggctgtcgtcaaaatcggcgccggacgctgtttattcgtcctgaacagcttggaattagcgaaaaagtatcacgacatgacggcaaatgcgccgccgacatcgccgcatagcgcatatcctaatcacaaaagggaaaaatcaatcgtattcatcgttatcaggaggtaattttatgacgaaagcaatgtctgaattcactaccgatctgcagcattccggtatgccggcgaaggatctcgacgaaaccatcgaattctatacgaagaagcttggtttcgaactggccggactgttccataacggcgaaaatcgttgcgcattcctgcgttacggccatctgaccatcgaaacgtgggagggtgatccggctccgctgaccactggtgccatcaatcattgggcattcgacactcccgacatcgaagctgcattcgaaaacgcgaaggaactcgggctgaatttcaaagataacgaaatccagcatatcgacagcttctgggagcatggcatccgctacttcaacgtgtacggaccgaacggcgaaaccattgaattctgtcaaattgtcaaataactatcgttagatgattgccgtcaaataatcgttgaaaacaaatacaacaggcgaaacagacggaagcaaacaaagaagcgtgcgctgaaccttatatacgggttcggaacacgcttctttttgttatgcaatcgatgcgactaatgcgattaatatgtgcgcaaaagcggtcacatatcgcatagttcgcgtacgtacggctccacaaaacgcagagccgcgccgataatgtcttgatggtcgagcgccattcccttgcgcagggtgaaatccgtggtgccgaatggcgtgtgttccaccacgcgttcgcgtagtccggccatatcgtcctcatcgagatattgtgctgcctcaccgctgatgatcacgtcaccggccagcaccgagcgaatattcgttaccgccagcgccacataatccagccattgcgagaatcgttcgcgatgctcctgctcgccttgttccaacaccgagaagaagccgggcaggctttcgccgtcttccatcagcgtttccggcgagcaatacgtatccatgcagccctgttgcccgcagtagcaggtgttgcctcctggaatcagcgtcatatgttcgattgagccattgcattggttgggcccttggtagagcgatccgtctacgatgaccgcgcctctggggcgtcgctcgaggtagatgcagacggcatccttcagattgtggtcgaaccagagttccgccatggcagaagcgtcggaatcgtgaatcatcagcgacggatagttgaggccgtggctgagttcgttgagtttcaggccggtgttgttcatgattttgccgaaggtgatcgactgcccgtctgccgatacgatgccttgcatgcagaaggccacgcctcgcaccgtgctgccttgtttcgccagttcctgcgcgaaatcgttgatgatgccgttcatgcgctggtagtaggcgtcgttgttacgataggggagtgtgcgctgtctggtggccacggatttgccgttcagatcaatggcgatggccgtgattcgtgtggtttggattcgcacgccgatagccacgctggagtgtgccgcgaattcgtagatttgcgctttgcgtccaccggtggattgctgcatctcgcctttgacgatgagcccgtcggcctccatggcgcgcagattctgcgtgatggttggcaggctgagccctaattcgtgttcgaacatctgcttggtggctgaaccttgagtgtagatgaacgcggtcatggccttgagattggcttctttgactgatagggcggattgggctttcactggttgatccttcctgcgcaacttcttttccaagattacttcataaaagtcctttccttatgtctcgtgttggtctgagatatcaggtattgcaaaaaagtatcaaaaacagctgtgcataaaggattttctgccacttttctgcgtcgaaaatatatttatcaacaaaaagttgagacggtgacaacgacgttctaccaagaaaagagacatgttatgaagataggtctgccgcgcacgctattggccggcttggtcgccatagcggtgttcatgaccggcgatggctttgaattgacttttttgtccaaatacatcgtggaccagggattcagctcttcgcaatcgtcgctgatgttcaccatgtacgggctggtggctgcgcttgccggctgggcgtccggtgtgctagctgaaatgttcggtgccaaacgcatcatgcttatcggcgcgagcgcctgggtcgttttgcacctgctgttcgttggtgtggcgctgccgagcggcgtctatccgctgatgttaggcgtgtatgcgttgcggggtgttggttacccgctattcatctactcgttcgtggtgttgatggcgcaaaccatcgatcctgccaagctcgcgtcggccatggggtggttttgggccgcctactcgttcggcatcggcgtgtttggcgcatatttgccgagtttcaccattccgatggtgggcgagtactattcgctgtggctttcgttgccgttttctatagctggactgctgatttgcctgctgatggtgccgaaaagcaagggttctggcacctcttccatgagcaatgcagacaagctgcgcgagcttagtcgaggagtcaccattctggtgcataatcgccaaatcgctttggctgcggtggtgcgtgtgatctgcaatctgacgttgtatggctttcccgtcatcatgccactctacttggccactaccaacaatggcggcggcgattggtttaaggtttcgcaatggagtcagatttggggattccagtttgtggtcaccattttcggcaatgtgttctggggtcgtatgggcgattcgcatggttggatgcggcaaatgcgctggtttggctgctggttctgtgtgatcggcacgctgggcatgtattacattccgcagtttttcggggcgaatatggtgcttatgtgtgctgatgcggttgttcttggattgggaatttccgctttcgttcctatgggagccgtgtttcccgcgttggcgttggaacataagggtgctgcgatttccgcgcataatttcgcttccggcctggctacgtttttcggtccgctgattgcgacggtgctggtttccactatcggattcggcggcgtgtgctggacgtatgcgatctgctatgcgatcggatcgttggtcacgttcggcattcatcctcatcaacccggatttgatgatcgcggccatcgcattgccacgatcgagcgtaactaatcgcaattgaatatcaattgctcgatcatcatttttctcaaaaaacatcattatccacaaaggagaataatcatgaaggcagtcgttctcgaagagcagggcgtcatcaatgtgcgtgaggtgcctgacgtccccgcacctggtctaggcgagctgaagatcgcgccgcataccgttggtgtgtgcggttccgacctgcactattacactcatggtcgcgtgggcaaatatgtggtggagcagccgatgattctcggtcatgaggcttccggcacggtggttgaggtcggtcctggcgtcgaaggcttcaaggtgggcgatcgtgtggccatggagcccggcattccggatatgagttcgcgtgccagcaaactgggcatgtataacgtcgatcctgcggtgcgtttctttgccactccgccgattgatggctgcctgtgcgaaacggtgaaccatcctgcggcgttcacctacaagctgcccgacaatgtgagcttcggtgagggtgcgctgcttgaaccgttggctgtgggcatgtggtccgccaccaaggctcgtatcaagccgggcgatgtctgcgtggtcaccggatcgggcacggtcggcatgctgaccgcgtcgtgcgcgttggcaggtggtgcttccaaggtgctgatttctgatgtgtcggcaatcaaactggcgattgcggctcagattccaggtattattccggtggatctcaccaaagaggatctggtggagcgcgtccgtgaggaaacggggggttggggtgctgatgtggctttcgagtgctcgggctcgccgaagtcatacgagacattctggaagctgattgctcccggtggcgctgccgttatcgttggcattccggtcagtccggtggctatcgacattacggaactgcaggctaccgaggtgcgcatcgaaaatatcttccgttatgccaatgtgtatcagaaggccattgacctcgtggctaacggtaaactgaatctgaagccattcatcaccgacacctatgcgatggaggatgccaaggcggcgttcgatcgcatggccgaggggcgtcctggagatattaagctgcagattaccgtgaataacgactgacgttacgcacgttacggaacgacgaaaggggtctaggccatgggtgctgttgtacaagtcaacgataatcggcatgggaaggcggctttggctcagacctcttttggtggattcgtgccgaaaggtggaagttcgaacgattccggcgtattggagatcattgtgccggacgcgcaggcttcggtgcgttgggtgaagcatggctacccaagctcgttggcgaaatggcatcatcatcctcatattgaaattcatctgattcgggaaggtaccggattgatgatggcgggcaatgccgttgttccgtatgaggccgggcaggttgcgctgattggttcgaatcttccgcataattgggtgtccgacatcgctccgggggagcggcttcgtcagcgtgatgtggtgtgccatgtgcgtccggaaaccatacgtctgctgatgtctggatttccggaaacgtctggttttgcaatggtgttgaggcgtgcggggcaggcgttggtgctgagcggtgaatccgctcgtcaggccggttcgattctggaaagcatggaggaacatagtcttgcttgccgtgttagtgatctgattcgtgtgttggatgtgttcgcgcatgcctcagcagatgaatcctatacagtggttgcgtccggatacgatccggctgtatgcagtggtgcggaaagtgtggtcaacgatgccattgagtacatttcctcgcatctgagcggtgaaattagcctggatttggccgctcgtcaggctggaatgagtgtgtcggctttctctcgtctgttcaaaagggccgcaggaataaggttttcggattttgttcgacgattgcgtatcgggcatgcgtgcagattgctgacgaccacgaatcaaagcgtcgcgtcgattcgtcgtgcttgcggatatggaaacgcttcgaatttcaatcggcgcttctttgaagaaacgggcgaaactcctactggctggcggaaaaaatacattggacggacaagataagtaaataaactttgtaaaagtttgatatgattgatatcatatagaaaatacttttataaaagatgaggaggtgagacttgagaaagtgtgtgtgatttatgataaaaagcaacaaaaacgctcgaaatgatgtttttaaagctttttctcttcacaaaagaacgcaatctaaacattaaatgaacagaatataacatttctcttgcgacacgacgcagtggaaaatcatattgcatactcgctaaagtgtgtcctaggtcacaaaagaccagcaacgcgtccatccgcttcgaggtgggtggaataacgggaaactactttgcaaacccccaaagaatcgaggaggacttcaagtggcagacgcaaagaaggaagagccgaccaagccgactccggaagagaagctcgccgcagccgaggctgaggtcgacgctctggtcaagaagggcctgaaggctcttgacgatttcgaaaagctcgatcagaagcaggttgaccgtatcgtcgccaaggcttccgtcgcagcgctgaacaagcatctggtgctcgccaagatggccgtcgaggagacccaccgtggtctggtggaagacaaagccaccaagaacatcttcgcctgcgaacacgtcaccaattacctggccggacagaagaccgtcggcatcatccgcgaagacgatgtcatgggcatcgacgagatcgccgaaccggtcggcgtcgtcgccggcgtgaccccggtcaccaacccgacctccaccgccatcttcaagtcgctgatcgcactgaagacccgctgcccgatcatcttcggcttccacccgggcgcgcagaagtgctccgtagaagccgccaagatcgtgcgtgacgcggccatcgaggcaggcgctcccgagaactgtatccagtggatcgagcacccgtccatcgaagccaccggcgccctgatgaagcatgacggtatcgccaccatcctcgccaccggtggtccgggcatggtcaaggccgcatactcctccggcaagccggccctcggcgtcggcgctggcaacgctccggcatatgtcgacaagaacgttgacatcgtgcgcgccgccaacgatctggtgctctccaagcacttcgattacggcatgatctgcgctaccgagcaggccatcatcgccgacaaggacatctacgctccgctcgtcaaggaactcaagcgtcgcaaggcctatttcgtgaacgccgaggagaaggccaagctcgagcagtacatgttcggctgcaccgcatactccggccagaccccgaagctcaactccgtggtgccgggcaagtccccgcagtacatcgccaaggccgccggcttcgagattccggaagacgccaccatccttgccgctgagtgcaaggaagtcggcgagaacgagccgctgaccatggagaagcttgctccggtccaggccgtgctgaagtccgacaacaaggaacaggccttcgagatgtgcgaagccatgctgaagcatggcgccggccacaccgccgccatccacaccaacgaccgtgacctggtccgcgagtacggccagcgcatgcacgcctgccgtatcatctggaactccccgagctccctcggcggcgtgggcgacatctacaacgccatcgccccgtccctgaccctgggctgcggctcctacggcggcaactccgtgtccggcaacgtccaggcagtcaacctcatcaacatcaagcgcatcgctcggaggaacaacaacatgcagtggttcaagattccggccaagacctacttcgagccgaacgccatcaagtacctgcgcgacatgtacggcatcgaaaaggccgtcatcgtgtgcgataaggtcatggagcagctcggcatcgttgacaagatcatcgatcagctgcgtgcacgttccaaccgcgtgaccttccgtatcatcgattatgtcgagccggagccgagcgtcgaaaccgtcgaacgtggcgccgccatgatgcgcgaggagttcgagccggataccatcatcgccgtcggcggtggttccccgatggatgcgtccaagattatgtggctgctgtacgagcacccggaaatctccttctccgatgtgcgtgagaagttcttcgatatccgtaagcgcgcgttcaagattccgccgctgggcaagaaggccaagctggtctgcatcccgacttcttccggcaccggttccgaagtcacgccgttcgctgtgattaccgaccacaagaccggttataagtacccgatcaccgattacgcgctgaccccgtccgtcgccatcgtcgatccggtgctggcccgcacccagccgcgcaagctcgcttccgacgccggcttcgacgccctgacccacgcatttgaggcttacgtctccgtctatgccaacgacttcaccgatggtatggcactgcacgctgccaagctggtgtgggacaacctcgccgagtccgtcaatggcgagccgggtgaggagaagacccgtgcccaggagaagatgcacaacgccgccaccatggccggcatggctttcggctccgccttcctcggcatgtgccacggcatggcccacaccatcggcgctctgtgccacgtggcccacggccgcaccaactccatcctcctgccgtacgtgatccgttacaacggttccgtcccggaggagccgaccagctggccgaagtacaacaagtacatcgctccggaacgctaccaggagatcgccaagaaccttggcgtgaacccgggcaagactccggaagagggcgtcgagaacctggccaaggccgttgaggactaccgtgacaacaagctcggtatgaacaagagcttccaggagtgcggtgtggatgaggactactattggtccatcatcgaccagatcggcatgcgcgcctacgaagaccagtgcgcaccggcgaacccgcgtatcccgcagatcgaggatatgaaggatatcgccattgccgcctactacggcgtcagccaggcggaaggccacaagctgcgcgtccagcgtcagggcgaagccgctacggaggaagcttccgagcgcgcctgatcgcaatatcgcaacgtaactccttatataaaagatgtgaagtgaagcgtatataaggagtcgtgcaaaaggagcctgatgggaaaccatcaggctccttttttatagtgagggggaagtggaccgtcgccgttaccttccgcgttcttcatcgaaagaagacgcgtgattgtgttggcgcgacaccgcgaaaaacgttggaaaaaccgcgacacgcgcgaattccatatgttcacccctgatgcttagataaagaagttgcctgattttagggctcgcaaattgtaattcaaaaagcgagcgtggcacagcggctcactccggtgagaagctgcatggctgcgcactgatgtggtatggccacggaacttccacggttccgggggtcttctgcgccggtgcccttggaagcaggctggtaaacagtaaataacgaatcgctagaaagggcggaaggcaatggcgggacagaaaatccgcatcaggcttaagtcctatgaccatgaggtcatcgaccaatcggcgaagaagatcgtcgaaacggtgacgaacgcgggcgcaactgtggttggcccggttccgctcccgaccgagaagaacgtgttcgtcgttatccgttctcctcacaagtacaaggattctcgcgagcatttcgagatgcgcactcataagcgtctcatcgacattgtggacccgaccccgaaggccgtggactccctcatgcatattgatctgcccgcagacgtgaacatcgagatcaagctgtaagggaggagggaaccattatgtctaatcgcaccgcactgctgggcaagaagctcggtatgtctcaggtctgggacgagaacggtttcttcgttcctgtgaccctcgttgacgtgtccaccaacgtggtgaccgctgtcaagtccgaagagtccgacggctacaaggctgttcagcttggctacggccaggttgacccgaccaaggtgaccaagccgctcgccggccacttcgccaaggctggcgtcaccccgcgtcgtcacctcgctgaggtccgcaccgataacgccgaagagttcgagccgggtcaggagctgaccgctgagctgttcccggaaggcaccctggtcgacgtgaccggtaccaccaagggcaagggcttcgcaggcaccatcaagcgttggggcttcaagtcctatcgtcgtacccacggctctcacaagaacgagcgtcgtcctggctctgttggcgcatgcgccaccccgagccgcatcctcaagggcaagcgcatggctggccgcatgggtcatgtgaccaacaccgcgctgaacctcaccatcgtttcgtcggatgttgagaacggcgtgctggctatcaagggcgccattccgggcccgaagggcagcatcgttctcgtccgttcggcagtgaagggagcctgataaatcatggcaaacgttactctgaacgtcaccgataaccagggcaaggccaccggcaccgtcgatgccccggctgagatcttcggcttctccgctgaagaagttcagtcccgcatcccgctgatccaccaggtcgtcatcgcccagctcgccgctgctcgccagggcacccacgccaccaagactcgtggcatggtttccggcggtggccgcaagccgtggaagcagaagggcaccggtcgtgctcgtcagggctccatccgtgcaccgcagtggtaccacggcggcaccgtgttcggtccgcagccgcgtgactactcccagcgcaccccgaagaagatgaaggccgctgctctgaagtacgtgctttccgatcgtgccaatgccggtcacgtggccgttgtcgacttcggtgtttccgaagccccgtccaccaaggccgccgttgccgctcttaccccggtgaccgagaacaagttcaccaccgtggtgctctctcgcgagaatgtgaacgaatggctttccgttcgtaacatcccgaccgttcacccgatcttcgccgatcagctcaacacgtacgatgtggtcaccgctcagtacgtggtcttctccaaggaaggctttgatgctttcctcgctgcgaaggctgagccggctgcaaaggaggcctgattttcatggtcgctattcacaagcccgcacacgacatcatcctcaagcctgtcgtttctgagaagagctacgctctgtccgatcgcggtcagtacaccttcgtggtggccccgaacgcgaacaaggttcagatcaagcaggcaatcgaagagatcttcaatgtcaaggtgacgaacgtcaacaccctcaaccgcgccggcaagcgccagcgcacccgcaacggtttcggccagcgcgtcaatcagaagcgcgccatcgtgaccgtcgccgagggccagacgatcgacatcttcggtaactgaaggctagccgagaaaagttaaaggaagaactagattatggctatccgcgtttataagccgacgactgcaggccgccgtaacgcgtccgtctcggacttctccgagcttacgcgctccacgcctgagaagtcgctggttcgcaagctcagcaagactggcggtcgtaactcctacggccgtatgacctcccgtcatcgcggcggcggtcacaagcgccagtaccgtctcatcgacttcaagcgttgggacaaggacggcgtgccggccaaggtcgctcacatcgagtacgacccgaaccgttccgcccgcatcgcactgctgcactacgcagacggtgagaagcgttacatcatcgctccggaaggcatcaagcagggcgacgtcatcgagaccggcgctcaggctgatatcaagccgggcaacaacctgccgctgcgcaacatcccgaccggtaccgtggtgcacgcgattgagctccgcccgctgggtggcgccaagatcgcccgctccgccggtgctgccgtgcagctcgtcgccaaggatggcgcctacgctcagctgcgtatgccgtccggcgaaatccgcaacgtggacgctcgctgccgcgcgaccgttggtgaggtcggcaactccgaccacgccaacatccagcttggcaaggcaggccgcgctcgttggatgggcaagcgcccgatcacccgtggtgagtccatgaaccctgtcgatcacccgcacggcggtcgtacccgcggtggcaagccgccggtttctccgtggggcaagggcgaggttcgtacccgccgtccgaagaaggcttcgaacaagatgattgttcgtcgtcgcccgaatggtaagaaccgtaagtaagggagtgtcgagtagatgactcgtagcatcaagaagggccccttcgtcgacgcccacctgcagaagaaagtcgacgagcagaacgagaagggtacgcacaacgtcatcaagacgtggtcccgtcgttcgatgatcacccctgatttcatcggacacaccttcgccgttcacgatggccgcaagcatgttccggtgttcgtcaccgaatccatggttggccacaagctcggtgagttcgccccgaccaagaccttcaagggtcatgtgaaggacgacaagaaggcacgccgctaaaggagagtaaggacacatggaagctaaagcaatcgctcgtcacgtccgcgtgacgccgcgcaaggctcgccgtatggtcgacctcatccgaggcaagaaggcgaccgaagccatcaccattctgaagttcgctccgcaggacgcatccctcccggtgcgtaaggtcctggagagcgccatcgcgaacgctcgtgtgaaggccgacaaggccggcgagccgttccgcgagaacgacctggtcgtgaaggagacctatgtggacgaaggcgtgacgctcaagcgtttccgcgcccgtgcacagggccgtgccgctcgtatcaacaagcgcaccagccacatcacggtcgtcgtcgctaacaaggaaggaaaccgctaaagatgggtcagaagatcaatccgtttggctaccgcctgggaatcactgagaaccatcgttccaagtggttctccgattccaacaaggttggcgaacgctaccgcgacttcgttctcgaagatgacgccatccgcaaggccatgagcaaggacctcgagcgtgcgggcgtgtcccgcatcgtcatcgagcgtacccgcgaccgcgtgcgtgtggacatccacaccgctcgtccgggcatcgtcatcggccgtcgtggcgctgaggctgagcgcgttcgcgccaagctcgagaagctcaccggcaagcaggtccagctcaacatcttcgaagtgaagaacgccgcactggacgcccagctcgtcgcacagggcatcgctgagcagctcaccaaccgcgtgaccttccgtcgcgcgatgcgtaaggcccagcaggatgccatgcgtgcaggcgccaagggtatccgtatcaagctctccggccgccttggtggcgccgaaatgagccgttccgagttctatcgcgagggtcgcgttccgctgcagaccctgcgtgccctcattgattacggcttcttcgaggccaagaccacttacggccgtatcggcgtgaaggtctggatctacaagggcgatatgaccgagcgtgagttcgaagagcagcaggcacagcagagcaacaaccgccagggtcgtcgcggcgatcgtcgtccgcgtcgcggccagcgcaacgctgctccgcagcagaacgcagcagcagaggctccggccgctgctgaggcacctgccgcaacggaaacgaaggagtgagctgagaatgcttatcccaaagagaaccaagtatcgtaagcagcaccgtccggtccgccgtggcatgtccaagggcggcaacgagatcgctttcggcgatttcggtatccaggctctggctccggcttatgtgaccaaccgccagatcgaggccgctcgtatcgccatgacccgctacatcaagcgtggtggccgcgtgtggatcacgatcttcccggatcgtccgctgaccaagaagccgctcggcacccgaatgggttccggtaagggtactccggaattctggatcgccaacgtccacccgggtcgcgttatgttcgagatcggtggcgtgtccgaggatgtcgctcgtgaggctctgcgccgcgcaatcgacaaactccccatgaagtgccgtgttattgctcgtgaaggcggtgacatctgatggcagtcggaactgcagactacaccatgaagaatctcaacgagaagaccaacgaggagatcgagggcttcctcaagaagtccaaggaagagctgttcaacctgcgcttccaatccgcgaccggtcagctcgaaaacaccgcccgcctcaaggcggtcaagcacgacatcgccaggatgtacaccatcctgcgcgagcgtgagctcggcatcagccaggcccccgaggcgaccgaaacgaaagctgaggagaagtaatggctgaagagcgtaacttccgcaaggttcgtcgcggttacgtcgtgtccgataagatggacaagacgatttccgtcgagctcgagcagcgttcgacccacccgctttacggcaaggttgtgcgctccactcgtacggtcaaggtccatgatgaacacaacgaggctcacattggcgacctcgtgagtattatggagactcggcccctgagcaagaccaagcgttggcgtctcgatagcattatcgagcgcgctaagtaaataagttcggcaaggctccgtgagtcaccccgcctgcttctagcaggcaggcggggtgcttggggagaaccagctcggctaaggagaatcaatgattcagcaggaaacgcggcttcatgtcgccgacaacacgggtgcgaaggaactcctcgccatccgagtgctcggcggatcgaagcgacgctatgccggcatcggtgacgtgatcgtcgcctccgtcaaggacgccatccctggcgggtcggtcaagaagggcgacgtcgtcaaggctgtcgtcgtccgcactgtcaaggaacaccgtcgtgtcgacggctcctacatcaagttcgacgagaacgccgccgtcattctcggctctggccgtgaaccgaagggcactcgtatcttcggaccggtcggtcgtgaactgcgcgacaagcgcttcatgaagatcgtgtccctcgccccggaggtgatctgacatggcagccaagattaagagcggcgacctggtcaaggtcatccgcggcaaggatcgcggcaaggaaggcaccgtcaagcaggtgctcaaggacgatcgtctgatcgtcgagggcgtgcagatcgtcaagaagcacgtccgcgccacgcagcagggccagcaggccggcatcgtggctgtcgaggctccgattcatcgctccaacgtgatggtcatcgatccggagaccaagcagcccacccgcgtgcgcatcgtcgaaaaggaagaggcccgtgacggcaaggtgaagaccgtgcgcgtgcgtgtcgccaagaagtccggaaaggagctggcatgaccgataccactgtcgaagcgccggcaactccgcgcttgaagcagaagtacaacgagcagatcgtgccggagctggagaaggaattccactactccaacccgatgcaggtcgctcgcgtccagaaggtcgtcgtctccatgggcgttggcgccgcagctcgcgactccaagctcatcgaaggtgccgtcaaggacctcaccctgatcaccggccagaagccgaagatcaccaaggccaagaagtccgtcgcacagttccacctgcgtgagggccaggccatcggcgcctacgtcaccctgcgtggcgagcgcatgtgggagttcctggatcgccttctgaccatggctctgccgcgtatccgcgatttccgcggcatcaacggcgaccagttcgacggtcagggcaactacaactttggcctcaccgagcagtccatgttccacgagatcgatccggattcgatcgatcaccagcgtggtatggacatcaccgtggtgaccagcaccaaggacgacaaggaagctcgcgtgctcctgaagcacctcggcttccccttcaaggagaactgatatggcaaaaaccgctcttaagaacaaggcggccgctaagccgaagttcaaggtgcgcgcctatacgcgttgccaggtctgcggtcgtcctcactccgtctaccgcaagttcggcctctgccgcatctgccttcgtgagaaggcccaccgcggcgagctgcccggcgttacgaagtccagttggtaaatatcgacgctgaaggtccgcggcccgatcgcctctaaggcgtgagggcggcggaaaccatggcgagaaagggcgttagcccaaatgacaatgacagatccgatcgcagacatgcttacgcgtctgcgtaatgcgagcgcggcaaagcacgagaccgtggatatgccgtactccaagttcaaggcgaacatcgctgagattctgaagcgtgaaggctacatcaaggacttcaccgccaaggaagccaaggttggccagactcttgaggtcaccctcaagtacggtccgaacggcgagcgttccatccagggcatcaagcgcatctccaagccgggcctgcgtcgttacgcaaagtccgatgctctgccgatgccgctcggtggccttggcatcgcaatcatctcgactagctcgggactgctgacccagaaggaatgcctcgaccgaggcatcggcggcgagatcgtcgctttcgtttggtgagaaaggagagctgaaacatggcatcgcatattggtaagctccccgtcaccattccggctggcgtggaagtcaagatcgacggtcagtcctttaccgccaagggcgctaagggcactgactcctacgagattcctgaaggcatcaccgcagtggtcgaaggcaacgaagttgtcctcaccccggctgatgacctgcgtccgacccgtgcaaagcacggcctggctcgctccatcgtggcgggcatggtcaagggcgtgcacgagggttatgccaagactctggagatcgtcggtaccggttaccgcgcccagatgaagggcaagggcattgagttctccctcggctattcccacaccatcaccgtcgagccgccggcaggcatcgaattcgaactgccgaacccgaaccaggtgatcgtcaagggcatcgacaagcaggctgttggccagtgcgccgctaacattcgtaagcttcgtgctccggaaccctacaagggcaagggcatcaagtacgcggatgagcacattctgcgcaaggctggaaaggctggtaagtaatgagcgtccagattctcggtaagggcaagaaggtcgcgcttaagcgtcgtcacgctcgtctgcgcaagcacatcagcggtaccccggagcttccgcgtctggtggttacccgttccaaccgtcacatggttgcccagatcatcgatgacaccaagggtgtcaccctggtgagcgaatccactctgaccagcgatttcgccggtttcgagggcaccaagaccgaagccgccaagaaggtcggcgaactgatcgccaagaaggctcaggacgctggtatcaccgcggtcgtgttcgatcgtggcggcaacaagtatcatggccgcgtcgcagctgtcgctgaaggcgcccgcgagggaggtctggcactgtgagcgacaacgaaaaggaaacccaagtggctgaagaaactcagaacactcaggctgccgctgagtccaacaacgaggaccgcaagtcccgtcgtggccagcgcggtgagggtcgtcgtggcgagcgtcgcaaccgtcgtgaggaatctcacgagaacgagatgctcgatcgcgtggtgaccatcaaccgtgtgtccaagacccacaagggtggtcgtacgttcagcttcgccgccctcgtggtggttggcgacggcaagggcaccgttggtgttggctacggcaagtcccgtgaggtcccggctgcaatcgccaagggccagctggatgccaagaagcacatgttcaccgtgccgcgcatcaagggcaccgtcacccacccggtgatcggccacgatgccgctggcaccgtgctgctgcgcccggctgctccgggtaccggcgttatcgccggcggtgcagtccgcgccgtcatggaatgcgctggcatcaccgacgtcctgaccaagtcgatgggctccgccaccgccgtcaacgtggtgcgcgcaaccgtcgacgccctcaagaagctcgaagagccggaagagattgccgcacgtcgtggcatgtctctcgaagaggtggctccggacgcgctgctgcgtgctcgcgccgaaggcatcgccgaggcccgcaaggctcgtgaagaggctcaggccaaggctgctcagaaggacggtgagtgatgactaacctgaacatcaagctgcaccacggtctggtgaactccactccgaagcagcgtgctgcggctcagactctgggcctgaacaagatcggcaagaccgtgactcgtgaggacactccggcccttcgtggccagctgcaggtcctccgtcacctgatcaccgtcgaggaggctgactgattatggcagacattctgcagatgcatgacctgaagccggctccgggtgccaacaaggatcgtatccgcgttggccgtggtgaaggctccaagggtaagacctcgggccgtggcgacaagggcaccaagaagcgctatcaggttcgtccgggcttcgaaggtggccagctgccgctgtacatgcgccttccgaagctgcgtggcttcaagaacccgttcaagaaggaataccaggtcgtcaacgtggctgctcttgcggaactgttcccgcagggcggcgagatcaccgtggctgatctggttgccaagggtgccgtccgcaacggcttcccggtcaaggtcttgggcgacggcgaggtttcggctgcctacactctcaagggtgtcaaggcttccgcttccgccaagtccaagatcgaggctgctggcggctccatttccgaggactgattccaacggaatatagctgactgaagctcagacatgaggcttcccccgctttagggcgggggaagcctcattcgtttgcagtcaaaatgcaatcatgcatggaaaaacaaaaaaacagacgaataatgacgaaaacgccatatcggtagacgccgtacgctagactcgagcgttagagtctgtttttgcacgtgtgcgcaggtgcgcacgacgatggaaggaaccccaggtgaggacgttaatccaggccttgaagaccaaggaattgaggaataaaatcctcttcacccttggtatcatcatcatttatcgtatcggttcattcatcccgacccctggcgtcgattacaccgtcgtccagcagtgcgtcggcaagatgaacaacgcttctgagaactttatcggtctggtgaacctcttctccggcggcgccatgctgcagctgtcgattttcgcattgggcgtcatgccgtacatcaccgcatcgatcgtcatccagctgctgcgtgtggtcatccctcgtttcgaggcactgcacaaggaaggccagtccggcgaagccaagctgacccagtacacccgttacctgaccatcggccttgccgtgctgcagtccaccaccatcctggtgaccgcacgttccggcgcgctgttcaactaccagtgctcccaggtcgttccggacggttccgtgtggaatctcgtggtcatggtgctcatcatgaccggcggcaccggcctcatcatgtggatggccgaattggtcaccgacaagggcctcggccagggtatgtccatccttatcttcatgtccatctgctccggcttcctgccgcagctgtgggagatcggctggggcaccaacggtaccgatggcaattggggcaagttcgccgcggtcgtcggcacgctgctggtcatcatgattcttgtcatctacgtcgagcttgcccagcgtcgtattccagtgcagtacacccgccgtatgatcggccgcaagatgtacggtggctcctccacctacctgccgctgaagatcaacatgagcggcgtcatcccgccgattttcgcatcctccatcctggccgtgccgacgctgatcgcgcagttcggcaattccgaccagtcctgggtcaagtggatcaactccaacctggccaacaccacatccgtgtggtacatcgcactgtacgcgctgatgatcgtgttcttctgcttcttctacacggagatcaccttcaacccggacgagaccgccgacaacatgaagcagtacggcggcttcattccgggcatccgcgcgggaagcgccaccagcaactacctgagctacgtgatgaaccgtctgaacacggtcggcgccgtctacctgctgttcgtggcgcttatcccgacggtgctcatcatggcgctgaatctgaacaccaagctgccgttcggcggcaccaccatcctgatcatcgcaggtgtcggcctcgacaccctgcgccaggccaaggcccagaccgaacagttccagtacgctggcttcctgttcgaggacaccgaccacaaggaaggtaagtaaccacttgaatcgtgatgccgtttccgttgatcgggagcggtatcacgatttttatgttaggtaatccatcatccgaaaatccccgttgaggggaatgaacgaaacggagaacaacacatgcgactgctgatcatgggcccgcagggcgtaggcaagggcacccaggccgctctgctgagcgagcactacggaatcccggcgatctccaccggcgatatcttccgctacaacatcaagaacaagaccgagctcggcgtcgaagcgctcaagtacatcgacaagggcgagcttgtgccggacgagctgaccaacaagatcgtcaaggaccgtctggccatggacgacgccaagaacggctggattctcgatggctatccgcgcaacgcctcccaggtcgaggctctcgacgccatcctgggcgagctggacaccccgcttgacgcggtcgtcgcactggatgcagatcacgacgtgctcatggagcgtatgaagaagcgcgccgaaatcgaaggccgctccgacgacacccctgaagccatcgccaagcgtcttgacgtgtacgccaaggagaccgcgccgctgctggacatctaccagaagcgcggcctgctcaagacgttcaatggcgtcggcgccgtcgacgagatccaggccaccatcgtggcggagcttggctgaaggaaaaaccaagcagaataacatatttccaacgaaagcgggaatcgcgacacgccgaacgtgtcttgattcccgctttcgtgtattcttgcaagttggtgtgtcttcgggcacgcatagtaatcgccaaggaacggaacgaggctcatggctaaagacggtgtgattgaagtcgaaggacaggtagtggaagcactgccgaacgcgatgtttcgtgttgaactcgaaaacaagcatatcgtgctcgcaaccatttcgggcaagatgaggaagaattacatccgcatcctgccgcaggatcgtgttgtgctggagatgagcccctacgatctgaaccgcggccgtattacgtaccgttacaagtaaaggtacacaagcaaaggaaaaccatgaaggtcagccctagtgtgaagaggatctgcgagaactgccgcgtgatccgtcgtcacggccgcgtcatggtgatctgcgtcaacccgcgccataagcagcgtcagggctgagagcagatccagcggcataaacagtacaggcgctgagtcacagcccgtgaaagcgggatgaaccccgggtacgcaggcccgggccgggaaaccggacgactcggtgcaagacctgcggaaaacagaaggaatcgcaatggcacgtcttgccggagtcgacatccccaatgagaagcgcatcgagatcgccctcacctacatctttggtgttggtcgtactcgtgccaaggaaacgcttgccgcgaccggtatcaatccggacattcgcgtcaaggatctgacggatgagcagctgattacgctgcgtgattaccttgagggtaactacaagatcgagggtgatctgcgtcgtgaaatcgatgcggacatccgccgtaagatccagatcaactgctaccaaggccagcgtcaccgtaagggacttcctgtgcgcggtcagcgcaccaagaccaatgctcgtacccgcaagggcccgaagcgcacggtcgccggaaagaagaaggccaccaagtaatcggtggctgacagttcaagccacgaggtgtgagcctcatcgtttgaacatcaaagcaaattcgttattaggaaacgagggtcaatggcagctcaaaagcaagccgcgcgcaagccgcgtcgccgcgaccgcaagtcggtcccggttgggcaggcgcacatcaagtccactttcaacaacaccatcatttcgatcaccgacccgtccggcgcagttgtgtcctgggcgtccggtggcgatgtcggcttcaagggctcccgtaagtccacgccgtacgccgctggcatggccgccgaatccgcagcccgcaaggctatggagcacggcctcaagaaggtcgacgtgttcgtgaagggcccgggttccggtcgtgaaaccgccatccgttccctgcagtccgccggactcgaagtcggttccatcaccgacgtcaccccgcaggcacacaacggcgttcgtcctccgaagcgccgtcgcgtctgagcactagaagaaatcatcaatccaacgccgcttatggccggtgagtgcaccaccggcctgaagctgaaaggataaccacagtgcttatcgcacagcgtccgacacttaccgaggaatctctcaaccctcagcgttcccgcttcaccatcgagcctcttgagcctggtttcggctacacgcttggcaactcgctgcgccgtaccctcctgagctccattccgggagcggctgtgacttcggtgcgtatctccggcgtcccgcacgagttcaccactctgccgggtgttgaagaggacgttaccgaaatcctgctgaacatcaagggcatcgtgctcaccagcgaatacgatgagccggttgtcatgtatctgcgcaagagcggcaagggcgaggccaccgcgggcgacatcaccccgccggccggcgtcaccatcgccaacccggacatgcatatcgctaccctcgccgaggatggcgaactcgagatcgagttcaccgtcgagcgtggccgcggctatgtgcccgcccagatgaacaagcaggataacgccgagatcggccgcattccggtcgactcgatctactccccggtgctcaaggtgagctatcgtgtggaagccacccgcgttgaacagcgcactgacttcgacaagctcatcctggacgtggagaccaagccggctatttccccgcgcgatgcagtcgcatccgcaggctccaccctggtggagctcttcggtctgtgccgtgagctcaacacccaggctgagggcgtcgaggttggccctgctcctgtggcagaggaaaccaacccggagatgaacatcccgatcgaggacctgaaccttactcagcgcagctacaactgcctgaagcgcgagggcatccacacgatcggcgagctggtcgcccacaccgagcaggatctgctcgatatccgcaatttcggtatgaagtccatcgatgaagtcaaggagaagctccagtctctgggactcgccctcaaggcttccccgctgggtaacttcgataccaataatctcgaaggtggcaccttcttctcgccggaagacgagtgatccgccacttttgacctaaccgcttcgttggattcggacgttcgggcaactgcccacctgaatccaacggggctttcaaggagaaacaatgcctacaccaaagaagggtccgcgtctggcctccagcccggctcatgagcgtcttatgctcgcgaacatggccaccagcctgttccagaacggccgcatcaccaccaccctgccgaaggccaagcgtcttcgtccgctggccgagcgcctgatcacgctcgccaagcgtggtgatctgcacaaccgtcgtcgcgtgatgcgcgtcatccgcaacaagtccgtcgtgcacaagctgttcaccgagatcgccgagcagatggagcagcgcgaaggcggctacacccgcatcgtcaagatcgctccgcgtcgcggcgatgccgctccggcagccatcatcgagctcgtcaccgagccggtgagcccgaagcaggccgtggtgaaggaagccgaagccgcaaccaaggttgccgctgccgaggctccggaagccgccgctgaagaggctaccgctgagaacgccgagtgaatcgctcttagctgattgaaggccgggaatcgcaaggttcccggcctttgtcatatctgctgccaagactgtcgtgccacatgcctcactatgccagccatttgctatgctcgatgccgtgagactacgcatcgatttggcatatgacggtaccggcttctacggatgggcgaaacagcccgaaatacgtacggtacagggcgaaatcgaacgcgtgctgcataccattcttcgcgtaccggaaggagacccgaccgaaccgctgcgccttaccgtggccggacgaaccgacaccggcgtgcacgcctcgcatcaggtatgccatctggacgtcaacgaggacgtgctcaaacgctgcgtcggccacatggacgtgccgcccgtcatcgcgcttacccgcagacttcagcgtatgctgccggccgatatcgcaatccgcggcatcgcacccgctccggacggtttcgacgcgcgtttctccgcgttggaacgtacctacgtgtaccgaatcgccgataggtcaagcgaggtggaccctcgtaccagaaacttcgtattgcatatcgacgatgaacttgacctcaaatccatgaacgaagccgctgcgatgacgatcggcctgcacgatttcggctcgttcgccaccccgaatccgggcggcaccaccatacgcgaggtgaagaccgcgtattggcgtcgcgtgccgcagcggacgcttatcgacgacggcatgacgatgggggagcggtaccgtacgccgaccgtggaatcgggcctcgtctgcttcgtgatcgtcgccgacgcgtttgcacgcaatatggtgcgctccctcgtcaacggctgcgtgcaggtcggtatcggcaaacgttccctcgactggtttgcaggaaaaatggcggctccgctgcgcgaaggctccacaggaccgatcgcgccgcaaggactgacgctggagcatatcgaatatccggccgacgaccagctggcggtccgcgccgaagccattcgcgccaagcgcacactgtagctttattgcgattgtcatagccatgttacgggcgattgtcatgtccattgccgagacattgtcgtaacagaccgtttcgttttccggaaacgctggttcgttaggtttttcttccatcaaggcacgatgcctcagattggcatgcgttcgcatggggtggaagggagcgtggaacgatgattgaatccgccgcacgaaggttggcttcggaactggtcgatcgtcgggagtcgatcaaccgggagctgagccgtaatggcgtacggttcggcatctacaagaacggcgagtaccatgaccggctgtttccgtacgatccgattccgcgcatcatcgaatcggacgaattcgacagaatggaagccggactgaaacagcgcgtcaacgcgttgaacgcctacctgcgcgacatctactccgacaagcaggccatcaaggacggcatcgtgccggaagaatacgtgtacacgtccgcgggatactttccgcaagtcaacggcgtgacacctccgggcggcgtgttcgcgcacgtcgccggcgaggacctggtgcaggggcaggacgggcaatggtgggtgctggaagacaatctgcgcattccatccggtgccagctatccgctgttcgcccgcgatatcgaacgcagaatcacgcccagcctgttccgcaacgtacgtgtgcgcgacaatcgcgattatccacgactgctgcgccaatccatggatttcgtctccaccgacggcatagcagtggtgctcacccccggcaggtacaattccgcgttcttcgaacatgcatacctggccgagaaaaccggcgcggcgctcgcgttccccgaagacctcgaagtcgtggacaacaaagtgtacttcctcgactatgccggcaggaaacaccgcgtcggcgtggtctaccgccgtctgtccgacgaatatctcgacccgttcgcgttcaacccggattccgtgatcggcgtgccgggaatcctgtccgcctacaggtcgggcaatgtggcgatcgtcaacgctccgggcaacggcgcggccgacgacaaggccatctactatttcgtgccgaacatgatccgctattatctcggcgaagagccgattctgcacaatgcgccgacctacatgccgatgttcgacaaggaccgcaaggaggtactcgaccggctcggcgaactggtcatcaaggatgtggcggaagcgggcggctacggcgtcgtgttcggctcgtcgctcgaccggtcgcaacgagaggaactggccgaacgcatcaaggccgaaccgcgccggttcatcgcgcaggaggtcatccaattcaaggacatcgacgtggtggaccccgaaaccggacagatgagcccacgtaaatgcgacctgcgcgccttcgtggtgaccggcaagaacacgcacgcatggtattcgggactgacacgctactcgtccataccgggccagatgatcgtcaactcatcacagggcggcggtttcaaggacacctgggtactggccaaagagaccggcgtggagcatgattacgcacccggctcggaggtcgtgcgcgtgctggagcagtcccgcaagcactcgctggcactcgtcaccgcgtcgaaggccgacaacctgttctggctcggccgctacacggaacgcgtattcaccacgctgagccaattcttccccttctacgaccgtgtgatggacacggatgtggacgcgttccgaccgttcgcccgtgcgctcgacctgccggaggatttcgaggatttcgacgcgttcatccacagcttcctgtacgacgagaagaatccggattccgtacgcagcgccatcgtctacgcgttcaacaacgcggtgattctgcgccccgaacttggttctcgctcgttgcagcaggtggagttggccatgagctccatagtggaggcatccgaatacggcggcatggacgcggacatcttcaaacaccgcgacatcgcggacaacatgctcgccttctggggaggtgtggagaattcccccgtcgaaccgactctgaaatcgttcattttcgtgggcaaatatctggaacgtctggatctgtacacacgattcggatattccgtggaagagctcaaggcgccgcttgccaaactgggcagctacatcctgccgttgaacggtctgccggtaccgcaatgcttcgccgaaggattgcgctggctggtcggccagctgccgcagcggggatatgcggagcttgcggaaaaactggggatgctgctgaaagatttcgatgggcgcatctccacgaaggatctgaaggatctgggcatgctcaacacgatggacatggacgccgcgcgactgtgaagaatacgtgccacagccatcgcacggtgcgtgtataacggctagaacaaggcccacggcgtggaaaacgccgaaggaacgacaataatcgctgaggagacgatgtgaagaaactggtgtttgactatgagatgaagctctcattcagctcgcccgtgaccgaccatcgcttccaactgcgctgcattccagccaccggcccacgccagcaggtgatcgacgtggcagtcaaaatcgaaccggatgtggaactcgaaaccaccatcgattccttcgattccgtggtgatgaccggattcattcccgaaccgcacaccatgttcaactactcggtgaccggcatcgccttcgtggacaacgcgcatatcaaatccgaaatctacaagccgctgtaccgcttcaattcggcgttgacagtgccggggccggccatcgaagcgttgatcggcatctgccgtgaacgcatcgcgtccctgcctgccgactgcacgccgatcgaccaagcccgtgaggtgatggacgaggtgttcaaaacgttcgtctacacgccggcctccaccaccatccgcaccaccgccgaggaagcgttcgctcaacgcaagggcgtatgccaggattacgcgcacgtcatgctgtccgtgtgccggcacgtcggactcactgcccgatacatcgcgggattgctcggcggcgagggcgccacgcacgcatgggtcgaaatctaccatgatggacgttgggtcggtttggaccccacacaaccgtatggtcgacgacaactacatcaccatcgcccatggccgcgattaccgcgactgcatgctcgacatcggcatcttctccggctgcgacgtcaagcaggaccagtgggtcaacgcttccgtgcacgagcagggatactgattccccgacgttttctcgatgccggattccgtatttcggcagatgcaaagcagataaacaaaaaaggccgaaacgccattgtttcaaccttcattgcatgcggataaggcgagattcgaactcgcggaggggttcgccctcacacgctttcgaggcgtgctccttagaccgctcggacacttatccattcgtcacctgaaaacaagcaacttgataattgtgccacagcggtggcgattgtcaaatcggactggctgcaacggtgtgatttccggcgtgtcttgctttgcgcccgactgtgcgtccttaggcgaacagcgcttcgtcgaaggaaggatagccccaatcaagcgccaattcgacacggtccgcaatcagaccggcaagcacgcccagggattgcgctcgcgaatccgtcgactgttttgcattggtgacgcgtgactgggaatgatcgttcgcggcattggagcttccggcgattgccgttatctcgcttcgcgcgcagttcatttcgatggtggcgtcggtcggtgccgtaaggccggtggcggaatcgagcatcgtgtcggggtgggcgagcaaggcggtggcctcgtacgttttcctacgatcgtcaatggcgcccgagaaggatgcgaaccgttgcgatgtggtcttatgacgatcgctgatatccagcgtcgcatggccgctgttgcgggccgccagcacttccatggcgaatccggcacggtcttcggcctgcgcggcggtggcaagggacttggaatcgacgtcaagcgattcgacatcgtcaaaacgcgacagcgtgatcggcgcgacggccaccgacagttgatcgcccagtgcgcgagccatatgacgtgcctgcgcgctgcgcaacgtgccttcggcaaaacgcgccggacattgcgccgcggtgttcgtccatgcggagaccgcctgctgcgccgagaaatagcggcggatgatgtgctgatgctggtcgtgtgcgattttgttatcggcggtggcatcgaaataggccttctcgcacgggctttgccgttgttcggcttcagccctgcctgcgatcctgggcatggagcatgccgtcagcgccggcatgaggatagcggtgcaaagcaatgcgcagacgcgtttcgcgataaaagaaaccgagcggaaagaaggggtacgtgtctgcatgaatcattagactaatatctgactgtgaccattgggccatgcgctcggaataacttcatataggaggtcttggaaatatggaactggacctggcaggaatgcaccagctcgccgctgggcagggaattgatcccgagacgctggatgccgcactctcggaagcattgcgactggcatatctgaaaacccctcacgctgcgaagcacgctcgcgtcgagcttgatccgcgtgcgggaagcttcaccgtatgggcccaggacgagattcctggcgagccgactgaagacgatccccatcccgcgccgactctgggcgaggaatacgacgacactccgcacgatttcggccgactggccgctgcgaccgctcgtcaggtgatcagccagctgttccgcaaggccgaggatgacaaggtgttcggcgcgttctccggtcagaagggcaagctcatcaccggcatcgtgcaacaggacgtcaaggacacatccaacgtgcacgtggccgtcggcgacgtcgaagccctgctgccgcgccgcgagcaggtgcccggcgaacgctaccgtcacggcgaacgtatccgcgtgtacgtggtgaacgtggcccgtggtctgaagggcccggaaatcgtggtgtcccgttcccatccggagctggtccgccgcctgttcgaacgtgaggttccggaactggtttcgggagccgtgtcgattatggccatcgcccgcgaggcgggcgcccgcaccaagatcgccgtccgtgccaacaccgaaggcgtcaacccgaagggcgcgctgatcggccccggcggagcccgagtgcgcgccgtcatggagaacctcggtcctgagaaaatcgatatcgtcgactggtccgcggatccggcgaaattcgtcgccgcggcactgtctccggccgtcgccaccggtgtgcaggtgatcagcgagaagaacaagacggccatcgccttcatccacgatgaccagctgtccctggccatcggcaaggaaggccagaacgcacgtcttgcggccaagctgaccggctggaagatcggcatcgaatccgctgaggcgcatgccaagaagatggccgaatcggcggaccattccgatggggaaaccgaggaataaacaacacttccggtagacaacaagcccgtggacgtacaatccacgggcttgagtatgctggactcgacaatccaaagcgtgacggccatgccgtcatgcccagggaaaagacgaggtatcacgaacatggttgcacgatgagaaggaacaagctcgccgtgaatcagtagcggtcgcgcccgtatgcgcgcggcccaagataggagaattgagtgccgaaagcacgcgtatatgaacttgccaaggaacttggcgttgacagcaaaaccgttttaagcaaacttgaggcgatgggcgaattcgtgaagtccgcatcgtctaccgttgaacctcccgttgcacgcaagctgaggaacgcattcgcgtccagcggacagggcaacgcatctgattccaagaagccgggccatacggccaagaagcctgccgaaccggcatctcattccatgccaaagccggccgctccgtcagcaccgaagccggctgcccccgcagcgccgaagccgcgtcatgccgcttccaagtccgatgccccgaagccgggtcatcgcgcgccgcgtccaggcgaatcccgccagcatggcaatcgtcctaacggcaacgccccgcgtccgcagggtggagaccgccgccagtccggtcgcccgacggccgttccgggagctcgcccccagcatggcaacgctccgcagggcggcaacaacgccaatggcgcgaagccgcacaccccgggaccgcgcccgggcaacaatccgttcagccgcaagcagggcatgcacaccccgactccgggtgatattccgcgtccgcatccgatgaaccgtccgagcgtcaacaatggcgaaggacgtcgtggtggccgtccgggtcagggcggtggccagcgtggcggcttccgtggtcgtccgggtcagggcggcgcgaagccaggccagtggggccagcatcgtccgggtcagggcggtggccagcgtcccgccggcggcggcaatcgtttcggtggcaatggcggcggtttccagggcggcaacagcgctccgagcaatggtccggcacgtggtggccgcggccgcggcggcgctgcaggcgcgttcggacgtcagggaggcaagtcctcgaaggcgcgtaagaaccgtctggcgaagcgtcaggaattccaggagatgaaggctccggtcatcggcggcgtgcgcattccgaccggcaacggacaggaagtccgtctgcgtcagggtgcgtccctcgccgatctggccgagaagatcaacgtcaatccggcggcgctggtcaccgtgctgttccaccttggtgaaatggccacggccacccagtccctggatgaggccacgttccagatcctcggcgaggaaatcggctggaacatcaagatcgtgtccgccgaagaggaagacaaggagctgctgcagcagttcgacatcaacctggacgaagaggaactgcaggaggacgaggatttgaagccgcgtccgccggtcgtcaccgtcatgggccatgtcgaccacggtaagacccgactgctcgacaccatccgccgcaccaacgtcatcgaaggcgaagccggcggcatcacccagcgcatcggcgcataccaggtgaccgtcaaccttgagggcgagccgcgcaagatcacgttccttgataccccgggccacgaagccttcaccgcaatgcgtgcccgtggcgccgaactcaccgacgtcgcgatcctcgtggtcgccgccgacgacggcgtcatgccgcagaccgtggaagccatcaaccacgcccaggccgcgcatgtgccgatcgtggtggccgtcaacaagatcgataagccgggcgccaacccggacaaggtccgcggccagctcaccgaatacggtctggttccggaagaatacggcggcaacaccatgttcgtcgacatctccgcgaagcagggcaccaacgtcgacaagctgctcgaagcggtgctgctcaccgccgacgccgagctcgacctgcgcgccaacccggatatggacgcccgtggcgccaccgtcgaagcccgacttgacaagggccgtggcgccgtggctaccgtgctggtgcagtccggtaccctccacatcggcgatgccatcgttgccggcacctcctacggtcgtgtccgcgccatgctcgacgaaaacggcaaccacatgcaggaagccggtccgtccaccccggtgcaggtgctgggtctgacctccgtgccgaccgcaggcgacctgttcctggtggcctccgacgaccgtaccgcacgtcagatcgccgagaagcgtcaggccaccgagcgtgcggcccagctggccaagcgccgcaaggtcgtttccctcgaaagcctcaaggagcagttcgccaagtccgaggtggatatgctcaacatcgtcatcaagggcgattcctccggttccgtcgaggctctggaagattccttgatgaagatcgaggtgtccgacgaggtcggcatccaggtgatccaccgcggcgtcggcgccatcacccagaacgacgtcaacctggccaccgtcgacaaggccgtcatcatcggcttcaacgtccgtccgaaccgccaggtggcggatctggccgaacgcgaaggtgtggagatcaagtactactcgatcatctacaaggccatcgaggacatcgaagcatccctcaagggcatgctcaagccggaatacgaagaggtcgtcacctcccactccgagatccgcgagatcttccgctcctccaagttcggcaacatcgccggcgtcatggttcaggacggcgaagtcaagcgtggtacgaagtgtcgtatcctgcgcaacggcatcgccaccgtcaacgacctcgagatctcctcgctgcgtcgtttcaaggacgacgtcacctccgtcaaggaaggctacgaggctggcatcaacctcggcaccttcaacgacatcgagatcggcgatatcatcgagaccttcgaaatgcaggaaatcgagcgtaagtagccgagtgcttcgagcttcgcatcgataaccaggtaaggaacgcccacagccggttcacgactgcgggcgttccgtgatacaacaagaacttttcaccaaaaggacagcaatggcaggaaccaatccccgcgccgcgcgcatcgcggcgttgattcagcgtgtgatcgcatcgtccatggaggcgcagctgcacgacaagcgactggccaacgtgaccatcaccgaagtgcgcgtcaccaacgatctgcagatcgcgaaagtctactggactcagctcggccatgaaggacacgagcagggcgaacgccgccgcgcgcagcaggccctgaaccaggccaaaggacgcctgcgttccctggtaggcaccaaggccggactgcgactcaccccgcaactggaattcatcttcgacgaagtgccgggcgaggcccatgagatcgaggacatcctcgcgctcgcacacaagcgcgacgaagaactcgccaagtcccgcgccaacgcgcaatacgccggcgacgccgatccgtacaagcacgacgagcccgatgatgacgacttcgacgatgatgacgatgtcgaggtcgaggattgggacgatgacgacgaagcctgacaactccggtctgctggtcatcgacaagccgcagggcgtcaccagccacgatgtggtcgcggcggtgcgtggcgccctgcacatgaaacgcgtcggccatgccggcacgctcgacccgatggccaccggcgtgctggtggtcggcttcggcaacgccacacgtctgctcaactacatcgtcgaccacgacaaaacctatctggccaccatcagactcggccagcgcaccaccacggacgacgccgacggcgaactgctgccgggggagggaactatcgccgaattcccttcacgacagaccgttgaagacgtcatcgcccatcatttcaccgggcgcatcgagcaggtgccgaactcctattcagccatcaaaatcaacggccagcgtgcctatgatctggcccgagaaggcaaggatgtggacctcaaggcccgtccggtgaccatctcggaattcagtgtttcggcagtgcgatacggctatgcttcgaccacatgcgcgggatcacctcttgccgatgccatcgaaatcgccccggaggaatcctggcatgccgaaaccgacgggcaaaacgaaccgaacatgcagccagtcatggaactcgacgtgaccgtgacctgctcggccggcacctacatccgcgcactcggccgcgatctgggcgccgaactcggcctcggcggccatctgaccatgctgcgccgcatccgcgtcgggcgtttctcggtggacatgccgaacgtcatgaccgcccatacggaagctaagaccttcaccaaccgcgaaggcatcgaagtgacacgcaaccgtgcggtgcttgacgatgccgagcatgccgttgaccacacactcgacctggtcgccagcgcggccgcttccatggacatgcttcccgtcaccgaacaggaggcgacggacctgcggttcggccgtagaatcgcccacgacatccatacgaccatggccgcgtacgttcccgaaaccaacgatctggtggcgatcgtggaacgcgccaaacgtggcgagaccaagccggtcgcggtcttcaactgaaacaatcaagaccggccggcacgcaatacgaacacgacaaacacacggacaatacgcaaagaaggacacatgaagacgatcacgcttacccccgatgccagcggcatggtggattggccgaccctgagcaacgacaagaagtccgtggtgaccatcggctcattcgacggcatgcatcagggacatcaggcggtcatccgccgtgtggccgaactcgccgaacaggagcaggcgttctccgtggtggtgctgttcgacccgcgtcccgcgctggtgcacgcttacgccgccaaacatgacggtcaggaaccgcccgcaggcacgcctgacacgcaggcgctgaccagtgtggacgaacggctgcgcgccatcgacgccatcggcgtggactacacgctcatcgtgcgctacaccatggcattctccgcgaaatcataccgcttcttccttggccagatggtcggcaaactcggcatgcgcacgctggtgctcggctccgacgccgccatgggtgcgaaccgcgccggaaacgtgaaggccattgagaatctggcgctcgccaccggcgtgttccagctggaggtcgtggacgattttggtccggggctgacccgagtgccggtcaatgcgaagccggtgatgccgtccgaacccggcgagccttccgaccctctggagggggcttccaaggccgaacgacgcgcatggagcaagaagcatcaggccaaggaagtgcgcacgtggagctccaccaatgtgcgctatctgctgagccaaggccgtatcaaggacgcagacgcgatactcggccacgcgcatgccgtggaaggcaccgtggtgcatggcgaggaacgcggccgcaccatcggattcccgaccgccaatctgagcgagaacgtcgccggatacctgccggtggacggcgtgtacgccggctggctggtcgatttgggggagaagtccgccgacggtggcgaagaagccggggagaagccggccgacggcgtatcgcagcagtatgacgcttcgtccgtcaacgcgcgcgtggccatgcagtcgccacaccgctggccggcggccatctccatcggcaccaagccgacgttcaacgaggacggtgacgccgaacgcgtggtggaagcctacgccatcaccgatgactggttggacctgtacggccatcaggcgcgcgtggaattcgctggattcctgcgcccgcagatcaaattcgattcggccgacgatctggtggtcgagctgaaacgcaacgtcgaggagacgaagcgcctcaccgcttgagacgaatcggttcgattgatttgattggttcgattgacgcgaatcattgacgccatctgtgttttgttacccaaacgggctttcccgggttgcaaaatgcggatggcgatgccgtttgggcatcggcgacctatcgcagaatcgcggccaacgcgtcctgcaacgtatccgcctgcaccacgcccattcccggcacggcgacgttcttgcgcagcgtcggcacaacggcggtggtgaaaccaagacgcgccgcctcacgaagccgatattccagtctcggcaccggacgcacctgtccggtcaacgaaatctcgccgatcgcgcacgtcgtgcggggaatcggtttcgatttcgcagcgctcgccaacgcggccacaatcgccagatcgcaacccggctcacgcgcctgaccgccggcgattgtggaaatgtacaggtcgttggccagcagattgatgccaccgtgacgatataacaccgccaccagcatggcgatacggttggagtccacaccgttcgccgcacgacgtggcgtcggcagcaccgacctggtgaccagcgcctgcacttcaatcggcagactgcgatgcccatccaacgtgaacgtcacgcacgtgccatccacctgcgtcgccgcagaaccattgccggttgataggaacaggccggacggatcggtcacctcctcaatgccctcgccgctcatatcgaaacagccgacctcgtcggtcggtccgaaacggttcttcacggcgcgcagcatgcgcaacgcggtttcggcatcgccttcgaactggcagaccacatccaccaggtgctccaacgtgcgtggacctgcgatcgaaccatccttggtgacatgacccaccaaaagcactggaatatcaagggttttggcggtgtcaatcagcgcgctcgccacttcgcgcacctgcgtggatccgccggagatgccatcgacgtcctgcgagacgatggtctgcgccgaatcgacgatggccaacgccggcttgaactgttcgataagccccaacaccgtggacagatccgtggtggaggcgagcagtagattcggttccatggcgccgatgcgcgacgcgcgcatgcggacctgcgcctgcgattcctcgccggaaatatacagtacggtattgcgctcggtggcgaacgccgtcagcctcgccacattgccggcggtttccagcagcaatgtcgatttgccgatgcccggctctcctgcgatcagcgtgaccgatcccggcacgatgccaccgccgagcacgcggtcgaattccgaaaatcctgtggcgattctggagatgttctccgtgcctatgtcggtgatcggcctcgccgcggacgatgcgaccggatgcgattgcgtgcgcgaggtccgtcctggagccgcggtacgcgagcctgccgcgggacgggcttcatggaattcctcaatggtgccccattgaccgcattcggggcagcggccgagccacttcgggccgctccagccgcattcggaacagaggaattgcgaggacgtctttgccatatcgccgacaatacggaggttttgggacaagacgttcgcgggtggcgtactcgttgcacagacattgcgctgaaaaccgtttcgggaactggattccatgacttcgaggggatggttgcgcgtcttatggctgtgaaagaatgacaagcatgtctgatacgcagaattcctcttcgcatggcaaattgattgccgccgtcgtagcagccgcgcttgtggttgtgcttgctctgatttccgcatttgtgtggcctggttgggccttgaacaagaacggacaggccggtcaggccggtcagacgagccagcaggcttccacttcgaacggtacggacggcgacaagacggagcccaccaaaccgtcgatcgatgccgtggcattgcccgacggggccagcgagctgctcaaggccatgccggattccgtattgaattacgcgcgtaccaaggctgacgccagcacgacgtggtccagcacctctcccgtcgaggaatacgcgttgacgtattccaccggcaagaaaggacaggacgtcacgctggaagtgggccagtggaacgacggcgacaaggcgaaatcccagtacgacacgctggctgaagccatgaccggcaaagagctgggaagcggcaacgtgaaggtctccggcaagacgactggcgcctacagcgccaaagccgatccggacgacgataccaaggccgttgccgtgtggcgcaacgatacggtggttttctatgccaccggcgcgaagaacgacgtccagcgtttctaccagcagttccccctgtaacgtcgacggaatcgtctcgatggcgaatcgcggccggctgatggaatatcacgcggaaaacgaaacgtgattttccaccatatgaatgcctgcgcgcgtattcgtccccgaagcagtgtagtattgggcaagttgcaaacttttaccctttgagtttaaggaacggaggctgagatgggctcggtcatcaagaagcgccgcaagcgcatgagcaagaagaagcatcgtaaactgcttcgtaagactcgccaccagcgcaagtagtcttcaggcgcgtgtgaagcgtccgctcaaacaaaatcccgcgattcctttcggagtcgcgggatttttgctatctgcgcggcggtgtcggccggtatattccgcaccagccgacacgcctgcctgtcaggatctcacttgttggggttgtccatcacgcgcgggccgttcggatcgccgacgatgacctggtccaccatgttcaggaacaggccgtgctcgaccacgccgaccgtggtgatgaggtcctgcgcgagctcctgcgggtggtcgatgcgctcgaggtgcagatccaccacatagttgttctcatcggtgcgcaccggctcgccgttcgcgtcgagacgcagcaccggcttgtagcccttggcctcgaacttcttgacgacctggcctgcgccgaacggaatcacctcgaccggcagcgggaacttgccgatggtgtccacgaccttggactcgtccacgatccacacgatcttgttggagttggtggccacgatcttctcccacaggagagccgcaccgccgcccttgatgccgttgaagttcttgtccacctcgtcggcgccgtcgatggtcacgtcgatatggtcgacgtcatcgatgttgacgatcttgatgccgtagccttcggcctgctcctgggtgcggcgggaggtggtgacgcccgtgaactcgaggccttcctccttgacgcgacgaccgagctcgtcgaccaggaaacgcacggtcgagccggtgcccagacctgcgatcatgccgttctgaatcagctttgcagcctcgatgccggccgccttcttcagcgcgtcctgctgtgccttgtccatgatcctccttcgatatggggttaagaccgtctccatactatcggatgcgttgattttcaaggcgcgaatggtcggttgcgggagcaggtgtctgttttggactgcggaaaagttttcacggaatgtttcacggtcctgcgtgaggtggcgtgcaaaaaagccgcgcatgaaatgacatgtggggagcggcttgcgtaaagcggctccccacatgtctcgctcagctatgtttgaccgcgaacggcgcctcgtccaataccagcgtgccgtcacccatcacatagccttccacggcgatatacccacggatgagacgtggattgccgtcgaaggtcgggctggattccggtgggggagtgaaccgcaccgtacccgacaccgacaggcccgatgggcttggacgatgcggcagtttcggcagatcctgcgattgcgatgaagctgcctgttccgatgccgattcttcgtcgtcttgcgattcgctgtgcgattcgttcgcattctgcggtacggccgtgctgtccgtgtccgtgccgtccgcgttgcccgtcaccggcttgtcgttctcgtcgccttcacggggaaaatagtcgggtttgaccagcatctgcgcataggattgatgcggttcaccggattcgtccgttttcccggattcgtctgtttctccggattcgtccggttcggctggaccgcccgcgtccgggaagctggattcgggtatgaccttcgtcgcttcggtctcaagcattgtggtggtttccgccggttcggtctcgagcacggtcgtttccaccgcatcatctgcgtcgtcatcggttgtctgtccgaaatccgcaaggtcgtgggaaacgccttccggctccgccagcatgctggcgatcgaacgcggcttcgtgctgttgctggaattagcggtatcggcaccggaatcgccggtgccggtcgtggcggaatcgccttgtccgcgtcccatgtggtattcggcggcgctgatcgcaccatccatcagcatcctcgcatcctcgggaacatcggtgccacgcgaatactcggaagccagtagcgactgccatccttccaacggcagatagccttcgcgcacatgcgaacggcaatcgcccgcatacgtgcgtgccagctcgtccactttctcgttgcccgcgttgccggcatgacccttgacccacacgaatcgcaccgaccccgccctatgtgcgatctcattgtcgatggcgcggatcaaatcggcgttcttcaccggtttcttctgcgaattcttccagccgttgcgcttccaaccctgcacccacttggtggagcagttgatcgcatactgcgagtcggtctcgatcaccaggtcttcggaaccgggatgcgctcgcaacgcctccagcacggcgcataattcgccgatctggttggtgccgttcgtcgcgccgccggcatcgcaatcgccggcatgctcgtgccccggcttgccgcctgccgcgggctcgtggtcggcccaggcccaacccatcggaccattcggattgccaagcgcggaaccgtctgttgaaaccgtaatcgtcatgcttctaccctacgaaagccgcgcgactcgccgcttgcccgtcataccgcatggcaacggcatatgcgattagtcgccgagacacagcatgacggaggcgcggaacatgccgtcgctgtgctcgaaggaggccgtgccatggtgccgttcggccgtctctcgtacggtggcggtgcccagccccgtgccaccatgtttggtcgagacgagatcgccgtcgatctgttcgatgctggtatcggcttcgccgtacgtgttgtccaccgtgatgaacagggccgccggagggccggaacgataccggatgcgcactttgagccgcctctcgccctgcgtttgctgggtgatggcctccgtggcgttctccagcagattgccgaccatggagcataattccgcgttgttgatgttgatgtattgcggcaccgccgctttgacgtccacatccgcacccaaatgccggacccaatcgcaatagtagacaagcaccgcgttcagcgacgcatgctcgcaatactgcattggtgccgtttgcagcagccggtgtttggacatctcatccagatatgagcggatgccatccatgtcttcagccgcggccaacgcctgcagtgagtggatgtggtgacgcacgttgtgcttgatctgacgcgcctcacggatccgctcgttcatgtgttgcagctgcaacgtctgcaaagcctcataatgctgtcgcctgcgggccgcgagcagacggtccgactgctgaatcatgtaccagatgaggaaatacaccaacaccatgaaacaggaatagaccaccgccacggtgaacgcgatttccagcatatgcgagtccagcagcgtggaattgtccgccggcatgcaccacaccacaatcgcggacgaaacgaacggaaacagccagataagctgccagaagcctttgctgatggatggggaatcgaatgtggctggaatcgaatcatgcagcggatgccaaagcgagaccagtacgacgacgtcaagcagcagcagattgaccagtcccggccagccgacgcggagattggttgaatccgcgccaagaacggccacatcgatgacgagcgacagatagtagacgatcgccaccatgtaggaagccgtggccacaatcagcaacagttgccgccatggcagttcggtcagccatcgcaggaccagcagcacaagcggcgcggtcggaatgaccgtccacagtgatgggatgcccagagtgccgcacagcacgccgcatagcaggaaccagaccagtccgatggacatgaacagtgtgccgttacggcgtggattgtccatgtgactccatgccatgatgaggcacaatgccaggccggacaacgcgttgagctgctctccgatggcgaagaacagacctgacggggtggtttgggcgatgccgttccggatgatttcgccgagtggtgcgaacatgtcagtcctccgtacgcatgcgggtgaacgtgtattccgcgtatgcgcggcaggtggtggtcaccgccgttttcgtgataggaatgcgtttgccgcctttcatgacgaactgcgcgttggtgatgccggacacgtagtcgaagttgacgagcacgcctcgcgcggtgcggtagaagttgtcgaacacggtgagccgttggtccacgtcggagaaattggtgcggattttggtctgggtgccgtccgcgaacgtaaattccacgtagtgcgcgttggacagggcgtatgcgatgagccgccggtccatggtcacggccggattgccgaacgccacatgccagctggaattcaccgtgccgggcgactgcgcctttgccagatgggtgaccggcggttttgccttcagctgctcttcgacgcgttccatggtggcttcgaaggttttgcgattgacgggcttgagcagataaccgctcgcctgcacctcgtagccgagcaccgcgaaatcggtgctggacgtgatgaagacgatcgcgcagtcgtcgttctgattgcgcagcagccgcgctatgtccaatccggtggtggcatgcggcagattctcgtcgctgagataacagtcgagcagcagcaggtcgtaacggctgttcttccagctttcgatgaacgatttcgcgtcggggaaaacgtcacagaccgtttgcatggcattcctgccggcggttgcgccgacgttccggccgttgaagtattccgcgcacatggtggcgatcagttcgcgttcggcagggtgatcctcgacgatggcgatgcgcacgttccctccttgctgtgccgtgattgcgcggatgacgttccggctctgcttccaagcgtaccgggagagggaaatacggggtgccgcggagcttgcgtttcatgccagaaaagcacgtttcgtgccatacggcggatatcgacaacgaaaaagacccgctccatacggaacgggtctttttcgcgctacgccttgattacttggcggaacgccgtatcactcggccagagccttgtccacgacctcggtggcctcggcgagcaccttgtccagagcctcaggggattcgaagctctcggcgtacaccttgtagatgttctcggtgccggacggacgggcggcgaaccagttgtccttggtggtgaccttcagaccgccgatcttggcgtggttgcccggagcctcggtgagcttggcggtgatgtcctcgccggccagctgggtggcctcgacgtcgtcgccggtgagcttggcgaacttctgcttctgctcgagggtggtcggggtatcgacgcgcttgtaccagctttcgccgaaacgctccacctgctcctggtgcagctgggccgggttcttgccggtcttcgcggtgatctcagcggccagcaggtccggaatcaggccgtccttgtcggtggtccacacgcggccgtccttacgcaggaaggacatgccggagctttcctcgccgccgaacgcgacctcgcccttgaacagcgggtccacgaaccacttgaagccgaccggaacctcgacgagcttggcgttgatggaggcggccacgcggtcgatcagggaggaagacacgagggtcttgccgatgccggcgttctccggccaatccggacggttgccgccgaacaggtattccacgcacactgcgatgtagtggttcgggttcatgacgccccagttcgggcagacgatgccatggcggtcggcatccggatcggtgccgccgaccagatcgtacttgtcccaagcgccgttgttgagggaatcgaccagacccttcatcgcgtacggggagctcggatccatgcggatcttgccatcatggtcgatggtcatgaagctccaggtcgggtcgacctgcggacgcaccacgtcgatggtcaggttgtacttctcgttcatgagcggccagtagttgaccgaagcgccgccgagcgggtcgatgcccaggcgtacgccggaggagcggatcacgtcgaagtcgatgacgttctccagatcggccacatagtgctcacggaagtcgaaacgctcaaccagatcggacttgacggcctgctcgaacggcacgcgcttgacgttcctgaaatcgccgagcagctcgttggcgcggtcggcgatggcgttggtgacgtcggccggagccgggccgccggtgaccggatcgtacttgaagccgccatcggtcggcgggttgtgggacggggtcacgacgatgccgtcggccaggccttcgccggtgaaacgctgggtgccgtcggcggcgcggttgtgggtcaggatggcctgggacacgaccggggtcggggtgaagtcgtcacgggagtcgatgcgcacggtcacgccgttggcgacgagcacttcgatggcggtcttccaagccggctcggacagggcgtgggtgtcgcggccgatgtacagcgggccggtgacgccggccttcttgcggtattcggcgatggcctgcgtgatggccacgatgtgggcctcgttgaatgaggtcttcagggacgaaccacggtgtccggaagtgccgaaggagacgcgctgctccggaacgttcgggtcggggacgacgtcatagtactttccaatgacctcgtcgacattgatcagatctgctggggtggcgggcattcccgcattttttgcaaccataccttcattgtgccacgagtttgcgcggaacgcggaaagccatcccacaatgtgcgatgaatacgttttctttttgacgtctcggcgtgtctccagtatggaattggggtttcagtgtcccgatgcccgacgatttgcgcatcgcacgccgatagtgtattgtttctaacgaattcgactcatgcagggttgcaagtcaacatttttagacgcaagacctggaatgtggcattggtttgccatgttccgggtcttttttgttgcaaaaaagccgcgctgcgtcatcgaatcccatcggaaggaaatagaaaggaatcaggatggctgactctctcgcatcgcagatcatcactgcgatcggcggacctgaaaacgttcgcagtctgacgcattgcgccacccgactgcgcttcgagctggcggacgcgtccaaggtggaccagaacgccctcgaacatatgaagggcgtgcttggcgcggtcccgcaaagcggtgaccgtttccaggtcgtcatcggcggcggcgtggccaccgtatacgaaaacatcatgcatctgcccgaaatggcgaacgccggtgccgcctccgcatccggcgaaggccagaagagcaacgccgacgtcaaggccgaggcccgttccaaggcacgcggcaaggtggcatggctggactccttcttcgagtatctcgccgactccttccgcccgatcctgggcgtgctgctcggcgcctccatcatcatcgccctggtcaacctgctcatctcactgaacgtcattccgaatgacgaggcctccgccggctgggtgttcgtcaaggccatctggaagggcgtgttctacttcctgccgatcatggtcgcctacaacgccgccaagaagctcaaggtcgatccgtggctgggcggcgccatcatggccatcctcatgaccccgcagttcaccagcctgatggacgccaagaccaccacgtgcgtggagaacgcggctctgggcaccaagtcctgcaccgccaacatcttcggcattccgatggcgttgagcgactacagcggcaacgtgttcgtgccgctgctcatggccgccgtgctcgccctcgtctaccacggattgaagaagatcattcccgaaagcgtccagctggtgttcgtgccgttcttctgcatgatcatcgtcggcgcgctgaccgccttcatcatcggcccgatcggcgtgtgggtcggcaacggcctcggcgtcggcctggcttggatgaacacccatgcaccgttcatcttcgccatcatcatcccgctgctgtacccgttcctcgtgccgctcggcctgcactggccgctcaacgccctgatgctcatgaacatccagacgctcggctacgacttcatccagggcccgatgggcgtgtggaacttcgcttgcttcggcgccaccgccggcgtgctcttcatcgccgtgcgtgacaaggacaaggacatgcgccagaccgctctcggcgcgctcgcagccggcctgcttggtggtgtttccgaaccgtccctgtacggcatccacctgcgttacaagctggtctacaagcgcatgctcgtgggctgcggccttggtggcgtcgtcattgccgtcctcggctggctcttcccgtccgtcaccgccgccggccagaccgtgcatggtgtgaccaccaccgccttcgccttcacctcgctgctgaccattccggtcttcgaccagatgtgggtgtacgcggtgtccatcgcggtctccttcctgacctccttcttcctgatcatcaccttcgactaccgcaccccggaacagaaggctgaagtgctggcccgcgccgccgccgatcagaaggccgccgctccggcggtcgaagccaaggaagccgctccggctgccaccaccgccaccgcgactgctaccgccaccaagaccgaagctccggccgctgccgccgccgcgaccaccgtggtgaacgctccggtcgccggccacgtgatcgccctggacgaaaccggcgatccggtgttcgcctcccgcgcgctcggcgaaggcgtcggcatccagccgaccgacagcgaggtcgtggccccggtctccggcgtgctgcagaccgtcgccgaaaccggccacgccttcggcatcaaaaccgatgacggtgtggaagtgctcgtgcacgtcggcatcgacaccgtgaagatgaacggcgagggctttgccgtcaaggtcaaggccgatgagcgcgtgaatgccggcgatccgctggtttccgtcgactttgctaaagtgaaggacgctggatacagcaccaccacgctgatgacggtgctcaacaccgccgccctcacctccgtcacgccgaagaccggcatcgacgtcaaggcaggggacgaggtgatcgacatccagcgctaacctgtcacacagaggcgaaaaaggggtcgacgtggacgttcttcgcgtattcaacaacaatgtcgtattggctagagacggtgatcgtgaggtgattctcacaggccgtggaataggcttccaagccaagccgggacaacatgtggatgacgcgaagatcgtccgtcggttcatccccgtcgatggcaaggatcccgaccacatggcgcaacaagtggccgggatcccgcccgaaatcatcagactcgtcacggacgccatgaaccgtacgggactgaaagaacaggcagacaagcagccaaccctggtcatggcgctcgccgaccacatctgcggcgcgatacaacgcgcgcaaagaaaacagaacatcgaatatccgctcgaagcggaagtacgttccctatacgccgacgaatacgccaaaggcgtggcgatggtcgacgcgatgaacacgtatttgggtggcgcgttgccccgcagtgaggcggtggcgctcgccttgcatttggtgaatgccggattctccggcggcgacctgtccgccacctacaccatgaccggcatcatccagcagatgatcgccgtcatcgaaggcgcgtacggcatcacgcttgcgcaggacagcgtcaatgtggcgcgattcatcacgcatttgcgttacctgttcgtacgcatccaccagcatgagcagctcgacgatgagccgcaaccaatcatcgaatcaatcaaaacctcatatccgaaggcttgccagtgcgcaaggcagcttgccgtggtggtgaagatgcgtcttggttccgaccttacggaagccgaaatcgcctatcttgccctgcatgtggcgcgcgtgaccaacggagtgaatcggcaggacgactgagtttccggtatcttccgatattcagcagcccgttccgcgcattcctgacggttcctaatcgttcgactgttcggccggctgcccgcttgcctgttcggtcggctgcggtttcgttggcgtagccgacatattcgcgttcaacgccagtatgccggtatcttcggaagtggcctccggcacgcgcacgcatagggcctgacgttccacgctgaaacggatgtgcttcgtttcaggcagcatatcgccatccacctgcgccaaaacaggcctctccaaagtgatttccgcgctgacgccctgcacctggtcgacggtggagttcgtggacagcggactctgctgagctttgccggtgatggtctggtgcagcacgtcgccgaacagattcgcccaaccgatcaggccgccggacgtgtcgatgatctcgtagtcgaggatgccatcgtcataggaagcttcgggcatcagcgaaaacatggggatctggccgcaattgcccgccatgaacgtgcggaacgtgagaccacgcgtggaatgcgtgctgccgtcggcgctggtgatggtcacattgcccttgtacttcggggcgaacagattcttcacgcccgacacgaaatacgccagccagctgatgttcttcttcaattccggatcggtgtcgtcgatcatcagtgcgtcgaaaccgatgccggcgatgatgaggaacgcatgcccgtggtcggtggtctcatcatccagaagggtcagacggcccacatccaccagacgggagccgtgcgacgtggccacggtgagcgccgcatcgatatcgtccacgggaatgcccatattgcgggcgaacagattgccggtgccgatcggcacgatgcccagcgcatgcccggtacccgacagcgcgctcgcgacggtacgcaccgtgccatcgccgccgacagccaccaccacatcggcaccatggtccaacgcttcgaacgcgcaggcgcgaccgtccttgtcgagctgcgtttcgatgaattcgatctgggtgagatgcttcgcctcgcagaactccttgatatgctgcttgcgctgttccgcctggggctttgaaggattgactatgaacgcgtaatgcacttggtcatcgtcacgcttgtcaagcttctccgcgagcgtacggtgcttgtacgcgcggtatccgaagaaggcggccgcgcatacggcgaccacggcgatgatgacgagcaggacgataactggcataggcatgcctctattgtctatgcgattgcgcaaaaagacgaattcgacatgaaaaattcggcgttccctcacgttatatccaaaaatgagaacgatggcgtcagtgtctgctttcggcactaggctgggaagcatgcttgatattcaattcattcgtgaacatgctgacgttgtcaaggaatcccagcgtaagcgtggcgaatcggtcgaactggtcgacgaggtgctgcgctccgacgaggttcgccgctcctctctgaaggaattcgaagctgcccgcgcgcagcagaaggagatcggcaagaaggtcgccgccgcccccgccgacgaaaaggccaagctgatcgccgcaaccaaggaactctcccagaaggtctccgaatacaaggccgcagccgacgccgcagccgaggaatacaccaccgccatgtggaagctgtccaacatcgtcgagccggaagctccggaaggcggcgaggatgattacgtcgtcgtcaagaaggtcggccagatccgagactttgcgtccgaaggcttcgagccgaaggatcatctgactctcggccgcggcgtggccggcatcgatatggagcgcggcgtgaaggtcggcggctcccgcttctacttcctgcgcggccaggtggcccgtatgcagatcgccatgctgaccatggccgtcgatcaggccgaggaacacggcttcaccctggccatcaccccgacgctggtgcgtccggaagtaatgcgcggcaccggcttcctcaactcccacgccgacgaaatctaccgcctgcgcgagccggacgaccagtatttggtcggcacctccgaagtggcgctcgccggcatgcacgagaacgagatcctgaaccttgagaacggcccgctgcgctactgcggctggagctcctgctaccgccgtgaagccggcgccgcaggcaaggacacctccggcatcatccgcgtgcaccagttcgacaaggtggagatgttcgtctacgccaagcaggaggactcctacaaggagcatgagcacctgttggccatggagcaggaaatgctcggcaaggtcgaggtgccgtaccgcatcatcgataccgccgccggcgatctgggctcctccgcggcacgtaagttcgactgcgaggcttgggtgccgacccagggccgttaccgtgagctgacctccacctccaactgcaccgagtatcaggcccgtcgtctgaacatccgcgaacgtatggaggatggcaacacccgcgccgtctccacgctgaacggcacgctggccaccacccgttggctggtcgccattctcgagaaccaccagcagaaggacggctccatcgaaattccgaaggccatgcgtccgtacatgggcggcaaggaagtcatcgagccgaccaagtgggaagcctgattttccaagacgttcgcgtctgatatgaatccgtgaaagcggcgttgcatttgtgccggcgccgcttttcgtatgttggacggtcccagtgccgtttgtgtcgttctgggcagatgcgtgtgcggttttctgttggaagcgacggggatggaggctgtgccaggtgtcgcacttccgcgcactgtggtatattggcgtttcgtgcgtagcagcgatgttaggcgcaaagggtagatgtctgagcggtctaaagagacggtcttgaaaaccgttgaggtgcaagcctccgcgagttcgaatctcgctctgcccgcatcaatcaagggcttaccgaaggatttttcggtaagcccttttccatgccgtttatggcgattgtcgttgtcgtggcggcaacgtcacacaatccgtcgatccgcggcccaacgggtgagctcggaacggttcgacagctgcagtttgcgcagcaccgagctcatatgggtctccacggtcttgatggagatgaacagttccgaagccacctccttgtacgtgtagccgcgcgcgatcagccgcatgacctcctgctcgcggttggacagccggtccagttcgtcatcgtggatcgggccgccgaacgcgccgttcgcgctcgggccgttctggaaggcggacagcacgaatcccgccaatttcggcgagaacacggcgtagccctcatgcacctgcttgatggaggacaccaggtcgtcgccggaaatagtcttcgtcacatatccctgtgcaccggcgcggatcacggaaccgacatcctgcggagaatccgacacggacagcgcgaggaagacggtatcgggggagtatgcgcgcgatttcgtgaggatttcggcgccaccgccgttctcgccgcccggcacatgcacgtccagcagcaccacgtccggtttggtctgcgcgatcatcgccactgacccctccacgtcggccgcctgtccgaccacgtcgaaatacggctgcaacgtggcgatcacgcccgcgcggaacatctcatggtcgtccacgacggcgattctgatgcgctgttcccgctcgctcattcctgctccttggttcgattgattcattgccgcacctgctgcatgtgccgtgttcattgcgccgattgcacgcccgtatcgccgtccgctgtggtggtcgtagcgctgtccgcatcctccgccgctcctgaaatcggcatgtgcatgcgcacctccgtgccccagccgggcctcgacacaatctccactgtaccgccgcggcgcttgatacgtccgatgatggactcgcggatgcccaggcgattcgctggaatggcgtcgacgtcgaagccgtcgccatggtcgcgtacgaacacctccaccagcttgtcgccggcctcgcagtagacggacaccggttcgccgccatgcgtcacggcgttgacgagcgcctgctgcgtggcatccaacaacgcgtcggtctgcgcgctcggccgtgcatcgcccaccgtcaccacctcgatcggcttgccgtgcgtgtcctccacatgcgctgcgatctgcttcaaaccggcgttgacggaacggtccgacgtggtgcgctcctgatatagccattcgcgcaactcgcgttcctgctgcctcgccagtgaaaacacggtctgctggtcgccggcatgcaactggatcagcgccagcgtctgcagcacgccgtcgtgcaggtgggcggtcatatcggcgcgctcctcctcgcgttccttcagcgcgcgttccgtgcccaaatcacgcaccagcgtcataatccacggcacaatcgccagcaacacgccgacaagcagcgccaaaccggcgacgagcatggtgaacgtggcgtgccgtgcggactgcataatgcgcacgtgggtggcgatgtagatcgcgtacgcgacgaaaatgaccgcgatgccgccgagcatcgtccataattggccgtccttcgcgttgaaccgcagccaggagacgccgacgccgaccacgccgagcagcaacggcacaatcagcgtgccttcaatgcctttcgccgccatcgccacgcataggcccagcataagcagtcccgccatggccagcagcgcgggtctcggcgcgttggcgaacatctgttccaggctttcggacgattgtgctccgctgccggattgcatgccgtccgcgttgccgtcgctgtcttgcgattgcgcgccgccgtttccgacgttccttaggtttcttacgttcctcacgttgccgtgggacagcggcgcgttctcgacgggctggctgccggcgatgacgtacgcctgctggaccgggtctccgacgggtacggtgatccacagaaaaatataggcgatcgcgcccgcaccgaagaaaaacgtggtgaccacgaaaatgaaacggatgagatgaacggacacgcccagatgcatgctgacggccttggccacgccagcgacctcgcggccgtacgtcgggcgcagcaacggcagtcgcgccggcttggacggcacgggacggccttcgcgcagggcctgcacgtagcaccagcgcatgtagaccgcgctggcctggtcgtactgttcctgcgtgtatcgcggtttggctaaggacttcatgcttccattgtgccctgtcggggatgccgattcagggctttcagctggtgttcagggcagattcagggtgttccccgatacgtatgacggctgcggattgctgtaatggagatatgagcaacgcaaacaacaatccgcaaggcggcagtgccgctggttctgccgaaccgcaatcgcagccacggccgccgatgtatcagccgcagccgaatcgcggcaatcgattcttcgcatggatccgctccagccggatcacgcgcggccgcaaccggtggatcgcaggcgtgtgcgacggcgtggcgcgccgcttgggatggaacgccaccctggtccgcgcgctggtgattctcacctcgctactgttcggcgccggagcggcgttctacgcattggcctggttcctgctaccggacgagacggatggccggatcctgtgcgaggagctggtcaacggccattgggattggaactgcgcgggcgcgctggtatgcgccgcggtggcgctgtgcctgcccggcgccggatggctggcgttcggcgtggccgtgttggtgttctggctgctggtgaaccgccagtcgtatgcggcgagctggcagacgccgcagcagggcggatcgtggcctgggcagcctgctcagcccgttcagccgggacagccggtgcggcctgcgcaatcgctatatatgccgcagccgatgtccacgaacacggccaccactgcaaacatgcccggcacgccaggccagccgatgccgcggccgacgtgtcccgcgccttccggctaccagcagtacgcgcgtcccgtccaatcgccataccagacgtttcagcagccggtgaacccgcctgcagcgtttgccgcggccaatgtgccgccgaccttcaccgctccgccgacggtggcggcgccgcagtcgaaacgcgcccgccgcaagccggccggaccgctgctggtactggtgacgcttggcttggcattgctggcgatcgccggatctggctggtacgccattacgatgccggttgattgggattacgccttgcgcgtgctgcgtctcgccacactgtgctgcggcggcatctgcctgggaatcggcgtggtgatcgtcgtgcttggttgcatgggccgtcgcaccggcggcctgcatccgctggcatggtgcgcggcgttcatggccgtggtgatgacgttctgcacgagtgcggtggcatgggaaagccgcgattggatgatgtcgaatgactaccaccgcacgacggtctccggcatcgtgacatggagcgacaccagcgacgcccagatgaaacgatacgaacagggactggtggtggtcggcaagaactacgccaacgatgtgctcgacatcgatttgagcggatatccggcagcgcatggcaagcacaaggtcaagctcaacgacggcacgtacggcgaaagctcatgtccgacagggaagctgaatctggtggtggtgaacgcccaggtggtggtcacgctgccggacggatgccagtggtcggtcagcgatccggacgacggctacaccaacgtcacggattacataggagggccggacgggattacgttcttcaacggcacgggcttcatgggcctgtccctcgatgagaacgatgattcgggactcggccatcatggcgtgaacaagggcgttccggcgctcaacggcaccaccgatttcgacgattccggcgatgatgatgcgggcgatgccggttcggatacggagaacgattcgcaggattcggtatacgccggcacggatctcgacaaggcattcaaaacgatctacgagaacaagtggtattggccgtcgatcgattcggacaaggctccggaggaaccggatctgtatgtcaacgtcgatggaacggtcggcggcagtgtcaccatgcagtacacgtccgacagcaagctgccagtgggaacgacggtcggtcaatcgcatggcagcgtcgatggaaagaacgtcgggaaaagcgccagcggaaaggaaacgaaatgagtgacgagaaaacccgtgaagtgccgttgaccgacgtcatgggaatcgcgggggtctcggacgagcccacggaaaccctgccggccgtcgacgatccgggcgaggcgaagaccgaatcgttccagaagccgttcgacggcggtccggaagcgcagaggaagttcgaatcgcaggacgaggccgaatcgctggaaacctccggacaagacatgcgcggaagctttgcgggccgttcggcacgtccgaccggttccgtcaaatcggctgatccagccaaatcagccgagccggtcgacccctccaagcaagtgcgcatcggcaaaacggacggcgagctggtaatccgcccgtccggaccaagcaccggaaccatcgtgctgggcgtgttcttctgcctgatcggcctgatgtccatgctgtgcctgctgcccatcggcgcatggcggtggatgccgaatccctcgacgctgttcttctacgtggtcggcggtcttggcgcgctgctgctcatcatttccgtggtctgggccgtcgtcgccgcggtgcgtctgcgccgacgggaacgccagtcagcagaacagtccccagaaagccagcagcgccaacgatagcgccgccgacaccaccacacacgtggccacgatgacatggccggatccgatgcatgcttttccatcttttcctatatcgcatcggcttccggctgcggcatcgtggccattattcatatccgcatcgtcatctatgcttgcaatcgcgcgattcctagcatgacgacggcacgcgtccacgatgatttccgccaacagccaggcgaacgcgacaaggctcagccatgtgagcatgacgatggcatgccagttcttggcaagcaccgccgaattgtcggtcaacgagatcgcatcaatgatgacggtgaccagatacgccaggaacacgccggtcgtgccgacggcaaggagggtgttgagcgccagtgcgacgcgcatgccggccgggaatcgatggtcggttattgcgattggacgtgtcgcattcggttgtgtggatggacctgtcggtgtggtcgcatccgttgaaaacattgaagtcgaatccgttggctccgctggttccgtcgaagccgaatcgtgcgatacccgccgtgacgcacggcgctcgcgcacccagccagcgatgagcagaattggcgcgccgcacatcgccagcagcgcgcagagcaggcaaaccgcgattgcgccgacaatcacacccatcgacttcaccagcgcgggcggggtcttcagcggtgccgtgaccgtctgattcggctgcgttccggcgatcatcggcgttgcccagccgttcgcacccgtgccgctcgtcaccgcgttgatccaatcctccagatcgtgcgtgtaatgcggttccaacggcagtcccggaaccgtctgattcgaaccggttcgaagctgatggttcgcgtcataataccgcagcgtcacattcgtattgccggcatggttcgcggcttttgtcagcagttgcgcgccctgctcgaccggcatggccgtatcttgcatgccatagttgataagcagcggcatggtaagcgatgtgcggtatttggccgcgtcaaaatccgcataggcgagtcccatgcgttgtgtgccaaggctggtgatgcgcggaataagctgcttgacggcatcgggtgcgcccgcggcggtcagataattggtggctgcgagcgtcatctgctgacggcccgaaacgactgggggagaggtgaggatggcgaaggcaagatccggatgctgttgcgtcagcacggtggcgatccatgtgccttccgattcggcgtagatgccggtttccgatctgctcacgcccggccattttctcaggatttccagcgatttcgcatagtcgtgcgcgctggacacgtagtcgcggtgcagcatggtgtagttgtcgagccgcttgtccggcacgagagtggtgatgccggccgacgccatcgcgttcgccacgtcgccgaacgcctccgacgatttgccggtgcccgaaccgtgcaggaacaggcatgcgggacgatctgccggcgcgtcgagcggctcgcgaacgatggcattcacggttttgccgccgtccaacgcgaccgtgatatgcgtttccttggtgcggtacgcgccctcctgcggggttttgagcacggcacctgtggccgggtcaacggcttggatagcggtattggtcgtggtgagcgtgatatggtccgtgaacggctcgacctgccatttcggcgccatcgcattgccgagcgcgcataggaccatggtcagaagaagcgccagcgcggtagtcgccgcgcaggtgacgagaattcgtttcacaatgcttcgcacggtacgccactctagtcgtattcggcgtacgtggcgcggaaaacacggaatcatggggaatccgcggaacgatcgcaattcctgcgccgcgagtcaatgctcccgtgccgtaaaacaatacgaaatcaggggaaaatcgcaataatgccctccacaatccacctgtggatatgtggaaacccgtcggtttcgccgcacctttccgccaaaccgacgctgagcgtcctccagtcgtcggtttgatattgcgatttccgccaaaccgacgcttagaccctcctcggcgtcggtttcgcggattgggggcgatgggatcgacgctgagatgggatttgggggagaaggatgggaaggttgggatggggctaggcgcgggcttcgtagcgacgggtgtagagcaccagcaggatgacggcgagcaggctgatcggcgcgcctgcgatgccggtgaaatggtaattcatcgccgtcgcggtcagtgccgctccgccgacgatggaaccgatcgcattgccgaaattgaaggcgatttgtacggcggcaccggcaatcagctcgccgccgccttcgcccgcctgcaccatcagcagttgctgtggcgatgaattgaagaacagcgcgaaaccgatgatgaacgtcagcaacgcggtggtcgcatgattaccgggcaacaggaagaccagcaacagtccgcacaaggcgatgccgtgcgatagcgccgcggtcgcgcccgccttccacaggtcggtcagcctgccgcccacgatgccgccgaccaccatgccgaggccggcgagcaccatcagcatcggcaccatcgtcgccgaccatccgccggttttctgcaaccacggcgacacgtagctccaccagcagaagatgcccgaattgccgaagaacacggccagcagaatcagccacgggccgggatgggtgaggaagcggaactgccccttgatgccggcgtccttgatcggatcgatggacggcacccacaaaatcaccacgacgatcgtcataagcgcccaggcggccagaatcgcaaacgccagccgccaggacatcgcctcggcgagcaacgttcccgcgggcacgcccagcatgttggccaccgtctggcccatcaccatcatggacacggattgcgcctccttgcccttgtcggcaagcgttttggcgatcagcgtggccgtgccgaagaacgcgccatgcggcaggccggaaatgaaacgcgccaccagcagcatcggcgagcagaaggagacggcgctgagcgtgttgccgaccaacgcgatggccatgaacaggatgatgagatgcttcggcggcaccttgcggccgaacaccaggatcagtgtgccgacacacacgccgatggcgtatgcggagatgtaatggccggccgcgggaatgctgacatgcatggcggtggccgtctggggcaggatgcccatcatcacgaattcggcggcgccgaggatgaaggcgccggaggccagcgccagaatgcttctcttcatggggattccttattttggattgtccgccgaaccagcacttggatggtgccaagcgtcggttcgatattgcgattcccgcgaaaccgacggtgagacggtgccaagcgtcggtttgatggaaaggcaaagaaaaaggcggaaccgaagttccgccttaattgtcgggctggcgggatttgaacccgcggcctcttcgtcccgaacgaagcgcgctaccaagctgcgctacagcccgtttggcaacagttggatatattacacgattgggcgctgtatgcaaggtcggcgtgtcgcgtgttgtgtagtggcttctcggtacacttggggcttatgactgagaccaacgaatcccaagagaatcagaacgaagaagaggccgcagttcccaccatgaccacggtggaacgcgccgaactgctgcagcagcaggatgctgcgattcgcgccaagatcaacggcggcgccgcgctggacgaggccgtggacccgtccaataaggaattcggcccgctggcccacccggagcaggtgcagatgcgtgtggccaagcgcgccatgatgcttaaggaaggcatccagccgtacccggtgacccttgacgtcaccgccaccatcgaagaggtccgcgccaagtatgacggcaagctcgaagcgggcgacgagaccgaggacgtggtcggcatcgccggccgtgtgctgttcctgcgcaacgcgggcggcctatgcttcgtgcagctgtccgccggcgatggcaccaaaatccagggcatgatctccaagaaggagatcggtgccgactccctgaagcagttcaagcagctggtcgatttgggcgaccacctgttcatcaagggccgcgtgatcgcctccaaaaccggcgaactgtccgtattcgccaccgaatgggccatcgccgccaaggcgctgcagccgttgccggccctgcacaaggagctcaacgaggacacccgcacccgcaagccgtacatcggcatgatcgcggacgagaagatccgcaacatggtgcgcaaccgttccaaggccgtcgcctccctgcgcaagaccttcgccgaccatgacttcctcgaggtcgagaccccgatgctgcagaccgtgcacggcggcgccgcggcccgtccgttcaccacgcatatgaacgccttcgacttggacctgtacctgcgcatcgcgccggaactgttcctgaagcgttgcctcgtcggtggcatcgaccgcgtgttcgaaatcaaccgcgacttccgcaacgagggcgtcgacgccacccacgccccggaattcaccatggtcgaggcataccaggcctacggcaactacgacaccatcggcgcgctcgtcaagcagctcgtgcaggacaccgccatggacgtgttcggcagccacaaggtgacgctgctggacggcaccgaatacgacttcggcggcgaatggaagaccatcagcatgtacgactccctttccgaggccctgggcgaggaaatcgtgccgaacggcggtccggacaaccccggcacctccgtggagcacctgggcgagatcgccgacaagctcggcgtggaacgcgacgacgtggagaaccacggcaagctcgtcgaacacctgtgggagcacttctacgaggacaagctgtacgagccgaccttcgtgcgcgacttcccggtcgagacctccccgctggtcaagggccaccgttccaaggccggcgtggtcgagaagtgggatctgtacgtgcgcggcttcgaactggccaccggctactccgagctcaacgacccggtcgtgcagcgcgaacgcttcgtggcccaggccaaggacgcgctcgccggcgacgaggaggcctgcgacatcgatgaggacttcctggaggccctcggtgtgggcatgcctccggcaggcggcatgggcatgggcatcgaccgactgctcatcgcactgaccggcgccaccatccgcgagaccatcaccttcccgcttgtgaagccgctgaattaacgcgaagcgttaattcatatcggcttcacgtgaaggcggatcaagagaacagcccggtgggctgttctcccgccgtaaccttccttttcggttgaagccactgaattaaggcgaagcacagttcgcaataaatttgatacggactaaagggactgacgacctactcggccgtcagtcccttctgtttttggctggcggcgggtccgcgtgcgcatcaaaaatcatgatgagcggcctccgcagtctgagcagccgccgattaagaatgacgatggtaaatttgaatccatatggctcgctcaacaatggggatgtcaggaaaactgggccgcatatagaatggtgtccatgcaaatatcgacttggattcgtggcgctcgccctcaaacgctgccgctgggtcttgccccggttctggtcggcgttgccgccagttggcggtgggatgctttgggtggcctgcggtcgtgcccggcttttccgggaggattgctggaagagcgtgatgccggtgatgtgctggggcattgtgcgttttctcggccgtggtttgcggtcgttgcgatgttgtgcgccgtggtggcggtcggtctgcaaattgctgtgaattatctcaacgattatgccgatggcgtacgcggcacggacgcccgacgaggcagtgacgccgcgggacctcggcggttggtcgcttccggaattgaccccagtcgcgtgttgctggctgccgcggtcaccgctttagccgcctgttccgccggactggtcgctgtcgtcataactggtcgctggtggctgatcgcgcttggcgcaacctgtctgttggcgggctggggatataccaacggtcggcatccttacggatatcggggtctgggcgaacttgcggcattcgtattcttcgggttggttccagccctcggcacgcagtatgcgctaagcgggtcgattaccgtgacgggagcggccggttcggtgatctgcggcctgctgtccgtcagcgtcatgatggtgaataacctgcgcgatctcgaagatgacgccgcgcacggcaagcgtacgctgatggtgcgcatcggcagtgggaagggcaaatgctggtgcatgcgtgcgctgggatgggctgctggtctgacggtggttttcgccatgccattatcggtgtatgccgaacttctggatctgctcatagttctgcctgcggaggtggatcgcgaacgttcatgcacggaatatggcatatgcgatgactggtcgtggggaaacgccgattggatgagccttgcggcgttcgtatccatcgcagggtgtgtggcgattgctactcgtgccgtcgcagccgtccggcatgaccagtggcgtcgggcgttgccattgtgctcgatgacctcgttggtcgcagccggcgcgttcgtgctcaatgcctgtcaggccggtttcatggtgtagctgcatcctgcatttacgatttcgtcattgagcatcggcgattgcctgatgatgcaaacggcatacaacagaatgaaaattgttgcatgaacgtaaccaaataatcgtcatcgacggttgtgttgggcgtgctaggcggtagactggcaggtatgacttacaaactagtactgctccgtcacggacagagcgcatggaataaaaccaatcagttcaccggctgggtcgacgtcccgctgaccgagcagggtgtcgaggaagccaagaacggcggccgcctgctcaaggagaagaacgtccttccggacatcgtcttcacctcgatgctgcgtcgcgccatcaacaccgccaacgtcgcgctggacgaggccgatcgcctgtggattccggtcaagcgcagctggcgtctgaacgagcgtcactacggcgccctgcagggcaagaacaagaccgagatccgtcaggagtacggtgacgagaagttcatgctgtggcgtcgttcctacgccaccccgccgccggagatcgatccgaacgacgagtacgcgcagaacaacgatccgcgctacaccggcgatccggttccggaagccgagtgcctggccgacgtggtcaagcgcgttgagccgtacttcaagtccgacatcgagccggagctgaaggctggcaagaccgttctgatcgccgctcacggcaacagcctgcgcgctatcgtgaagatgcttgacaacctctccgaagaggagatcgccaaggtcaacatcccgaccgcaatgccgctgctgtacgagctggacgagaacttcaagccgatcaagccgcgtggcgagtacctggatccggaagccgccgctgccggcgctgccgccgtcgccgctcagggccagaagtgagtttgttgcgattgggtgcgtgaatagtcgcggctgatcgcatgaaacacatacgaaaaggtgggaacctgcataccgtaggttcccacctttcgttattgccggcgcctttgtcggtaagtctttttcacgttgtatctgcgttttgctgatgtcgccttgcctgcgcggctcggcgggtgccgtgcggcgcaggcaagacggacaaaacggaatcgcaagaacgtcagatcacgccgtattccttgagcaatgtcggaatatcagtggaatccagcttcttcacgatctgcttcaacacacccctttcgatggggttgagcttcatatcggtgatcggtttgccgtctcgcagcatcaccgtggcgttgagcaggttgcgcacgtcgtagaccgaaccccacacctccggcacgccgcggtccacgtcgcacagcgtgtacacggcctccatgccggtgcgcatcgaatattcggtggtgaagatcgtgtcgcgcggcgtctccgcgaattggccgaggaacgcgaaattcaccgcgccatccggcaccacgtcggggcggtcgccggcggaacgcggcatgaagaacgcatcgatgtacggcatcatcaccggaaccgtgttggcgtggttcttcgccaggtcggcgatcttgtcggtcggcacgcccatgtggtacagccattcctcgcagatctcctcgccggtgcagtcctgcatcggcttcttcacatagttgccgggcttgtcggggaacagaccatacacccatacgcacagctggtccttcggctggtcgcggaactgctgctggcgattcagcgtccagctcatcagccaattggaatcctcaacggtgacgatgccgccggtcaccacacgtccggagaacgggtcgcgcttgcagatcttctggatgtacggcggaatctcgtcgtccaacgtggtgacggtggcgctcatccacttcgaatgctccgggtcggaacagaacacgtccggatgtccgaagctcggatcctgcgccgcgatgcgacgccacatatcccaaccgccgccgggcttgatctccggagcccacgcggccggctcggtctgcgaacccatcgacgagttctccacgcagccgccattggtgatgaacaccagatcgttctcgcccaagtcgatactgcgggtcgtgccatccgcctccatcagatcgatgcgcgtggccaacttcttggtcggcgagctgaacggattgcgcggatacgcgccgtattcggcctgcttcctcaaaatcgtatcctgcccagtgccggtgcgctggcgtacgggacccatgccgccgccaatcgcgaaatcgacgttctccaccttcacgttgtagtggaactgcacgccgaagccttccaaatacttgatcatcggcagaatcatcgactcgtactggttgtagcgggtgaaccgcaacgcgctgaagtccggcagtccgccgatatggtggatgtagcggcggatgtacagcttcatctccaacgcgctatgccagttctcgaaggcgaacatggtgcgccagtacatccagaagttcgtatcgaacacctcatcgtcgaagaagtcggagatcttcttgccgtatagttcctcgttcggtgtgaagaacagcttcatgatctccatcgacgccttgtcggacagcgcgaacttgccgttcgtgccgccgtccacgccacgcgccttagtggagcggcatagcgaatagttcggatcctccttgttgagccagtagtattcgtccaatacggacactccatccgtctcgatggacggaatggaacggaacagatcccacatcacctcgaaatggttgtccatctcgcgtccgccacgcatcacatagccgacgccaggaatgttcgcgccatcgcaggcgccgcccggaaccgggtccttctcgaacacgtggatgtggtcgccgggcatctgcgcgtcacgtaccagatagcaggcggcggacagcgctgcaagacccgtgccgatgatgtaggcgttcttgctatcgatcccctcgggcttctttggccgggcgaatgcttcgtaattgccgttggaatagtacatgacttcctcctttggatgccgctggacactattgtgccgcgtcgtgggacacaagtatacgggcatgaactggacgcgatgtctagtttttacgactatcggaggaatttcgcttataggtggcggattacgcctgcatgcgaaagtgattttgcctatatgtggcagatttcttttggaaaaggatgttcgagggcaggatttttacccccttatgatgttttggccgaggtcatctgccacatataagcgagatgggtggcttccaaacggaaaccacccatctcgtcaaggaaaatgcaagaagaggtgaggaaccctcagtcgatgtcggtgccttcgtcgcgggtcggctccttggacgggtcgaaaccggagacgatgaacaccacgcggcgggccgcggaaacggcgtgatcgccgagacgctccatgaagcggccggtcaggaccacgtcgatgagctgctggttggtgcccttccaatcctcggactgggccagttcgaaggtcttcttgtgcagagcgtcgagcttgtcgtcgttgagaatgatctgctcggcggtcttggtgtcgcggtcggtaagcatggaaaccacctggtcggccacattgtcaaggaacgcctgcatttcggcgaacagcggctgggcatcggccggcagcggggaagcaggataggtgcggcgggccgcttcggcgatgtgacgggccagatcgcccatgcgctcgaacgttgcggccagacgcagggtggagacgaccacgcgcagatcggtggccaccgggttctgcttggccagcagcttcacgcactggtcgatgacgctggattcgagggcatcgatttcgatgtcgccgtcgatgacggcctgggcggcttcaagattctggttcagcaacgcgtcgccggcaccattgattgccttgcgaacgtcttgcgccatgcggtcgaggtcatcggcgactgccttgagctcttcattgaagataacgcgcatatgcttgcctttcaaatgcttcacgtatgtcaatatcgggttcggatataacctctcccaagtgtattagggaattggcggattcgcacgtgacggacgtgttgttccgccaatgttcaccggcacgttcaccctgcgttcacgaaaatcgcgccacggccattcatcggggaacgtcagggtgtgcgagaatgaagacatgtttgaatccgtaggcacgtggtggcgcaatctgacacatcgccatggtgacgatcgcaacaatgatgatactttggatgacgcgacgaacacgttgctgtccatactgccgctggcctccatcgtggtcgacgagcatgacgaggtgatacgcgcgcatccggacgcctacgcccttggcgtggtgcgggacgacgccatcgccgatgacaccgtggcaagcgcggtgcacgaggtccgtgcccacggcggcaagaagcagttcagcctgaccacgaccacgttgcatgagccgaagaaggctccgaaagcagggaagccaaccatgcgggaggttgccaaacaggcgttgatcggccaatcgccagacaagccggtgaccacggtgtcccgcccgaactggctgaaggtgatcgtaggcaggctcaacgaacgctttgtggtggtgctggtttccgacgtgagcgaaaccgtccgtttctcccagatccgtgattccttcatcaccaacgtttcggagcagctcctcaagccgacgcagtcgctggaggagcttgcggacgcgttggaacatgactcggacaataaggccgcgattgaggggaacaccgtaaaactgcgccaatcctgcgctcgcatggaacatatggtgtccgacctgctgctgcttatcaaggcgcaggaaccgattctgccgacggcgagcaaccgtatcaacgtcatggaacaggtgaaaaccgtcgtcggcgcgcatcgcgacatggcgcaacggcgcggcatcgacattgaaatcgatggcgacgaatcgctggacatcaacggggaaggcgagcagattcaggccgcggtcgcaaagctgctcgaaaacgccatcgcctattcaccggacggcaagggcataaccgtatccgtcaagccgaacgaggacggcaccaaagtgctgctcagcgtgcttgaccgtggttgcggcattgcacagaaggagcaaagccgtattttcgaacggttctaccgtggcggcaaccagaatgggcattccgaggaaggtatcggtttgggccttgccatcgtcaagcatgtggcgttgacccaccatggctccgcttcggtgtggagcgctccgggacagggcagcacgtttacgttggagctgccggtcgccagaaattagcggcgattacagagcgttgggacacgccatatacggcaagggccgcttccgcaggttggtgcggaagtggcccaatgttgttaccggttatttcgcgattggctgaaccgccggtcgggttattcgccaagacggcggtagtcccaccggtcgaaatgctcccaaaccagcatgagcacgccgatcaccgtgccggcggcgcacatggtctgcaatcgttcgacattgatgccgaaggccagcagaatcatgcagatcaccaaggcgatggcccataatgcggtgccgaacgtgaacaccttccgcaggtcgacgcgcaccggtttgggggagggtttgcgcacgcttgggtcgataatcggagcaaatttcataccgttaccttacctcggtgcgcgcgtcacaggtgctcggccacgtaatcgacgcacttcgtaagcgcctcgacgtcgctcggctccacggacggaaacacgccgatgcgcagctggttgcggccgagcttgcggtagccgttggtgtccataatgccgttctcgcgcaacgcggcgaccacttgggaagcgttgatgctctcgtcaaggtcgatggtgaccacggcgttggaacgtgcgttttcgtcggaaacgaacggctgcgcgtaatcggacctctccgcccactggtacagcagcgacgcggaacgtgcgcaacgcgccgtggcccaggcgaggccgccattgtcgttaagccagcgcacctggttctccagcatgaccagcgtggccacggcgggcgtgttcagcgtctggtccttacgggagttctcgatggcggaggtcagggacaggaacggaggaatccagcgtcgcgcgcccggcaggctgacgcttttagcgatgccgtaggcgcggtcgatcgcagccggggaaagcacggcgatccacaggccgccgtcggagccgaacgccttctgcggggagaagtagtaggcgtcggtctggctgatatccacgttcagcgcgccggcgccgctcgtggcatcgatcagagtcagcgcgccctgctccttggaaccttcgacacgcttgaccggggccgccacgccagtggacgtttcgttgtgcgcccagcagtaagcgtccacatattcggtgagctccggcaggcgatacgtgcccggtttgcccgcgaagatctccggatcctcaaggaacggcgcggattgcgcggacttggcgaatttcgcgctgaaggagccgtacgtgccgaacgccgccttgcgggtgataagcgacgcgcaggcgatgtcccagaacgcgctggcgccgccgttgcccagcacgacctcatagccgtcgggaatctggaagaaattcgacaggccttcgcggatggagccgaccacctgcttgaccggggtctggcggtgcgaggtgcccagaagattgcgcgcgcccgcgtcgagcgcctggacctgctccggacggattttgctcggccccgagccgaaacgtccatcctccggaagcatgttggtaggaatgttcacagtgttcgtcatgtcatccaagggtagtcagaaggtcggattgcgcgttgatatggccgttttccggacgttcctccacccgtggcgaattatttgcgcaaggacggggtcttgatgataatccctatgtcggtgtacccttacccttgtgacggttctgtaaccgtgcgcggtcataagctgcgacggtttcgcaatccgcaaggagtgattgatatatgaggcatgcggcgcataaagctgccaaggtttcgcacgcgcaattcagcctatccaaggcgttgttcacggcgaaccggggctcccataccgccaaggccgtgcgaatggcacagctggcggaaggcggcgccgtagtcggactcgctccggaagtcgtggataaactgaatgaagtggctccaatgagccgccgtgccatgcgtgaggccgccaaagccgcttcccgcaaatccgcgttggtgacctccgcttcgttggcggcgcttgtcggcaccgcggcgaccgcgttggcgttcagccagcagaacgcatcccgactggtgcttgcggacgacggtaccgaaacgtcccagatcaaacgtgtgtccgatggagcggcatcccgttccgaaggacgtaccgcccttaaggaactggcttccaccagcaacaacggcggttggcagctgggagacaccagcgcctccatggacgccagcctgatgtccaagtccatcgccgacaatccgaacgtcgccgtcctgatggaccaagacagcagcgccttaccggctaacttcaatccgaaccatgccaccggagacgtcggcaacgcctacgagttcagccagtgcacgtggtgggtgtatgtgcgccgccatcagctcggtctgcctgcaggctcccacatgggcaacggttgccagtgggccgattcggcccgcgccttgggctattgggttgataacacgccgcgccatgtcggcgatatcatcgtgttcgccgcaggccaggaaggttccgactcgtattacggccacgtcgccatcgttgagaaaatcaacgacgacggctcgatcgtgacctctgaatccggcgcctccctcaatggcggcacgtattcccgcacgctcacgaacgtgggcgatttccagtatattcactactgagtttccctaccgacgaccgtgccccttttcttgtaagagggatgctgtaagctaaggattcgatgaagcatattaagcattgttccgtgattgctgcgctcgccgcggctgctcttactttcgccggggtggcacctgccgcgctggcagccaatgatggcgccacgcaagatgctgtcgttgctacccgttcgttcccgaagaccaacgccgtgaagaagaacatcctcgcggaggcatcgtccacccaggtcgaatccgattccgactggggcggtgtggaaagcctgaacgttccccaaaccaaatctcaagccgaaaaagacgtcgaagccgccgcagcggcagcggaacagcagcgtcagcagcaggcccaggctcaagcacaggcccaagccgcttctcgttccgccgctcgaagcgacctcagcagcagcggttccttcaccgtgacgccgcctgatggggccagcgtgtccagcctgctgacgttcgcgaaccagttcgtcggcaaggttccgtatgtgtccggcggcaataccccgtccggttgggattgctccggtttcgtgcagtatgtctacggccagatgggcgtttccctgccgcattactccggtgctcaggcgactgtgggtcgcgcggttggcagcctcgccgacgcgcagccgggagacatcatcgccaatgcgcagcatgccgcgatctatgtcggcaacggcatggtcatcaactcccagctgaacggcacccgctacgatcccatcgcatgggtgttccccagcagctacagcattcgtcgaatcttctgaagctttgacattgagctaagggcgtatttccgtgaggaatacgcccttttgctttgttattttccgcgtcgttacttgaaaaccgcatgtcgcgcggtatggtggaagtcaggtgcaacgcatagtcgcgttgccgcaacctgattcaagggaggtcgctcatgatcaatgacaaggcaatcctcgtaggtgtcgatggatcccacgccagctacaaggcgacatggtgggcagcgaattacgcgaagcatgcgggactgaccctgcagatcgtctgcgcatattcgctgccaagctatgcggcagtgtcgttcgatgccacgtatacggccatgggcgatgataatgccgcgcacaacgatgcgcaggagattctgtcgaaggccaaggccatcgccgacgagcagggcgtcgaggcatcgacgttgatcgtcaccggagatcccgcatccgtgttcgtcgaactgtcgcgcaactacaacctcatcgtcattggcaaccgtggcaagggtggtctggccgaacgactgctcggcaccaccagctccagcctgccggcatacgcgtactgcccgatcgtcgtggtgccgtacaccgacgacgaaggcaacctgatgcacttgaacaacaccatcaccaaggtggcagtcggctccgacgaatccaagtggggtctgaaggcgttggagatcgcggccgcgttcgccgattcgtggggtgccgagctggacgtcatctccgccgtgccgaacatgaagggctccgaggatgaaggcgtcatggcgtccttccaggaggatctggatgtgcgcatcaagccgcttgaagaggcgtacccgaacctcaagatcaacaagcagatcgtgcccggccccgcagccggcgcactgaccaaggccagctacgatcatgacgtcgtcgtggtcggctcccgtggtcgtggcggcttcaccggtctgctgcttggctccaccagccagggtctgctgcagcatgcggtcggaccggtctacgtggtgccgcgcaagtatgtggaagccgcggagacccgtctcgacaccgtgccgagctcgcctgccgacgtcacgccgaaggcgatcgacgacatcaagggcgtcgaggaagtgccggtcgacaaggccaagccggaagtggtcgaagccatcgaaacgaagatcgatccggaccgtcagtgacggtacggcaaatcgactgaaatcgatataaaaaccgcatagaagagggtggctgcgattccaacgaatcgcagccaccctctaactatgtgcggtacgtgcgctcagtgcttgacggtgacgttcatacgcactggcgtcggctcgacgtacgtatgcttgaccgtgcagcccttctcgatatgacggctgacgcgatcggcgagcttttcggcgtcctcgtcgctcaaaccggcgtcggtggcgtcgatgaccacctgctcgtcgaaaccgatgtaggcgtcggtatcggcatcatacgtgccgttcaccacgatcttcgcgcccttgccatcgcccagcgtatgctcgacggcgaactggctggacagcgcggcgcaaccggccagcgcgaccttcatcagatcgcccggcgtgaactggccacggcccttgccgaacttgatgtgcgcgccatcctcgctgaacgcgtcccaggaaccgtccttgttgcgctctacccacagcctcttgcccatggaaactcctcatgtcctgtggcgcgccgttcgcgccaatccgtgataccaatctagcgcatcgaaacggacgtgggggagtgcgttccgcaagatgaagcgatacggttttgtgattcgttacgattgcgctggaggccggcggacggccgggatgcgcgttggcggcacactcaaggccgttcggccaagcttacggccttacaacgcgcatcccggccgtccgcctccacgccaccggctaaacttgcctattatggctttgacttccgaacaactcgcagacatccgtactcgtattcccgcacgtccggaaacggacattcccatgccttacgaggatctggtacgcaaaatccttacggaaggcacgctgaaatccgaccgcacgggcacgggcacagtctccctgttcggccagcagatgcgtttcaatctcaaagacagcttcccactgctcaccacgaagacggtgttcttcaaaggactcgcctacgagctgctgtggttcctcaaaggctccacgaacgtacgttggctgcaggagcacaacgtgcacatttgggacgaatgggccgacgagaacggcgatttggggccggtctacggcgcgcagtggcgtagctggccggcaccgacaccggacgatccgaaccgcaccatcgaccagatctccaacgtgctcgacctgatccgtaaccaccccgattcgcgccgcatggtggtttccgcatggaacccggcggaagtggagaacatggccttgccgccatgccacgccctgttccagttctacgtggccgacggccgcctgagctgccagctgtaccagcgttcctgcgacatgttcctcggcgtgccgttcaacatcgcctcctattcgctgctcaccctcatgatggcccagcagacgggactcgagcccggcgaattcgtttggaccggcggcgactgccacgtctacgacaaccacatcgaccaggtgttggaacagctgagccgtacgccgtacccgtatccgcagatccgcatcaggaaggccgattcgctgttcggctacgattacagcgatttcgaaatcgtgaattaccagcatcatccgaccatcaaggcaccggtggcggtctgaggttgttgccgccgtctggcgcgtctgcgccagacggtagactactgaccctagttccgacttcaaggagtgagtgaaatggagcacgatagtagccgcagtggctatcacgaacccgagcccggacttgccgggcgtgaagacgaggaggattggggcgacgatttccccaaaaccttctctgtgaatctgatttgggcgcaggcctgtgacaaggaaggtcacgacggtgccattggattcgaaggcggcatgccatggcatctgcctgaggatatgaggcatttcacggagctgaccgtctcccatccggttatcatgggccgcaagacgtgggagtcgctaagcccgaagttccgtccgctgcccaaccgcgacaacatcgtcatctcgcatgacccgtcctatttcgcgccgggcgccaccgtggtggattcgctggatgacgcgttggatctggcccgtcaggaggccattccggatgacggcttggaccgcagtgaaatctgggtcatcggcggagccaaagtattcgaggaagcgatgccattcgccgacaaggcgtatgtgacgcagatcagcatgcacgtgaacgccgacacctacgcgcccgatatccacgcattggtggaatccggagcatggcgcgtggccgaggaaggcacgtggcagaaggcgcggaaaggaaacgaccaagtcgaaggcttccgtttcgtgacgtacgaaagaaaccacgaggagtaacttttcatgtataccgtgatgaccgtgtgcacgggcaacatctgccgttcacccatggctgaaatcattctgcgcgccgaattcgagcgccgcggcttggctgacaaggtcaacgtcgaatccagcggcgtcagcgacgaggaatacggcaatccgatcgaccgccgtgccgtcaaggtacttaaggaacgcggctacgagctgccggcgcaccatttcgcgcatcgcatcacgcgcgacgaaatcgaacgcaccgacctgttcctgccgatgaccgcctcgcacatgcgcgcgctgctccgtcagctgcctcaagccaagcgcagcgaagtgcacatgtaccgcagcttcgatccgaatctgccgaagccggccgcgggacgtgaggacagcatcgacctggtggacccgtggtacggtggtccacgcgaattcgaagtggcgatcgaccaaatcgaagaggtggcgccatatatcgtcgattgggccgaacagcagttgcagaactgattttttattgcgattgcggcatgcttgatggtttcaagcgtgccgcttttgttttttgcgatttattgcgatttattgcgatttttttttggggggggctggctgtgttgtgaagttgcgatttttctgatgttgcggtgtttggtgggattgaatatacggcgtttttgcgatgttgcgattgcggggtgtccggtggaggccggcatatgcgttgcaaggcacactcaaggccgttcggccgagcttgcggccttgcaacgcatatgccggcctccacctcgtttttattggcaggttgcgatgttgcttcgttctgtgggtaagttgcgttttttgatttttgtggggcgcctcgtttttgtgggcaagttatgtcttgacggttgggaagcgtgaattggcgtgggaggggagggtgagggtaaaagaaaaaccccggcggattgggctggggtttggtggcgaccacggccggacttgaaccggtgacctccgccgtgacagggcggcgctctaaccaactgagctacgcggccgttgtttcagccttgcgactgacaacagatagaaatactacggcaaaaacgcaattatgcaaaactgcggcgtgtcacggtgtgttgggcgtggcgcgccgcagtttcgcgggaaaggagacgaatctcagtcggtctgcttccaggtgtcgacgtcgatgtggtgctccgggttggcctgccatgcgtcccaagcggacttcacaatgtcctcgacattgtacttggcgtgccagcccatctcctcgttgatgcgcttcggggagccgatcaggtgcggcggatcgccggcgcggcggcccatgacagtctccttgaacggcagaccggtgaccttcttgacctcatcgacgatctggcgcacggaggtgccctcgccggtgccgacgttgaacgcgtcatacttgcgctcgtcgcggtccagatacttcagcgcggcgatatgcgcgtcggccagatcggacacgtggatgtagtcgcgcacgcaggtgccgtccggagtcgggtagtcatcgccgaagatcgccggggccttgcccttcttcagacggtcgaacagcatcgggatgaggttcaggatggccggatcctcaagttccaccgggccgcagccggccacgttgaagtaacgcaggccgcagaagcggatgccatacggttcctcgcaggcgcgggccatccactcgccgaacagcttggtctggccgtacgggttgatcggcagcatcggcacgacgtcttccggcaccacatcgaccggcggcacgccgtaggtggcggcggaggaggagaagacgagcttcttggcgccggaatcgcgcatgccgatcagcacgttgagcatgccgttgaggttctgctggtagtaccacagcggcttctcgacggattcgccgacctgcttgcgggcggcgaaatgaatcacggaatcgacgccttcggccttcatgatctccgcgaggcgctcgccggcgcccggagcggcgatgtccatgccgtacaggcgggagccttcgatgcgggtgggcttgccgtagctcagatcgtcgacgacgacaaccttttcgccggcctgatgaagtgcgtgaacgacgtgggcgccgatgtatccgcacccaccagtgacgagaactgtcatgttctggcctttccttcaaatgagcggtgaactttgatgatttgaaaaaatgtcaaccattgttcactttttgctcagatttgttaccttttgaacaatttgagtatagcacgtgaacacgaacgcacataactcgttcgttcctgcgtttcctctataaattagggtatgcaacaagacgaaaacacgccgaataatggccgtgaaatagaagaaaacgtgccagacgtacaaccgacagtcgatggcaggcctgctctttacggccgcaaagtactgtccttcgtgcggcggtccgcccggctcgacgcgcgactgcagcgggcctgggacgcctacgccgatacgtatctgctgaacatcaacgcgggcgaagggtccctcgacgtgcgtgagggtttcgtgttcgaccaagcctatatccgcgaaacgtggggcaataccaatcctctgatcgtggaaatcggctccggacaaggcgagaacgtcgttgccgccgcagccgcccggccggacgtcaacttccttgctctggaggtctacgatccgggcgtggcgcacacgctgctgctcgccggcaagcagaacctgaagaacctgcggatcgcccagatcaacgcgccagaactgttcaaggcggccgtcgacggctcgatcgccgaagtgtggacgttcttccccgacccgtggccgaagatgcgccatcacaagcgccgcatcgtacagcccgagctcgccgcggacatccaccgcgcgttgacggacgaaggcgtgtggcgcatcgccaccgacatcgaggattacgcgctgcacgtccatgaggtgatggacgagctggacggcttccataacgacggcgcattgaccgtgagcctgcccgtcgagcacgtcggcaaaggcaacgcggatgaggcggccgcattgcgacacgccgatttcgctgaatccgagcgattcgatggccgtgttttgaccaatttcgagaagaagggacttgccgccgggcgcgtgattcacgatttcacctatcgtcgcgtgtaatgcgataaggcttggaatttcagtgttttacgaggattcctgtcttattgtggcggtgtgtgacaccggcgcgacacgccgaggtttgcatgtcggccagattcgcgtatagtagggcaagttgtcaagcggaaacgctgaaagcgcccccttcgtctaacggttaggacaccagactttcaatctgacaacgagagttcgactctctcagggggtacgtaccttggaaacaaggtggcaatggccgcgtagctcagttggttagagcgccgccctgtcacggcggaggtcaccggttcaagtccggccgtggtcgctggaacagcgcaagttgttcatggctctgtagctcagttggtagagcgaacgactgaaaatcgttaggtcagcggatcgatgccgctcggagccaccatggaaaccccggagagattcggggtttattgttttgtgtcaggtttttcttcactgtttcatggtttctgtggtatcgatgcaattatctcttgttatcgctgctcctaactaagagggaattttgttcctagtgttgataaattacggcgcaggtggataaacgattgtcgtggacggcaaatccgtggacgagaccatgtgggtcttcgaaatgggagggatcggctcgcttggagcgaattatttgatatccggcgatgtctcgtctggttttcttctgctgggtggaaagctcgtgtaatactgcggtgtcgttggccgcatgccggtcgaaaatgggtttatgatgggagcgttggctttacggcaaaggatgccggagcccatgaacacacagtcgcttaaaggagagcactatggtctatcgcatgattttcaaccagaccgcgtatttcggccgcggagccatcaaggagattccgggcgtcgccaggtcccatggcttcaccaaggcgttcatcgtcactgatccggtgctgctggagaccggcaccgtcaagaaggtcaccgacgttcttgacgaggcgggcatgccgtatgaggtgttcgacaacgtcaagccgaatccgccggtcgagtgcatccaggatggcgtcgccaagttcgcagcctccggcgcggacttcctgatcggcctgggcggtggttccccgcaggacacctgcaagggcatcggcatcgtgactgccaatccggaattcgccgacgtgctgtcccttgaaggcgtggccgacaccaagaacccgtccgtgccgattttcggtgtgccgaccaccgctggcaccgcgtccgaaacgaccatcaactatgtgatcaccgacacggccaacaagcgcaagttcgtggccgtcgacccgcatgacatcccaatcgtcgccttcgtggatccggacctgaccgactccatgccgcgcggcctcaaggtggccaccggactcgacgccctgacccacgccatcgaaggctatatcacaccgggcgcgtggagcctgtccgactgcctgtccatgcagaccatccgcatgatcgccaagaacctcgccaagagcgccgatggagacattccggccggcgaacagatggcctacgcctcctacatcaccggcatggcctactccaacgtcggcctcggtctggtgcacggcatggcccacccgctgggcggccgcctcggcgtggcgcacggtgtggccaacggcatcctgctggccccggtcatggaatacaacaaggactacaccggcgagaagtaccgtgacatcgccgacgccttcggtatcgccgacgcctacaccggcgacatcgaaaccgtgcgtgaagaggccgtccaggcggtgcacaagctcaccgtggatctgaagaacccgaccaagatctccgaagttggcgccaccgaagccgacctggagccgctggcccatgacgccttccacgacgtgtgcacgccgggcaacccgcgccaggccacccaggaagacatcctcgccatctacaagagcctgatgtaggtccgactgcggtaggcgcaatcgcaaaaccgcaatcgtaaaaacaaaacggacggcatcgatcgcatggtcggtgccgtccgttcgctatccgcggaaaatacgccgcgaataatcgctatacctaatcgctattcctcgtgcttctcgctccactcctcatcagtgggagtgtcgtcatacagctcatggccttcctgttcggccaattccatctgctcgttgatccacgcggcctcggccggattgatatcagcggtgttcaacaccttctgccacaccggatacagcagatgcatcacaggatataacgcggtgatgaggatttccggcttgtgcttgcggtaatgctgcggatgcgcgttgaacgtgttcttgaaacggcgcatatagttgaggaacgatgccggagacgtgtccatacgacgtgcgctgatgcccgcgatcatccgcggacaatacacggtcttgagatccttgcccaacagatgcagcgagatgtcgatgtcctcatgcatcacatccgccttgtcttggcagacctcgtcggcgatttcgcgccaggcggtggcgcgcagggccatgttggaaccgaacagcagaggttgcccatcatcggccctataaatacgtttgcgggtggaattgtccccgcgaagcccgaaatgacggctcggcaaatcgtaatacatcaccggaccggtggcgcccatcgcatccggatcctcggtgaaaatgccggacaccacctccacccagtccgggcggatcatgcagtcggcatcgaaacggccaagaatatcgccggtggcatgattcaaaccataatcacgcgttggaatcagaccctgctcatcatcctgatgcagcagcttcaccggcgcttccggatggtccttcatgaactgctccaccacggcaacggtcgaatcagtggaacggttatcgacgacaatcacctcatgaggcatcacggtctgccgggtggcgttgagcaggcaatcgttgatacgctcctgttcattccaggcggggatgacaattgaaacgttcagcatggtttcaagaataggttccagcccgtacacggtgcctgtctacaataaggagccatgagcgaacgcgaacagcatatggatacggacaagaggacgggaacgtccggacagtgcggcaataccgacgaaatgcgttgggatctcggcacgctgttccctgcgaaaggcgatccacgcagacctccggaatggctgggtcgcgcgctgctgtacatcgccatcgccatcgtgctgctctccttctgctggcgcagttggggcaaaatcgaatacctcgtcatcgacgtcgtcatctcgctgttcctggcgctcgccgtggagccggtggtgattccgctggtcaagcatggctggaagcgttcgttcgcttcgattttcgcgttgctgatgttgggtgtcctgctttgcgtgatgttcggtctgttcggcaatctgttcgtgcagcaggtcatcgctttgtgcaacggtctgccggccctctaccagcagatctgcgatttcgtggcgcaatacacggatttcaagcttcctgagatcaacagtctcggcggtgagattctgaagaacatccagacctcgtgggtcacggatttcgcgggcaccgccatcagcacggtgtccggattcttcagcttcctgctgaacctcatgacggtgatcatgaccacgttctacatttcggcggccggcccgaagctgcgccgcgcggcctgccagtggatggctccctccgcgcagcgccggttcctgttcgtctggaccgtcagccagacgcagatctcatcgttcctgttctcacgtgccatcctcgccgtgctcaacgcgttcttcacctcgatctgcctgatggcgttgcacgtgccgtattggatgccgttggcgttgttctgcggcgtcgtatcgcagttcatcccgatgctcggcacgtacatcggcggcgcgttgccggtgctgttcgcctggggcagctgtggtttgtggcaggcgatcgccgtggtggcgttcatctgcgtctaccagcagatcgaaaacctgatcttcgcgccgaagatctcccgccgcaccatggacgtcaacgatgcggtcgccttccttgccgtcctggccttcggctcgctgttcggcgcgatcggcgcgttcctggcgctgcctatcgtcgcctcgatccagacgatcgcccgcacctacaccaagcggtacgatctggtcgattcgccgctgatggacgatccggttccggacaagaagtcgaagctggtggaaggcgccgaagtcatcagcgagcacctgcacgccgtgccgcgcgccgtgcaggggtcgagcgcgcatgtgccgattcccgacgacgtgcgcttcctgcaggagcaggcgtacaatatcactcggtccgacgagaccggggatgccgacgaatcgcagaccgtcgccattccgaagcacgtgttggacggggtcgatcgcaagccgctgcggggaaccgcggaagcggacggagcgcagacggaagccggaccgcaggtagcggacgggtcgcaatcgcagggaacggatgacaatccgagaagtaggtggcgttaatggtattgctgagcgtacttgatgtcgtgctggtggttttgggcggcgccggcatgctctaccaagcggtctgcatcgtcatctcgctgttcgccaagccgatcaagttccccgaagcgccgatgaacaaacggtacgcggtgctgatttccgcgcgaaacgaagcgaacgtcattggcaacctcatcgactgcctgcattcgcaaacctatccgagcgagctcatcgacatctggctggtggccgacaactgcaccgacaacaccgccgaagtggcccgaaacatgggatgccacgtcatcgaacgattcaacaaggagcaggtcggcaaaggctacgcgctgacctatctgctcgaccagatgaacgagtcgggcgcatccgacccgtatgacgcctttttcgtgttcgatgccgacaacaaactcgacaagcactacatcgaggaaatgaacaagggcttccaagccggtttcaaaatcctcaccagctaccgcaattccgtgaacctgtccgacaattgggtgtcgtccggttccgcgttgtggttcatccgcgaatcgcgcttcgtttccgcctcccgcatgtggctcggcaacagctgccacgtgggcggcaccggcttcatgttctcccaggagatcatgcgtcgcaacaacggctggaaattccacctactcaccgaggatctggaattcaccatggacagcgtgctgcacggcgaccgcatcggctactgcggcaccgccatcctgtacgacgagcagccggtcaccttcgcgcaaagctggcgtcaacgcctgcgttggagcaagggattcctgcaggtgttccgctattacggaccggcgttgatcaagcgcgcggtcagggaacgtgatttctccgccgtcgatttcacgctgctgctgtgcccgttcaccgtgctcggcatcgcacgcgtgctgttgggcatgctgttcgctgcctgcggtttcgtgacatggcaaagccagctgaattcgctgaccggctggacatccggcattgtgatatcggtgatcggcatgatgggactcgccgcattgaccatcgtggcggaacgcgatcacgtgggcgccaccaacaaggagctgctcgcctacgtgctggccttcccgatctacatgctgagctatgtgccgatttcgttccaggcggtgttcgccaagtccgaatggaagccgatcgagcataagggctgaggcttgcccgcggcggtgtgaacggtcatgagatgtttcgtggcgatccatacggtgcggatggtgaaaagatgacgaagagagggtgtggtttggctatggatgacgctggcgattaccgctatacgcgacgacgccgagcgatcacggtggcggtttccgtcgtggccaccgtcgcactgtgcgtcggctatgcagtggccgacatgtgcgatgtcgcaccgggcgtcctcacattgcgccatgtcgaacattcgacggtcgccgctgccggccgttcgatcgaggcggccgacgtgatcgccgacatcgacgcttccaagaccatcgatccggccgctgcgcgcgcgctgaccgacgcgttccgagcctcagccgccggcttcggcggcgaattctccatcgccatcgccgacgcgtcgggcaacgtggccgcggaaaacaacatcgacgtgccccgcacgccagcatccaccatgaaaacgttgacggcgtatgcggccgccgtcgaactcgacatgggcaagaccctggacacgcagacctatctggaacagtcccaggacggcaccgcgcgtctggtgctcaaaggcaacggcgacatgctgttgggagccggagcgtccgacgcgaaccacatcaacggacgtgccggattgggcacgcttgccgggcggaccgcacaggcgttgcggcagcgtggcatcacctccgtgacattggcttatgacgacacactgttcggcaacgaccgctggccgcaaggcatcgccgaactcgacacggaccacctgtactacgccccgacagcttccatggccgtggacggcggcaggaattggaacgggacaggtccggccaatcctgatgtgttctcggcgtatccggcattgagcatgcagccggcgcgtgacgcggcgctggtgttccagcagcggctggccgaacagggcatcacggttcagggatttgtatcgcaaggcacggttgcgggggcatcccatccgcttgcctccgtgcgttcggcgtcgttgaacgagattatggcgttcaccatgcggcattccgacaattcgctcgccgaggaattcggcagactgctggcgttgcaggtcggcgcggacaattcgccggctggcgcggtgcaggctgtgaaaagcgtgctggagcgcaaaggcatcactacgaccgggctcgacatgcgcaattgttcgggacttacggaggattcgaaactgacggcgcgcaccctgctcgaagtgcaactgcgcaatctggctgcgggatcgggggcggccgcagccgaaggaatgtccgtcatgggcttcgtcggcaccgctgagagccgtctgaacgatactgacgaagcggggctgatccgtgtgaaaaccggcagtctgggcgacgtgacctccatgaccggcaatgtgtcgcggttgaacggcggagcgttgaccttcgcggtgatcgtcaacaatcccaccgatttcgcggcggcgaaggcggccatcgacacattcgtggccggtctgccgaagctgtgaacggccacgtgtgaatcttcccagcggatattcagcatatagccagaaacacgtcattcgcatgtgccaagatggtgggcatgcgaatcgctgacgtacaagaagacattgatcacgagctgatcagcaaagaagagatctccgacatcatcaaccgtgccgcggcacaagccagtgaagactatcgtggcaagaacccgctgctggtctgcgtgctcaagggagccgtgaacacgcttgcggcgttctcccaggccatgagcattccggtccaaatggatttcatgagcctgtcgagctacggttccggcacggagtcgagcggcaagatcacggttcgtcaggatctgtccacggatgtgcgaggacgccatgtgctgattgttgaggacatcatcgattcgggcatcaccctggcttggctggtcgacgagctcaagcgccgtggagcggcttccgtggaaatttttgcgcttctggagaagccggcacgtcgcaaggtcaatgttgatgtgaaatacaagggacgtgagattcccgatgaattcgtggtcggtttcggcttggattacgacgagtactaccgcaacctcgattcgatcgcggtgctgaagccgtcagtctatgaaggaggtcaggcatgagtttccctggtccgaaccagccgccaagcaatggcggcggcaacaagcccaacgggggcaataacccgttcaccaatccgtttagccgcaacaatgacggcaagaacggtggcagcggggcgaacggcaacaagtccaacggcccccgtccgttctggcagtcgccgtggctgtgggttgtggtcgtggcattgcttgccgtgaccatgttccagcttttcgccggtgcgggctcgcaaaccatcgacaccaaggatggcatgcaaatcctcaacggcaacaccgtagagtacgcgacgatcgtggacaacacccagcaggtcaagctcaagctgtcgagcgattactccgccaccgacccggacaccggacgtacgaagaactacggcaagaacgtgcagttctactacacgtatgcgcagtccgcggccgtggtcaaggccgtgcagaaggccgatccggccaagggctggaccgcgtccatgcagcagaccagcatttggacctacctgctcacctcgctgttgccgttcctgatcatcttcggcctgttctggttcctgatgagccgtatgggcggtgccgccggcggcatgttcggcatgggcggcaagaagaacagcggcaaactgctcgacggccagaccccgaccaccaagttctccgacgtggccggcgaagacgctgccgtgcaggaggtcgaggaaatcaaggacttcctcaaggacccgtcccgttacaaggctttgggtgcccgcattccgcgcggcgtgctgctgtacggccctccaggcaccggtaagacgctgctggcgcgcgccatcgcaggcgaggccggcgtgccgttctactccatggccggctccgacttcgtggagatgttcgtgggccttggcgcctcccgtgtgcgtgacctgttcgatgaggccaagaagaacgctccggccatcatcttcatcgatgagattgacgctgtcggccgcaagcgtggcggttccggcatgagcggtggccacgacgaacgcgagcagacgctgaaccagctgctcgtcgagatggatggcttcgacaacgatacgaacctcatcatcatcgctgcgaccaaccgtccggatgtgctcgatccggcattgctgcgcccgggtcgtttcgaccgtcaggtggccgtcgaagcacctgatttggaaggccgcgaggcgattctgaaggtacacgccaagggcaagccgttcgtgccggacgtcgacctgcatatgatcgccgtgcgcacgccgggcttcaccggcgccgaccttgccaacgtgttgaacgaagccgcgttgctgtgcgcccgtgccggcgcccagctcatcgacaaccgcgccatcgacgaggccatcgaccgtgttcaggccggtccgaagcgtcgttccaagggcatggctctcgacgagctacgcaacaccgcatatcacgagggtggccatgcgctggtcgcggccgccatgaacgacaccgatccggtgaccaaggtgacgattctgccgcgcggccgtgcactgggctacaccgcggtcatgccaaccgaggaccgttactccatgtcccgcaaccagctgctcgatcagatggcgtacgccatgggcggccgtaccgccgaagaggtcgtgttccacgacccgaccaccggtgcttccaacgatatcgaaaaggccacgaacatcgcgcgtcagatggtgctcgactacggcttctccgagaagctgggcgccatcaagtggtccgacgacgagcaaagcgatctcggcgcgctcacccacaagtactccgcgcacaccgccgaaatcatcgacgaggaagtgctcaagcttgtggagaccgcgcataccgaagcatggaacgtcatcaacgagaaccgcgacatcctcgacgagctggtacgtcagctgctcgtcaaggaaacgctcaacgagaaggagcttgccgccatcttcgccaacatcaagaaggcgccgaagcgcgaggtctggttgagcgacgagaagcgtcccgattccgacattccgccggtcccgattcccgacaagctgaagaaaagcgcaggattgaccaactgatgagcgataccgatttcgataccctcttcgacgacaaggcccgtgccgctcatgcggccgggcctgtcggctatgacgaggaaggcgtgcgccaggccgtgcgcctgttcttgaagtccatcggcgaggatccggaccgtgaaggtctgctggacacgccggaccgtatcgggcgcgcgtgcaaggagctgttcgccggcctcggacacgggccagaggaagttctgaaaacccgtttcaaggtggacaccgacgaaatggtcctcgtacgcgacatcgaactgttctccgtctgcgagcatcatctgctgccgttccatggcgtggcccacgtcggctacatcccgcagaacggccaagtggcgggcttaagcaaactggcacggttggtggaactgtacgcacgccgtccgcaggtgcaggagcggctcacccagcaggtggccgacgcgttgatggaaggcatcgacgcgcgtggcgtgatcgtggtcaccgaatgcgaccacatgtgcatggccatgcgtggcgtcaagaaggcgcagtcccgtaccgtcacctcggcggtgcgaggatgcatgcgcgacgcggccacgcggaccgaggcgatgagcctgattctgtcgaaccattcgtaagtgcgctttaccgggcggaatcggacagaaccgaacggaagaacggaatgaatgaaggaagaaaaccgatggcgattgatatgaaggcgattcatgatagccagcgcacgttggtgatgggcgtgctcaacatcacggaggattccttctccgacggcggcctctggcttgctccggaggcggccaaagcccatggcgaggcgatgatgaaagccggtgccgacatcatcgacatcggagcggaatccacccgtccgggagccaaacgcgtcagcgaagccgacgagaaggcccgtgtgctgggcgctgtggacgcgctgattcccgaaggagcggtgctgtccatcgacaccacgcgcgcttcggtggcgttggccgcgctcgaacatggcgcgcagatcatcaacgacgtgtccggcggccagttggaccgcgaactgccgcatgtggtggccgaccattccgactgcctgtacatcgtgcagcattggcgtggctggcttgccggcgccgcgggcaatgtgccggacgccgacacctcccgctacgagcatggcgtggtgaatgacgtgtatgacgagctgatgcgtcaggtggatgcggtgcttgaagccggggtgcaggccgaacaggtcatcatcgacccgggcctgggcttctccaagccgggcgtggagcataacctgccgattctggcggcgcttgaccggttcaacgcggctggctatccggtgctgatcggcgcgtcccgcaaacgtttcgtcggctcgctgcttgccggcgccggtgtgaccgagccggacatggcctcaaaagacaacgccaccgcggccatcagcgccctgtgcgcggaacatggcgtgtgggccgtgcgcgtgcatgacgtggcgaaaagccgcgacgcggtcgccgtcggcaacgcatggcgcgagtatgcgaacgcgtgaccgtgcgaatcgcagatagtcacaacatcgcaatcgcggaaataataggaatacggaacgtaggaacggcaaaggaaggctggtatggatcagattcgactgacgggaatccgcgcgacgggcaaacatggcgtgctcgacttcgagcatgagcgggcccagaccttcgtggtggacgccacgctgttcctcgacctcgctgccgccggccgttccgacgatctgaacgacaccgtcgactatggtgcgatcgccaaaggcatcgtggccatcatcgaaggcgaacacgtcgatttgattgaaaagctggccaatcgtatcgtcggcatgattctcggctttccggccgtgtgccgcacgcaggtcaccgtgcataagccgaatgcgccgatcaccgtgccgttcgacgatgtcagcgtgaccgtggaacgttcccgtgaaacagttgacagtccatcgcgtgagcggtcgtcggaacatgggcaggtgcatcatgccatcatcgccatgggaggcaatcagggcgatgtgaccgccaccttgcgtgacgccgttcggtgcattgatgggcttccctccacgcaggtgacgggggtgtcgccgctctatcggaccgacgcatggggcatgccggaaggtactgcggaattccgcaatgcggtcgtgtccgtggataccaggctttcggccgccgaactgctggccggtttgcagcgcatcgaagcctcgcatggtcgcgtgcgcaccgaccattggacgtcgcgcacgctcgatttggacatcatcgactttgacgggcaggaaagcgccgaccccgacctgacgttgccgcatccgcgcgcatggcagcgggctttcgtattggggccgtggcttgcgcttgaaccggacgcagaactcgggggagcgcacgccggttccgtggcgcaactgctgcacgaaacgtccgaccgcgaccatatcgatgagatcgcggacgattggatggttgccggagctcaggatcccatagttcgcgattccgacattgggacgtctgcagatgacgttgatgcgattgacgatgccgattctgttgaatccattgattccattgaacttccggaaggtacggcggcctccaaagcagccgctgcggccgcggcgaaaccgggaccggcatcccgtcgagcggtcatttccctggatagcgtttcaactgatgcggaacaccagttccgtcaggcgatcgtggccatcgacgcgcttcccggcaaccaggtggaaggtatttcgccgctgtaccatgtcagccaggtcgacgactatccggacaaaatggccgccgtcatgcagatttccacgcgcatggacgcgcgtgagcttatcggtgcgttggaatcggtgtcatcctccatttcggatgacctcgacctcgaccttgtggacatggaaggcgtggtccgcaacgaacctgattgcatggtgccgtggccggccgcacgtgagcatgcggccgtgctcgccccatggttcgacatggatccggacgcgaaactcggcagggatccggtcgcgttcctgctggcgatggctccggacgccgcgcaagtgggcatgctgaccgacaattggattatcggagacacgctatgagagcacgcagaaccccttggtggtcattcgtccttgcggccgcgcttggcgtgctggccggcatgggattggcgaaatacggcgagatttcaggcctgccgttggttggcgcaccctggatcgtgccggtggtgctggccgtgttgggcggtgtggtgctgtacatggctctgcagattcataaatacacgaccaaagatcccgtcaaacgcgcgcagctcaagccattggacccgcagaaggcgttcggcacgctggtggcctgcaaagcgctcggacttgcgggcgcggcgttggccggctggtacggtgggcagatcatcatgagtctgccgcatggtgaggcggaattctatagccaagccatcatcgaatgcgtggtggcctgcgtggtatgcgtcgccgacatgatcgtcggcatcgtgggggagtggctgtgccgcatcccgcctatcgacgggcaggaaagtccggccgtgaaaaaggccgcacagcgcaatcgctatgcggccgccgccacgaaggcgtctacaaaatcggctacgaatcctgccacgaaatcgaaagtctgaacgtcagaccttctttaactccgtctcagtccttcttcggcacgcggaacatcgcttcctgcgccatgcaggccaccagctcgccatcctgtgtgtagaccttcgcttggcccaagccgcgtccgtgcgccgcggtcggcgtgtcttgcacgtacagatgccactggttgatgtcgatgtcgcggtaccaccacatcgaatggtcgatggacgcatacgaaatgcccggcgtggcgatgcttaagccagcacggcgcagaatcggctccagcatgatctggtcgcagcccatcgccagcatcgcacgatgcatgacctgcggcacgtccaccttgccgtcggccttcatccacaccatctgcttgccggaatcctcgctggcgctcttcttgtcggcgccaagcatgatggtgcgcgtcacatggcgaatatcgaacggcgacttctccgcataatacttggcgaacggcgactgttccgcatacggctccatcagttgcttcgcgctggtcaggctgtcgggatcgggaatgttctcaggcatcgggtcggcgaattcgatgccttcctggtcatgttcctggaagctggcgattgccgtcaaaatcgagccctgcgcctgcgtgacattcacgcgacgggcggagaaggaacgtccgtcacgcagattttccacgtcgaacagcagatcctgacggatatcgccggccgaaatgaaatagccgtggatggaattcggcagacgggatggagcgacggttctcgacgcggccatcagcgactgcgcgatgacctgtccgccgtagactcggccagtggggaagtacaggctttcgccgttgatatacgtatggttgcgatagtttgagggcgtgcccagctggagcacctttgccagtcgctgcagcggcgtcatgtctgtctgcgtcatgatggcctcgattccttccgcgtgtggatagctctttatgctggcatcgagtctatccatacgtagtaaatttcgtcggattgttttgtaacgagtacgtgagaagaatgaacggttggttagcggcaacggttgacgtatggcaaagcgccaccgctcgtaatgaagggtggcgctttgctgaaatctgcgcttaacgcgactcgattggatctgtctgcctttagcgggtcagcttgcggtgcaggcggtgcgggcgggccgcatcctcgccgagacgggcgatgcggttctcctgataggcctggaagttgccttcgaaccagtaccagttggccggattctcgtcagtgccctcccatgcgaggatgtgcgtggccacacggtcgaggaaccaacggtcgtgggagatcaccacggcgcagcccgggaaggcgagcagcgcgttttcgagggattccagggtttcgacgtcaaggtcgttggtcggttcgtcgagcagcagcaggttgccgccctgcttcagggtcagcgccaggttcagacggttgcgttcgccgccggacagcacgcccaccagcttctgctggtcggaacccttgaagccgaaggacgccacgtaggcgcgggtcggcacttccacgccggccacctcgatgaagtcgagtccgtcggacacggcctcccacaggttcttgttcgggtcaaggccggcacggttctggtcgacgtagctgatcttcacggtgtcgccgatcttgagcgaaccggaggtcaacggctccaagccgacgatggtcttgaacagggtggacttgcctacgccgttcggtccgatcacgccgacgatgccgttacgcggcagggtgaagctcaagtcgtcgatgagcacgcggtcgccgaacgccttgtggatatgctcggcttccagaacggtggaacccagacgcgggccggccggaatctggatttcggagaagtcgagcttcttgttgttgcgtgcctcctgctccatctggtcgtaacgttccagacgggccttgttcttggcctgacgggccttcggcgaggaacgcacccagtcgagctcgctcttcaggcgcttggcgagcttggcgtccttggcgccctggatctccatacgcttggccttggtctccaggtaggtggagtagttgcccttgtatggatacaggtggccgcgatccacttcgcagatccattcggccacattgtccatgaagtaacgatcgtgggtgacggcgatgacggcgcccttgtactggtgcaggaactgctccagccacagaatcgattcggcatccaaatggttggtgggctcgtcgagcagcagcagatccggagcctcaagcaacagcttgcacagtgccacacgacggcgctcgccaccggagcacacgctcaccggcgtatccggatccgggcactgcagagcgtccatggcctgctcgagctgggagtcgagatcccagccgttggccgcgtcgatatcgttctgcagcttgcccatttcttccatcagcgcgtcgaaatcggcgtccggattggccatttcctcgccaatctggttgaaacgcgccaccttttcggcgatcgggccgaatgccatcttgatgttctcgccgacggtcttggtgtcatccagcggcggttcctgctgcagaatgccgacggtgaaaccaggggtcaggtaggcttcgccgttggaaacggtgtcgaggccggccatgatcttcagcagcgtggacttacccatgccattcgggccgacgacgccgatcttcgcgcccggcaggaagctcagggtcacatcgtcaagaatcactcggtcgccgtaagccttgcgggccttgatcatctggtaaataaactcagccaatgttgtgttccatccttaagaaacgttggaattccagcgttttgcgtatgtcggtcgacggaaaatcgcacttgttcgccgtgctgtggcgcgttgccggcgcgactggttgcggacgaatcgcaagtctgctgcgaactcatcgaagccaagtgttttcggaccgtgtccatacgcaaagtaccatcgccgattatcccatatcccgtctacacagagtggcggttactcgtaggaggcatgggcgccattcgacgaagggcgatccggcatgttcgataatccgactttggcgaaaatcggcgaaacccatggcaagtcggtcgcctaggtgattctgcgctggctggtgcagcggaacatcgtggcgttgcccaagtccacgcatcgggaacgaatggaacagaacatcgatgtattcggcttcacgctgagtgatgaggagatggcggccgtcaccgcgctggataccaagaccagcctgttcttccgccatgataccccggaggccgtcgatatgttcgttggtttcatcaaggaacgcgcgggacgggaatgacgctgacatactgagaaaaaggaagtcccgatgttgcccccgtaggtgctgcggcggcgattttccttggtttttccgcgcttttcgagtacggggtggtgggttggctgttttcggcgggcggctattgattggtgggcggcaggccggcgatcaaatgatcacgccatcgcagtggtcgatctcgtgttggatgatctgcgcggtgaaaccggtgaacgctgcgtggcgctcgcggaatttccgatccatataatccacttcgatgcgctggtatcggacggtgcggcgctcgccctggagcgagaggcaaccttccgccgtatcgaacgcgccgtcttcggcggtgatgtgtggattgaacatcacgaaaatgcggccgccgaaatcctcatccacaaaagcgatgatgcgcttgggaacgccgatcatattggccgccatgcccacgcaaccattgcgatgcgcgtccaacgtgtctttcaggtcctgtgccacggccagatcctcttcggtgttctcggctgcggcggacggctggctcaaaaatgggatggacgtcatgatctcacgctgcatgtgattcctctcgttggatgttgccggtctgccaatattgtagcgtcgcatggctgcgagacggacggctgggcgaacctgtccatttcctgaccgttcgcgtcggcttcgggatgtgaggtgcaacgtgtgcggcttggactggtgcaatatgcttggggtcatggaagatatgttgcaataccgcgaatatatggcgcaggctcttgaactggcccgcaagggtgcgggatgggtggacccgaatccgctggtaggcgtggtggtggtacgtgatggcgaggttctcgccaccggataccatgaccggtatcgtggcccgcatgcggagcgtatggcgttcgactatgccgacgcgcacggcatcgatctgactggcgccacggtcatcgacacgcttgaaccctgctgccatgtcggatcgcagccggcgtgcactgacttgattctggcgcacggcatcgcacgcgtggtggtcggatcggttgacccgaacccgattgtggcgggcaaaggccttcgcatccttgaggaagcgggcgtcgaagtggttcgcgacgtgatgcgggaggaatgcgacgccatcaatcgccatttcttccactacatcaccacgggaaagccgtacattgtggacggcagaaggcgtgcgggtgaatcggactctgagtatgcggtccgtcggcgcgaactatatgccacatatgcggcggtgcttgccggaactgaatcggacgttcctgacgagtctttcgcgcatttcaacggaccggtccaagccgtcggcgcagacgaagtggtgattggcggccacaggccgttactcctggaggccggcgcgctcgcctgcacggatccagacgaatggctgcgtgagctgggcaagcgcaaaatcgacagcctcatcgtggaaagcgacgaagcattcgagcggttgtccatggcttgccaaaaagactgaagcgccattcgtgcgttgttggccgtgtatctcgcttatagatggcggattcgtctgcttgtccagtgctatctcgcttataggtggcggatgaattttgcgaagaggccttagagggcgtaaatcataccctctaagaccttaatgacgtagaggcgccgccatctataagcgaaatagcatcgggcggctttccgattccgccatctataagcgagatacgtgagactgatatgtccagcacccagcaagcatagtggcgagcacatggtcgggcatggcgcgcatggcctcaggggactcaagctcactcggatcgcaatccagcagcactaggtctgccgcatctccagcttgcaacgtcgtacgccccagggcggtggacgaagcgagagcggtttcgaaatccagacattgctcagactggaaaggctctcgatcggaactctccgtgccgaacaccgctgcggaaatggccagccacggatccaacggcgcgaccggcgcgtccgatcccataagcagtttgattccagcccgatgcagactgttgaacgcgtagggaattccggcgggattgccccaaaatcgtgtgatgacgtcacggtcgtccatggcgtgctgtggctggatgctcgcggcaagtcccaattgcgcaagacgtggaatgtcgcgttccttgagcatttgggcatgctcgatggagccgtgcgcgtgggtacgttccgcgcagtcgagcacgatggtgttcgcttcgtcgccgatggcatggcaggcgatgtcgaagccatgctcggtggcgagccgcatatacgattcgatttgctcgggggtgtagctcagtgtgccgtaggtttccggcgtaatgcccgaatacggtgtggagcagtaggcggatcgggtgttgagcgagccgtcggaaatcatcttcatcgcaccgacatggcccaagccatggcttccgggaagttcgtcgccggtatgccagccgtcgtcgatggcttgctgaagtcgttcggggtaaacgccggcttcgatgcgcaatccgtcaagcccctgcttgaagcggtcaatccacgtgtcgatgttctcggccatctcatagtcgcgcacgccgaccacgcctttgccggcggcgtcctgttccgcgttgcgcagcaatcgcatcagctcgtcagccgcaccggggcctttgtccagcttgcagtaagcgtcgaaccattcaagctcgccgacgagtcccgactcgcctacatgcacgccgagcttacgagccgcggctgaattcacccagccgcaatgcatgtctgcgcttgacagcgccacgggctggtcgcccgacaccgcgtcgatcgcagccaatgtcggttgggcatcatcggcccacagggagtgtctgaaccgcatgccgaccacgtactggtccgggtcgagcgtgccggattcgcggcgttcctccaagtgctcgcgtagcaggctcattgcctcatcggcgctgcgggcatcaatcagatcaagccgccccagcgtgtacgaccactgcgtgaagtgcgtgtgacaatcccacaagccgggaatgatccacgtttttgaagccttggctaccgacttttccgaagaccgtacatccgcgatccgcccttgctcaatcgtgatgtcgacagactcatcggaccccacgaaacacacattctcaatcacatacggttcgcccatacatcctcgattcaacaaaatgacctcattgccagccatagtatccttgcaatgcttgcgattgccacgctcgtctcaatcggctatgcgcactttgaattcctccgctgggatacggttatccgcatcagaaaaagaagggcgcagttatccacttatccactgtttgccagaagccggtaggcagcgcggcgacatttcctctactttggcgctatggacaatggagcacaatattcggaaagcctcgcacggctgaggacaagaaccatcgaacaatgtctcgaagcgcagaggcgcaccggaaggcggctggtgttcgcgcttgataccgcactgagtttacaaggcatcgaactgcctcgctaccggcgcggagggcttttggctgatacgctgcacgcggtgattgaaagtaacggcgtgcgaacgatactgcaggggatttgttttgtgctttggtctggacctcagacgcatatgccgattcatcatggtcgattgcgatgcacggattccgtgaccacatgggccatgcatgccaatcggcttgaagatgaagaattggtggttttgggtgattcgatgatgcggcgtgatggacatatgaaaaaggccacactggaggagtttcggatatatgtcgatagcttgtccgatttgtccaactattcaggctccgacagattacgtgcggtgagaggagtgtcgaaaatgcgtagggctctcaggctgatgcgggagaatacagattcttcccaggaaacgagaagtcgaattgttctgttgcgttatggtttgccttgtccggaagtgaactatgccattcggctcaaaggctattctcatgtatttttcgcggacatggcttatccgaatttgaaaatcatcattgaatacgacggcaggcatcatgcctcgcgatggttggctgacagtaaacgtcgggaagcgttggaggatgaaggatggctgtatatccaggtgacggcggaaaatctcagggatgaggattctcaaagggaattggcggaacgtgtggcgcagaggatgtcattgcgtttgggggagcctgtgcggctatgtgggcgaatgacgattgctcagatagccgatggtcggaggaagggcaaccgtctgtgaggcttgggcaagcccatatctcgcttatgaatggcggaatcgggctgcggcatgatgctatttcgcttatagatggcggatgaaatccacaaaaaggccttaagaggtatgaatattaccccctagggccttagcgattcaagaagactgccatctataagcgagatagcatcggtcgggtgaagaaatccgccatccataagcgagatggcggatttctgcggctcactgcacggcggcgagggcttggtcgaggtcggcgatgatgtcggccgcgttttcgatgccgcagctcaggcgcaccaggtcgatgccgacgccggcctcctcaagctgctcctcggtgagctggcgatgcgtggtgccggccggatacagcgtgcagctgcgcgcatcggccacatgcgtggcgatggacaccatcttcagatggtcgaggaacgcggagaccttctcgcggccgcccggcacgccgaaggagatcacgccgcaggtgccgttcggcatgtacttctccgccagcgcatggtacttgtccgtttcgaggcccgggaagctcacccagctgacgcgcggatcggcgtcgagccacttggccacggccagtgcgttcgcgcagtggcgctccatgcgcacgccgagggattccagatgcatgcccatgatccacgaattgattggcgccggagtggagccgaagtcgcgcatgagctgcgcggtggccttggtgatgtatgcggccttgccgaattccttcgcgtaggtgacgccatggtaggagtcgtccggagtggtgagtccggggaatttctccgcatgagccatccagtcgaagttgccggaatccacgatcgcgccgcccacgcaggatccgtggccgtccatgtacttggtggtggcgtgcgtgacgatgtccacgccgtactggaacggacggcagttgatcggcgttgggaaggtgttgtcgacgatcagtggcacgccgtgacgatgcgctgcgttcgcgaacttctcgaagtcgagcacgataagcgccggattggagatggactcgccgaacacggccttggtgttcggctggaacgcggcctcaagttcctcttcggtgcagtccgggctgacgaaggtgcattcgacgcccatcttgcgcatggtcacgttgatgaggttgaacgtgccgccgtagatggcggaggaggcgacgatgtggtctccgttgttgcagatgttgaacagcgcgaagaagttcgccgcctggccggacgaggtgagcatcgcggccgcgccgccttccagctcgcagatcttcgcggcgacggtgtcgttggtcggattctgcaggcgggtgtagaagtagccggattcggacaggtcgaacagtcggctcatctgttcgctcgactggtatttgaaggtcgtggcctggatgattgggggagtgcgggattctccattgcccggctgatagcctccctgcacgcagatggtgtcgacgttttcgctcatatgttccttctttcgattccgcgcttccgtgtgccgcgcaggtgttgcgccgcgatgcgaacaaacaaacaaacacactgtatcactgcattgataaatggcttgattccaatggaaacgccgtatagtttaacgaattgacaaacttaggtaattcaatttattatgtagaccaagacgggcggaaagcccgctgcgaaataaagctttacgtaagtaaaccaagcaaaggagcattccatgggtctgtgggatatcgataagattccgtacgtcggtcgcgaaaaggggccgcaggagggtcttgctttccattactacgacgccgacaaggttgttgccggcaagaagatgaaggactggctgcgcttcggcgtcgcatggtggcacaccttcgaccaggagctggtcgacccgttcggcaccggcaccgcccagcgtccgtggtacggcaagtattccgatccggaggacgaggccctggccaaggtcgactacgccttcgagttcttccagaagctcggcgtcgagtacttctgcttccatgatcgcgacatcgctccggaaggcgacaccctgcgcgagaccgacaagaacctggacaaggtcgtcgacaagatcgaagagaacatgaagtccaccggcatcaagctgctgtggaacacctcctccctgttcaccaacccgcgcttcgtctccggcgcctccacctccccgttcgccgacatctacgcgtacgccggcggccagctgaagcactccctggagatcgccaagcgccttggtgccgagaactacgtgttctggggcggccgtgaaggctacgagaacctgtggaacacccagatgaagcgcgagcaggagcacatggccaagttcttccacatgtgccatgactatgcgaaggaaatcggtctggacgcccagttcctgatcgagccgaaggccaaggaaccgacgatgttccagtacgacttcgatgccgcaaccgccatcaacttcctgcgcacctatgatctgatggacgtcttcaagctgaacctggaaggcaaccacgccaacctggccggccacacctaccagcacgagatccgcaccgcccgcgaggccggcgtgctcggctccctggacgccaaccagggcgacaagctcatcggctgggatatggatgagttcccgaccgacctgtacgagacctccaccgtcatgtgggaagtcctcgccgaaggccagatcggccctcacggtggtctgaacttcgacgccaagccgcgtcgtacctccttcaccgccgaggatctgttccgttcccacatcgccggcatggattccttcgcagcaggcctcctggtcgccgccaagatgcacgaggacaaggtcatcgagaacctgcaggccgagcgctacagctccttcgattccggcatcggcgcaaccgttgagaacggcaccgcctccctggcttccctcgaggagtacgctctggacattccgcaggccaagctcatcgaagccaccaagtccgatcacctcgagtccgtcaaggccacgatcaacaactacatgatcgacgccctggccgaggcgtgagccgaaaacccaccagggttttaggtagcctcgggcgaagtccgagacggtagtcgagggcgagcaatgactgggcgcgtagcgttccggaattgcaggaccgaggcgtgagccgaataaggagtttccgttaggactcctgattcatcgctggatcaaacagtggggctcgactgcgacagagccggatgtggtgtgccgaagcgtcggtgttccggcacaccactcatctttccttcctccttccttaaatttccttcgcacgcaagtcgtttgccggctagatcgccggtgagcggcttgtttgcgttgttagaccaagcgaaaatttcgattattcgcaatgatgtgatgtatccaaacgttcccgaatgaggcgtacttatgaccacaacgattaccatcgccaatcccattcttcacggaatgcatcctgatccgagttggatttgggatgatgatcttcggcaaatcgtgcttgtgacctccaccttcgaactggttccaggcttgcctatttacgtttccagggatatggcccactggaaacacgtgtcggatgccatagatgaggagttggcaagacgtttgctcattcctttcgtggatgactcgggtggcgtctatgcgccgacgctgcgtaggattcgtggcaaatacgtgattgcctgcaccatcgctcgcatcaatggacgcaaagccatcgcggaaggatgctcccaggccgaattggatgcggcccaggcggcggaaggcaacttcgttcttgagtcggactcgatcgacggaccttggcgtgggccgttctggatcgagggcgccgaaggcatcgatccagacatattcgaggatgaggacggcaatgtgtactggacccaaacccgccctgcggtcaacccgcaatgggagggacaaactgaggtctggactcgacgcatcaatccgaagacctggacctttgtcaatgatgggcgtccggcgggaacgggcaagacggtactctggcgtggatacggtgtggaggcggtatgggctgaagcgccgcatctctatcgcgtgggcgactatgtgtatttgatgaccgctgagggcggcaccagtttcgaacacagtgagatggccatgcgcatatatgcgccgcatggtctgcttcaggcgtttgacgtatacgagcgggaagcgtctgaagcgggggaacgtattccgcagatccgtgacggggagcgctgctatctgggcgttgcggttcgtgccttccatgcggataagaagaatccgattctcacccatcggcatctgggcctatcggaatcgttgcaatgcgtggggcatgcggatttgatgtttcatccggagctgggctggtggatggtgtgtcttggtgtgcgggagacgcggggaaagaacgacggtgagttgttgagctatctggggagggagagcttcgtcacccctgtctcttgggagcataatccagccgattggaagttggatggtgccggtgcgtcatccattcatgagggtgatcccggatggccggtaacttgtgctggacttggtcggctggccgacgagattacggttaccgtcaatgatgaaggtggcattgccattgagcctaggattaagtcctcgttctcaggcgatatggaacctgttctggtgaatgtggcggatgattcgacgaatggtatggtggtgcgcgacgaacgcgatatcagctaccgcatgatagcgaaattgccgacgctcatgccgatccccatgaccggttctttggtggtccggcagaattccacgcattacgcggtgttttcgatgcgtggcgcggatgtgctctacgagacggtgaatggagatgattcgcaagccggttccgttgccgccctgcgggctgatggcacacgtccggcggtgcttttcgatgacaaccacttgttggtcatcgtggctgaagggcttgatccggctgattcctcggctttcgtgagccgagggcaggtactgctcagtattgacgctcgtttccttagcaccgaatgggccggtggattcgtcggttgcatggctggtttcatggcatagaatctgaggagtttgaaaggatggttcgttactggtacttcggaggaccatccttggggcgggtcggaaccggaaggctaggggcgtgtggcgtttcttcctccggttgcacatgcgcggtttgtcttgctggtcacccttcaagttgctgtgtgctgttgcgcatcaccagggatgttgacatgatgatgtgcggttgaagcacgtcatcggtggacagtgcttcgaccagcatgcgtacggcggctcttgccatatcttgaagtggctgtcgcacggtagtcagggccgggccaaggaacgcggcggtctgcacgtcgtcgaatccgaccacggatagatcctccggaatacgtaaccccaattgccttgccgcctcgtagacgcccatggcctgcagatcgctgcccgcgaagattgcggttggacgattcggcctttccagaagtgagatggcctgcgcgtaaccgccggaagtgctgaaatcgccttcggtgatgagttcggggtcggcttcgattccatgttctgcaagcgctgacgtgtatccgtccagccgtgccttggagcacatcatctcctccggtccggtgatgatgcctatgttggtatgtccgagtgcgagcaggtgccgggtggcgatcacgcctccggtccagttgtccgcttgcactgacagcgtgtctgggtctgggttgccgaatgggtcgaacaagacgaaggggatgcctctggaatgcagcttgtctcgttcgatgcgtgtcaggttcgagaagacgaggatggcgccatccgcctgtctgcgcagcatgttgtctatccaagacgaatccgggtgctgccggttgcctccttcggtggtgatgacgcttagatcatgcagtttggcttcgcggatggcgccacgtaacacttcgagagcccagacgttgtcgaaatcctggaacacgatttcaatgattcgttggcttttcgcgctggtcgctttacgggagtatccatatcgtttcaacaccgcgttgatggattgtcgagtcgcttcggaaacgtcggccctgccgttgagtgctttggacacggtggagagcgaatagccggtttccttggcgatatcggacaatcgcaccgaggttttctttgtcgtattgcgcatgaggcaccccttctttattcttatcatatccgaaaatgcaaacgaaagtttcgttttgtgattttcgaaagtttcgacatgtcgataatgctttaaagcgttgaaatctcaatggaaataattagttctatgattttactaaaaacttgactttgtatgaattgtttagataacctatggttacaacgaaaacgaaatggaaactttcgaaaagggatcaacggttgattccttcatcggacatggaacacaaggcagtatccgctacagccgcgtttccccgatacgatccactcgaaggagtccttccgtcgttgccatcattttgtcgatgatgatttggtcaataaggagaagacaatgaagttcaaaaccattgcagctgccactcttgcggtggcgaccatgttgggcatgggtgcctgcggctccagcactggtgccaaagacgataagaccattacgttctggcataacgcaacagctggtgacggcaagcagtattgggaggatatggccaaagcgttcgagaagaagactggtgtcaaggttcagattcaggccatccaaaacgaggatttcgaaggcaagctgaccaccgctatgcaggatcccgcctccggcccggatgtgtacatgacccttggtggagccaagaccaaggacatgattgacgccggacagaccatggacctcactgataagatcagtgacaccgtcaagaagcagatgtcttctgcgctggagtccatgtcctatgacggcaaggtctatggtgttccagtcactgtgcagcctggtggcatctggtattccaaggatctgttcaagcaggctggcatcgatgccgcgccgaccaccttcagcgagctgaagaccgatgtgcagaagcttcgcagcgctggcatcgatccgatcgcactcggcggcaaggatgcttggccggtcggtcactggtactactggttgtccatgcgcgaatgctctccgaaggcctacgccaagggcgtcaatgacaaggacttctccgactcctgctggaccaaggccggagatgatctgaaggatttgttggatgcgaatgcttttaacgaaggattcctcaccacgacggcccagcagggcgccagctcgtccgcaggtctgctggccaatcataaggctgcgatggagctcatgggcacatgggagcctggagttctcaaggacctgactccggacaagaagccaatggctgaccttggcttcttcgccttcccgaccgtggacggaggaaaaggcgaggaaggtgctttgatgggcgctgtgaccggtttcgctgtcaatcccgaggctccggacgctgctgttgatttcgtcaatttcatggctgagaaatcaaatcaggagaaatacgccactgcgttcagcaccattccggcttccgacgaagcttacgatgcggttaccgatgaaaatcttaaagccatcatcgaagctatgaaaaagtccgatggcatgcagctgtggatggataccgctctcggcggaaatattggcaacgctcttaattccggagtggtgaatctgctttccggacaggggacttcggctgacatcgtcaaggcgatgaaggacgcagcggccaagggctgacagtgaacatggctggttgaaggccaaaggagggtggatagacagattttcatctgccctccttcctattcgagaaacgtatctggtagtggagaaaaccatgtcaagtacaagcaaagacgcggtgacgctgcgcgctaagcggtccaagaaaccgtccgatggcaaaatgcgtcgtaatgttgagattttcgtactgtccgcacctgcgattcttctgttcgtctgctttgtgattctgcctatcgtcttgggtgcttattacggcttctatcagtggaagggctacggacttccctccaagacaggtaaattcgttggtctccagaactacatcacagcgcttaaggatcccgcgttccaggcggcaattctgcataccttcgaggtcgtgatcggctcgttggtcatccaggctccgctcgccatcctgttcgcattgctgctgaaccagaagttcaaggggcgtggtctcatccgcaccctcatcttcgtgccgtatgtcgtttccgaggtcatcgtcggcacaggatggagcctgttgctacagaagaagggcgccatcaatgagattctggccaacttcggcatcaatggtcccgattggctggccgacccgaagatcgctatttggacgctgctgttgctgatcagctggaaatacgtcggtttcgccgtaattctgatgctcgccggcatgcaatccattcccgaggaactgtatgaagcagccaaggtggatggggcgagtttctggcagatgcagaaaagcatcacgttgccgttgcttgctccgacgttgcggatctgggtgttcctttccatgattggctctctgcagcttttcgatctggtctatatcgtgtggggcaagtatgtgtcgaccaccgctggtgtgtccaccatggccacctacatggtgcgtgaaggtcgtggagccggcaactatggctatggttccgccgttgctctgatcatcttcgtgatctctttgatcatcgcactcgtctatcagaagttcgtgctgaaccgtgacttggacggtgctgttactgaacagaaagaagccgagaagcgtgccaggaagcgcgcaaaagaagtgcagcatcgtgaggttgctgccctggcaagtgaggtgaagtgatgactgccgcaacaatcgcaggacattccaacaaaagcgagtacagcaagaagaatggttaccgtaagtcgtccaagacgccatggggcaacccaatcgtctacttcttctccctggtgcttgtggccatctgcatcactccggtgctgtacattatcttcggcggtttccgtaccaattcgcagatcaccaaccatccgtccgggatgccgaacccatgggtccccgacaactacaagacggtcttcgaaagtgatattttctggacggaactgaagaattctaccatcgtgggtatcgccaccatggtaggcgtcgtggtgcttagcatcatggtgagctttgtcatcgcccgatacaaattccgctatgcgccgcttatgtacgcgttgttctctgctggtctcatgttcccgatgaccgttggcattacacctttgtatctgctgattcgcaatctgggtctggccaactccctgtggggtctgatccttccgcaaattgccttcggacttcctcagaccatcatcatcttggtgccgttcctacagtcgattcctaatgagcttgaggaggcctgtcttctcgatggatgctcccgccttggcttcttctggcgcatggtcattccgctgtccatgcctggcgtggccaccactggaatcctcaccttcgtgggaagctggaatgcctacatgctgccgctgttcgtgctcagtgatgccaacaagtacacattgccacttggcgtacagatgttcagctctgaacactccgttgacaccgcacaggtgttggccttcacctctctggctatgattccggccctgatctgtttcaccatcttccagaagaagatcgtcggcggcctgacaggtgcggtcaagggctgacggaatgtgacaacccacgcccggaagatgttcctttccgtcttccgggcttcatctcttatgcaagaggtacattatgaagatttccaacccggtgctcaccggttttcatgccgatccttcaatgattcgcgtcggtgacacttattacattgccaattccactttcgaatggttcccaggcgttcgcctgcatgagtccaaggacctggtgcattggaacattcttccaagcccgttgagccggtccagccagcttgatatgagaggaaacccctcttcgggaggcatctgggctcctgacctaagctatgcggatggcaggttctggctgatctacactgatgtcaaggtggtcaatggtgcattcaaggattgcactaattatttggtcaccgccgaggacatccacgggccatggagcgagccggttcgtatcaacggggtcggttttgacgccagcctgttccatgacgacgacggccgcaaatacttggtgcagcagacatgggatttccgtgaataccaccaccagttcgacggtatcacattgacggaattcgacgtcgacaccatgaagctcaagccagaaacggcccgcaccatctgggatggcacctcggtgaagatcaccgaaggtccccacctatacaagaaggatggttggtactacctgtttgccgcagaaggcggcacggtgtatgagcatcaggaatctgtggcgcgttcccgtacccttgacgaatgctccttcgaagttatgccgaatggcccgttcatcggtaacttcgacactcctgacacctatttgcagaagcagggccatggagcgttggtggagaccccgtccggcgagtggtattacgcctccctatgcggtcgtccgtggcgtcatgataccgaaccggcccatggcacccgcggatggtgcacactcggacgcgagacctccatccagaaagtcgaatgggatgaggacggttggccgcgcgtggttggaggtcacggcggacagcgttacgttgatgctccgaaagatgccatcgagactttggccccaacaacgcgtgacgaacatgatgagttcgattccggcgagctcgggccaaattggaacactctacgcgtcccgtttaccgacgccatgggcacggtgggcggtggcaaactggcattgcgtggtcagggctcgctgtgcaacctgtttgacttgtctcttgtggctcgtcgctggcaggcatttgatttcgacgccgaaaccaaggtgcgtttcgatccgaagaattacatgcagatggcaggcctgaccaactattacgatgacctatgctggtcatgggcgtttgtcacttgggatgagaaacgacatgcaagggtcatcgaagtggctcagaacgatttcaaccaatatacgtcgttcctcaaggatgacgccatcgtagtgcccgaagaagctgaggcggtatggctgcgcaccaaggtccgcacggaatactattcctacgaatattcctttgacggagaacatttcaccgagattccggtcaagctcgatgcgaagatcctgtccgacgattacgtgaaccaacgttacggcggcttcttcaccggcgcgttcgtgggtctcgcctgtgttgatctgtctggctatgacgcgaaagccgaattcgactatttcgattatcgggagcttcccgacaaccggtagtcgatgccgacgggcggcgattcgccgcattcctgccgcccgtcggttatttggtgaaatgaacgcagactcaatggggagaatgctgagatgactttgcgattgccgaaactacttgacgacggctgcgtgctgcaagccggtgtggacatgcatatttggggcaccggcgatcccggacgcatcgtattgacacggcttgctgacgagcggcatatggtgcaggtgaaagacgacggaacttggaacgcgccgtatggtccgatcgaagctggagggccgtacgagctgaccatatgctacgaggacggagcggagcgtatctcacggcagtgctatgcgggagaggtgttcctgtgctccgggcagtcgaatatggaactgcctatggcttgggtgcgcgccgactatccacaggagtgggaccgtgatcccgatccattgctgcggcagtacaaagtgattcccgattacgatttcaaaggtcctcgcgacgatcacgaccgtgcgttctggcagggctgcgatgcggatacgcttgatgatttctcagcgctcgcatattttttcggtcgcaggatccgccagtggctcggtgtgcccgttggtctgttgaacatttcattgggcggctctccgatcgaatcctggatggacattgacacattacgagcgttccccgaagcgctcgccagtcttgaaccgtaccttggcgatggtgtggcgtcgaaaagaagcttcgattccgttgccgagcgggaccggtggtaccaggcgcttggatacgaggccgtggccgatgcccaccatgaatggctgccattgatcgcgtgggactgtccggaatccaagaacatcgagccgcgcgacgtggcatggcatgacatacgcctgcctggatggtacaaggatcgcggacttgccggtttccgcggcgagattaccatgagaaaaaccgtgttcctgcctccgtcggatgcggggaagcccgccctactgcgtctgggcaccatgaatgatgccgaccatacgtgggtcaacggtgtgttggtcggtgggcgaagcaatgtgtatgagccgcgggactatccggtcgcagccggcgtgctgcgcgccggcgcgaacgaaatccgcatgcgtctggtcgttgaacggcccggcggccgtgtgacgcccggcaaacggatgacactgaccatcggagacgatgtcttcgacctgtccggcatttggcagtatgccgtgaccgccgaagccgaccgcgattgcccattcgaggatttcgtcagatggaagccgaccggcctgtacaacgccatgctcgccccgtgttttccatatgcggtgcgggccgtgctgtggtatcagggcgaatcgaataccggcgactacgccatgcgttatggcgatgagctgaaagccatgattgaattgtggcgtggcaagtggcatcagccggatatgccgttcctgatcgtccagcttccgaaattcggcatcgacgccatcgaggatggtggttggccgcttattcgagaacaggaatggagagtggcggacgaacttgaacacgtggctgcggtggtgacgcttgatgccggtgaaagcaatgatttgcatcctcatgataagaaaaccatcgcggatcgtgcattcaatgtcgcgatggatcttgtgtatggccagcaggctcagcctcagccggttgttgaaaccgcagaggcggacgatggattgttgaggatgcactgcgtgtggcggaattccatgggcgaacagatgcaatcgcagaatcgccatctgatgacgttggatggtgacgttccgcgagaaattgatttcctgtggcacgactgcgccacttcggtgcgggctgaggcatggctggatggttgcgatattgtggcgcgcataccgtcgcgcatgccggacgaggtgcggtatgcgtggagcaacagcccggaatccggtctcatctgcgacggggacggtgttctgcttccgccgtttcatctgccgttgcccatggttgattaggagcagtcatgcgcagacaagtcatgattcgtcaaggatgtgtcgacggattctccgatgcggatcctgtgatcaccgtgtttcggggcattccatatgccaagccgcctgttgatgagttacgctggcgtgagccacaacctgctgaagcgtgggatggcgtgctcgaagccggtgatttcgcgccgatgccgatgcagccgctgcccggctcggatgagttctacggcagggaatggcagattgacgctgacactccgatggctgaggattgtctgtatctgaatatctgaacgccggccttacgtggatgcggcagtggttccgagattcgtacggattcccgttgcgatggtcatgggctgcctgtgatggtatggctttacggtggagcgtttcagactggatctacctgtgagaaggagttcaatggagagcagctggcccgtcagggcgtggtggtggtctccattgcttatcggttgaatgtgtttggttttttcgcgcatgccatgttggaaaaggaagcggttgatggacggccttgtgcgaatttcggatttcttgaccagcggatgggcattcagtgggtaaaggacaatattgccttgtttggtggcgatcctgcgaacattaccgtgttcggccagtccgcaggggccgcaagcgcgttggcgcaaagcgcctcgccgatgaacgatggtctgttccaacgcgtcatcatgcagtctggaggcggaactggtctgttcaatcgccatctgtggtctcttgaggatgcgcagcgaaatggagcgcgttttttgaagtatctggaagttgaatcgattgccgaagcgcgttctgttcctgcgactgatctgctggaggcggcggtgacttttcctgcttgcgattggtctgggcagggtgatgatgtcgtatgggctccgatgactaattggattccctgcgtcgatgggacattccttgtcgagcaataccgtgatgcgcttattgcgggacatcgcgttccgtgtgatttgttggtggggaacacgaccggcgagttcatggttccgggccctgatggcactccgtatccggagggtgagtgcggcaatctggatatgatcgatgcatgggtgtcaggcggcggctcggaaccatacaggtatcgattcgatgtggatatgccgggggatgatgccggtgcgtttcattcgtccgatttatggttttcgttcgggacgctccctgcgagctggcggccgtttcgaggctggcattacgatttgtcccatgcgatgaatcgatattgggtgaatttcgcggcgacaggtgatccgaacggttccggattgcctgagtggacggcatgcggacctgatggtcaacgatatatgctgttcggtggatgccacgatacgccgggtaacgtttcatgcgtcatggtcaagtaagtgaatatagtatggtgtgagcgttcactatagtgcggtggaatgtgatgaaggagacggatatgacgcaggagacggaagcgctgatcgcgtccgacgaggatctgaccaaactgttcgccggcaagccgacgcaatatcgcaaatcgaagtcgctgccgaaattcacaggcgaggccatgcgcgcctgcgcgaagatcaaccgcatcttcttcgatgatccggacgaggcgtaccgtttgtttcacgagctggtcccggacgcgggggagggcgtgcagttcacgccgccgttcaatgtcgactacggcatcggattgaccattggccgcggcacgttcctcaacaaggatttcatggtgtgcggcggcggatatgtgacgctcggtgaggattgtctgatcggtccgcgctgcaccatcgccacacccaaccatgccaaggacgctgccacccgcctggcgggctgggagcatgccagtgccgtgaccatcggtgataacgtgtggttcggcgccaatgtgacggtcacgccgggggtgaccatcgggtcgaattccatcatcggcgccgggtccgtggtgacacgtgacattccggagaacgtcatagccgtgggcaatccagcgcatgtgattcgtgagattcccgaacatgaccctgccttcgccgatgtggaaggtttgctgtagttttgcaaacgtttcatagggtgtgttgacggcaaatcgatttctccagccatgcgatgcaggtgagcgcgtaaagccttatacggaagctgtcgttcatattgtcgtttctatgagtatggttcatgaatcagcatagggccgggaagccccattgttgggaagcttcccggccctatgcctgaattcctgcggtgatggatcagccgcgggccttggcgtaggcttcgtatacggcttcggtcggttcgccggtctccacgccgtcgatggtgagttgccatgccggaggctcggtttcgccggacagcacccaggcggcctggcgggccgcgccgatggccacgtattcgtcggtggcgggtcgggtcacgtccatgcccagaatgcttggtgccagcgtgcggatagcttcggacttcgcgccgccgccgatgagcagaatgcgcgtgatgctagcgcccagggatcggatgagctccaggcagtcgcgctgggagcacagcagtccttcgacgaaggcgcgggccaggttctcgcgtgtggtgttggccagagtcatgccggagaaggtggcggtggcattcgggcggttcggcgtgcgttcgccgtcgaaatacggcaccagggtgatgccgccggctcccggcttcgaggcgaaggccagcttggccagttcgtcgtaatccacgccgagggcggcgcggccggcgtcgaggatgcgcgaaccgttgatggtgcaggccagcggcaggtagtgcccggtgcagtcggcgaagccggatacggcgccggtcaggtcgtaggttgggttctcggagatggctgcggccacgccggaggtgcccagggaaatggacacgtcgccgacggccatgcccagtcccagcgatgccatggcgttgtcgccgccgccgggggcgagcaggcagccgccttcgacgttcttgccggcgatggccggatcggccttgacgggggcggcgtcgcgcggccccagcacggtgggcagcacgatggcctcggcgtgcgattgcgcggcttcggcgccttccgcggcctcgagcaccatggcgatcaggtcgcggcggtattcgttcgacgcggcatcgtagtagatggtgccggaggcgtcggagcggtcggtgaacagggcttcaagatgggcgtcctcgccttcggtgaccgggccgtaaccggcgatgcgccagctcagccagtcgtgaggtaggcagatggcggcgattttcttggcgttttcgggctcgttctcggccacccatgccaccttggtcagcgtgtaggaggcgacgggggaggagcctacggccttgacccaacgctgcttgcctcgggcgattgggtcttccggctcgccgtcttgtgcgggcgctgcgccgagcttttcgatcagagccgcagcctggggcgccgaactggtgtcgttccacagcatcgcatcgcggatcacattgccttggttgtcgaggatcaccatgccgtgctgctggccgccgacggccagcgcggatacgtcgtccaggccgccggcctgctcggcggcctcttggaatgcgctccaccagtatgaggggtcgacggatgtgccgttcgggtgtttggcctgcccgaatcgtacaagctcgccggtttcggcgtccgtcacgcgtaccttgcaggactgcgtcgatgtgtcgacgcctgcaaccagagtccttgccatagtttgtgttgcctccttgcatgtgccgttcgccggtggcgcacggttaatagttagatgaataaactatactatagtagtgtagcatcaggaaaggctctggaacatcggttcggggaattcatgctgatgcggcaacacggcaaacagggcagggacgggaacggctatggcatctcttcgcaggatcaatcaggacgatctgcgcaatcacaatctttcggtggtgatcgacacgctactgcgtgcctccgggccgatgagccgagcggatcttgccaaggagaccgggctgaccaaggcgacgatgtcgttgctggtgtcgctgctgatcgatgcgggcgtcgtcaaggagggtgagccgcagaactcggccagctatgggcgcccgtccacgccgttgatgctgggaggcggcaaggtgtgcggcgtcggcatgcaggtcaacaccgacggctatggatgcatggctttggacatcaaccacgacatactcaggcacgaatgggtggatgccgacatgagcggcgtcgagccggacgtcgtattcggcaagcttgacgccatggccaaggcgatggctgaggatctggaatcgaaacgatgcatcatcgcgggcgtctcgtgtgcgctgccgggcttggtcacctccgacaagaggctgctcatggcccgcaatctcggttgggagaatgtcgatctgaccacgttcgacgttatgcgagggtatgacgttaccccgtgcaatgaggcgaagctggccgccatcgcgcagattccgggatatgcctgtgcgcgtgcggacgtgttcgatggcgtggattgcgccgactctttcctgtatctgtcgtgcgatatcggcatcggcggcgcgatcgtccgtgacggtgagatcgtgtcgggaagccacggtttcgccggtgagatcggtcacgtgtcggtgtctttggacggtccgctgtgcggatgcggacgacgcggatgtttggaaacgtatgctggccgtcgcgcgctggtcgaggcttccggagtggccgaaaagaatgcggcttcgagcggtgaggcactggagcgtctgttggacgcatggcattcccatgatgtgcggaccgtggaggccgtcggacgggccatcgacgcgctggcctcggccatcggctccgcactgaatctggccgatgtcgataccgtgctgctgggcggttggtggaccgatttcgggccgttcttctacgaaacgctcgaaaaccgtttggaatcgcaggtcttgggggcgtcggacatgcaggtgagcgtgtccatcccgttggtggccgaccatccggcgttgtacggtgccgcggaagtcggcttgcgcaaattcatcgacaatccgctgacgttcatcaccgacaaagcatgattcctgagcgccgccgcaacgtcactcgtgcgcattgacatattgcggattctccactttgcccgttccgccataccgtttgaagccccacagcagaatgagggatttcgcatacgccacccaggcgatgccgaagaggatggcgagaacgcgtatgagcggtacgaaatatgacaggccggccgcgagtacgtcgatgacgacgaggacgagcgagcaggggaaggctcgccaggggaacatcgccgatagcgagaagagcctgccggtggtgttggcgaagcgtgcctgcaacggtgcggcgtattcggcgaacagcgccacgaccacggcggcgatgaccagaagaatcagcggtatgtaggaggcgttggtatcccacgccttccagaacgacaggccgaagaggatggcggtggcgaggatggcgacgagcacccaggccgcaagtccctgtttgaactcgcgtttgaagcgggtgagatattccttgacgaggcggatgtcgtcatgctcgtcataggcgaacattgtggaatacaatgccgcgcgtgccgggccgatggtgacgtttgggatcagcgtgatgaggtagaccagattaagcccgacgaaacgcagcagggtgtccatgaaacgccagaagggcgcgttgatgttgaaccgcatgaatcctcctcgatgatgtgttcggctattgccgatagtactgtgccgtattgtgcgacacgccctatttataagattataaatagctctccaagagcacttagtttgttggaataacaatactttagcgccgatgcggcaagggttttgcggccactgccgtcgctgcaggaagccgctgaaatggacggcgccggcacgctgaccgtgttcacccgcatcatcctgccgatgtgcacgccgattctggcgaccgtgggcatcttctcggccgtgaaccagtggaactctttccaggacaccctgatctacatgaccgattcgaagctctactcgctgcagtacctgctgtacacctacatcaaccaggcgtccgcactggcgaatgcggccaaggcgaattcggcgaatgtcgccgctctggcaagcgccgcgacgccgacctcgatccgtatgacggtttccgtcatcgtggtgctgccgatcatgttcacctacccgttcttccagcgcttcttcgtcaagggcatgatgctgggcgcggttaaaggctgattaacaacacaacgattcttttccccataactgaatatcagaagaaggaatacaaggaggtttccgcatagaactgaagaaaatcaccacccgcgcgattgcggctggcgttgcggctgctacgctgctgtcgctcgcggcctgcggcagcggcagcaacagtgccgacaccaaggacgacggttccgaaatgaccgtcgaggtcttcgactcgctggccagcagccagggtctgcaaaagagcggctggttcgccaagatcgtcaaagacaagttcaacatcaagctgaacatcatcgcgccgaacgtgtccggcggcgataccgtgttcgatactcgctccgcttccggcaaccttggcgatctggtgattgtcggtaccggcaacgggcgtctgaacaagctggtcaaggccaagctcatcgaagacatgaccccgtactactccagcatgaagaatgtcaagaagtacgattccgcggtcaagtccatcgccaagcaggccggcaaggatggcgtgtggggtgttcctcagggtgtctcctcccagtctccgaccgacccgagcgaaggcaacgagtcggctgccgcaccgtacatccgctgggatatctacaaggagatcggctacccgcagatcaaggatctcgacggtctgctcaatgtgcttaagcagatgcaggacagggctcgccaggataccggcaaggacgacatctacgccatgtcactgttcaaggatcgggacggcgatgtgatgcagaacgccgcatccatctgcagctggttcggctacaccaaccagggttccgtgttcatctccgccgacggtaaggacgtgcagcccgccaccaaggagggcggcatctaccagcaggccctggagttcctgaacaaggccgaatccatggggctggtcgatcctgattccaccacccaggactgggataccatgcggaccaaggtcaccaacggcaagaccatgctgtccatctggagctggctgggcaagccgcgtatgaactccgacgagaacaaggccaaaggcgtcggcttcatgctggctccgcttgagaacatgaaggtctattccgacggcttccagcctgacggtgatggcgccaccatcgtggccatcggctccaaggccaagaacaaggcccgtctggccaagttcatcgactggatgtattctccggaaggcatctacgcctcttcctccaactccggtggcgccgcctgcccgaaggatctgggctgcttcaccaccgacaaggacggcaagaacccgaccctgaccaagttcggccagcaggccatgaccggcgaccacgccaacctgaaggtctccgccaagcttggcggctccagctacgatgacggctactctaagctgaacttcaaggccgtgtctcagaacgacatcgacccgaacaccggcgaggcctacaacccgctgctgtggaagtccaaccaggatgagaccgagctgttcaaggattggtccgcccacatggagaacgccaccaacgacatcgactatctgcagaaggcaggcaagctctccatcgcagccggtgcgtcctacaccactccacaggaggattccacggtttccgccacccgcagctccgtcaagtccgaaacggtgaacgcctcctggcaggccatcaccgctgcgggcaagttcgagaagacccttgacgaagcccgcaccaagatcgacaacctcggctacaaggaagtcctcaaggtcgaccagcagaacgccaaggacctgatccaggcccgcaaggacatcgtcaagcaggccaagtaattcctggcgttccggctggagcgttttcgcttcggccggaacgcctcgcctaatcacataaccaacaaggggcgtcggactcttcgaaccgggccgacgccccgcaactcttccggttccgcatattccgacggacgtcgtcgtctccttcttgcctgtcggaacttttccgctttttccatgtccactttcctccatgctttcgtgaggagcgcgttcgatgatgaatctccacaccgtcgaatcgcaatgaaacgaaagaaaaacgcatgaccgtaattactgaagccaacaaaaccaaagccagggaactgacggcgcaactcacgctggacgagaaaatcgccattgtgcacgccgcaggcctgttccgcaacggcaacgccgaacgactgggcattccgccgctcaggatggatgatggtccgatgggcgtgcgcgccgaactgcataacgacaattgggcgccgctgtacaacacccgtgactatgtgacctacctgccgtccggctcggcggtcgcctccacatggaaccccgacctggcccgcatgaccggtgaagtattgggggaggaagcccgaggccgaggcaaggacgtgattctcggcccttccatcaacatcaaacgcagtccgttgtgcggacgcaatttcgaatacatgagcgaggatccggtcctgaccgccgcgcaaggtgtggcctacatccaaggcgtgcaggaatccgacgtggccgcctgcgcgaaacattacgcggtcaacagccaggaaaccgaccgattggacgttgacgagaccgtaagcgagcgggcattacgcgaaatctacctgccggccttcgaagcggcggtacaagacggcggcgtgctctccgtcatgggcgcctacaatctcgtcaacggcaccaaatgctgcgaacacaagcagctgctcgacgacatcctgcgcgacgaatacggtttcgacggtttcgtcgtttccgactggagcgcggtgcgcgacaccaaagccagcgccgaagtcggcatggatatcgaactgtccgtcacgccgaatttcgacgattactacttcgccaacccgctgaagaaagccgtggaagacggcgacgtcaaggaaagcgacgtcgacgggaaagtcgaacgcgtgatcgccgtcatggacgcgctgcacatgctcggcgacgcgcacgcaagccgcaaaccaggccgttacgcgacgctcgaccacgcggcgaaggcattggacatcgcccgcgaatccatcgtgctgctgaaaaacgacgcgcacctgctgccgctcgacgaacgcaacatgacccgtctgctggtcatcggtgccaacgccgaccgcatccactccaacggcggcggctcggccgtcatcaaagcgctgcacgaagtatccccgctgctcggcctcaacggcgagctcggcggcaacgtcgaaatcgaatacgcgctcggctacgacgccaaacagatcaaccaggacgaaagctggcaggaggaaagccttgagaattccaagggttccgatgccaaagacgtgaatcgcgcgcgcgaactgcgtgacgaggccgtggcaaaagcccgcgcgtacgcggccgccggagatccggtggtcttcatcggcggactcgaccacgaacatgatctggaaggccgcgaccgcaccgacatgcgcctgccgtagggccaggacgagctcatcgaagcgctcaacaaggcgtggtgcgccaatttctggagccacaccatctacgattggggcgacgtggtgcccgcccgtcggctacggcgacggcatcagcgacgccaaatgcgtggtgtccgggctgcagatggactatcgccgcttccaaagccaggcgcagttggcctgctatacgaacgagcgtgacgcgatccgcgaatacgacgcgaccacgccgatcaccacgaacctcatgggcacgttcaaggatctcgactacttcgagtgggccaaggagatggacgtggtcagctgggacaactatccgggcatggacaccccgccgagcttcaccgccatgtgccacgacctgatgcgcggcatcggcggcaacaagccgttcatgctgatggagcagaccccgaaccagcagaactggttcccgttctgcaaggtcaagcagccggggggaagtgcgtaagctcagctggcaggccgtggcccatggcgccgacaccgtgcggttcttccagatgaagcagtcccttggcggctgcgagcgattccatggcgcggtcatcgcgcatgacggcaccgaggagtcccgcgtgttcaaggagaccgcggccttgggtgaggaactggaccgcatcggcaggcggatcatgggctcgcgcatcgaatcccgtgtagccatcatgttcgactggcagagctactggtcgcttgaaggctgtgtcggcccgaccaccggcttcaactatcccaatgaggttcatcgcttctaccgtgcgttgtggcgtcgcaatgtgccggtggatatgatcgccagcaccacgcctcttgcgcggctcagccagtatgatctggccatcgccccggcgctgatcaccgtgttgcctggtgtggctgaaacgttggaagcctatgtggcggatggtggcaccttcatcaccggctatatggccggcatccatgatgagcatgatctggtggtgccaggcggctacccgggcaagctgcgcaggcttatgggcgtatgggtcgaagagatcgatgcgcttgcgccgggcgaaaccatcgaagtgcatggcggcacggttgatgccaagggcgagatcgtggcgagcattattcatcgcgaaggtgccgagcgtcttgctacgtacggcggcgacgaattctatgctgggcattccgcgctcaccgtcaatgcgtatggcaagggcaaagcctattttgtgggcactccgttggacgagaccggcatgagcgcgttcatggctccgatcatcaaggagctggatctgaagtcgcttgataccccggaggatgtcagcctgtccgtgcgctatggcgatggcggcacccgctacgcgttcctcatcaacaacagcgccgccgacaagcgtctgtgcctcagcgaactcaacggtggcacggagctgctgaccggcaccgtcatcaacgatctgatcgagcttaagccgtatggcgtggatgtgattgcgttgcggtgatcgcaatgctgtagaccacgttagacggagcggaacgactccactcgacgaagccgaatatgaagaaggccgatgcccttgatggacatcggccttcttcgtcaggaaccggtggtatggcgccgttccgcgttcatcgggtggctgcgatcacaccgccggtcatcatcacgcctgcttcttcttcagcagaatcgcggcgcctgcaatcagtgccacagccgcggcgaccgccatgccgagcacggaggagccggtcgaaggggtggacgtgacaccggtcggtgttgtggatggcttcgtgtctgtggcaggctttgccggggtcgttggcgtcgtcggttcaacagcgtccttttcgaacacagcctggatggagacgctgccgtcaggcatctcgaaggcgttgttctcgatggagacgttgcccttcagcacgttccactctttgaagtggtagcccttgttcgcggtggccgtcagcgtgaccttgctgcccttggccgcgcgctcgacatccgcggaggcggagccgccttcggtcgcggagacgttcacggcgtactgcgtattgcgcacgcgccacagctgggtaccgtagaacgggttcgcggtgccgaccaccatgtagtcgtcggtgtcgcagaagatgcgcagaccgtggttgaacgggtcgccgaagccgttgtcggtaacggtgccgacggtcacgccctcattcgcggcggaacggtcggtgatctcgaacaggttgaagccgcgcttggacttggccaggtacggcagggacttggcgtaggccttgaggttggccttgctggtcagcttgaccagcatctcgtacaggcccttgaacttgtcgggaatgatgtcggcgatgctgaagaacgcgtccgtgacttcgccgtagttgttggcgaaatcggcggagcccttgtcggacagctgggagccgaggttgtccagctcgttgttgatgtcgaagagctgcgaggcctcatcggaggagccggaggctgccaggctgcccggaacgatgctgccgtccttgatgccgtcgaccagttccttggtctgggcggcggtcaggctgatcggcttggcggacgagacggacttggcgtcggtggtctgcggctgcgcggcggaggcgtccttgccggcctggatgcgggcccagtcgaccagcgcctccggattgtcggtggacggcatggtctgggtggtcaccttggcgttctgatcgttgctctgcgtggcgatggcggaagccgggtcggtcgggcccatgccccacagcaggcgcaggaacacgcgcaggtagtggacggtgttgttccaatccttctcgttcatgttgagaatgtcaccgttggtgaactgtgcgatcggttccagcaaggtggtggtgttcatggtggacaggtacatcttgccctcgtgaacggtggtctgccaggtgtattggttcatgtggttgtcgtagccgctgcccagaccggtggaaccgcccttcgggaaggtgtcgttcttgtcgcccacgagcatctcgacgttctcgttcttgtccatgcggtataggttgacggactgttcgaggttggtggcttgggttacgaagttgcttttggtgacgaagccctgcagtgcgctggacacgtcgttgtagtcgccgatgtacaagtggtcgccgtagacctgcagggtgcaggcgccggcgctcacacggcttttgtcaagaccgtagtagtacttggcgcccttggcggtgtcgcctacgagcggacgccaggtccaatcggccttgttggtggaatcgcccttgttctcgcccacgtaaatggcgaaggagcgcatggttccggtctcttcgttcagggtgctggtgtcgccggtgcagaccacgacgtacagcttgccgttgaactcctgcacctgatagataccgccgccgccgttgacatcctgtcggtggatggcgggcaggttgtcgaagctcgccatgtcggcgatcactttgtaggagttcggatcggacggggtcttggatgccacaagcagcgccttgcccttgccgtccgcggtcggcttgaggtcgccggcgatcagcgtattgccgaaggagccgatggcacgggtggaggtgaacacgttgcccttgaccagggaacggaagccatccacgtcgacgctgtcatacaccttggtgagcttgtcgttgttggccgggtcgacttcgtagatgcacgggaatccgttttgataggccatggcggtctggatctcctgctgggtgagatccttgttgttggtgtccatgaccatgccctcgaagtacagcttgccgttcatcttgaaggcgctgcggaaggtcgggatcacgcccttgcctccgtcgatgccggtgctcttggacatgaggatcttggtcttgccggtcttcacattgaacttgaacagcatgccgccggcgctcttgccgtcgggttcgccaaggtacatgttgcccgcgtacatggtctggatgagtgcggtggcctgcttggaggtcaggccgaggcttgtcatatcgcggttcagaatggcctgcacgccgaggccgccgtacatggtgccgatgtagacccagtcgccggaggatgctgccgcatagctgtaggactggccgcggtcgccgttgccggtggtgctcaggccggcggtatagggggcgatggtgccgtcgccggtgtaatcgaccacgccatcggcctggctcaggccctgatcggcgtggctgaccttttcgaaggtcatgccgttatcgttctgggaattgtaggtgtattggggagtcaggccggcggagtcgtccgccatggcggtggccgggattccggcgagagccgttgcgcaagcgacgattgcgccaaggcatgcgattgccttgtttctcatctatttctcctgtcttcgcgcgacgtggaaaacgtcattgatgggggcatctagggggctgcccgccgtaagcggcgggagtcataaaagcgtgtattgcaagagcctccaataggcaaccgtatcgataaatattgacaagttgttatggcatatgttgcacaatggcagacgaatatgctatgacgcacttcgattccgccattgcattggtggtacgcaaaggggtgttggctgagcgtatcgggggatggggcggaagcgcttaagtatgggcgggaacgctatactgtaccaaggcaggatttttattaaagatgggttagataacgatatgactgcaaagaagcgcatccttgcgttcgaaatcggaacgttcttcacccgatacgtggtgttcgaggacgggcgcatgggcattccgggtactatcgcgactccggtcgacggcgaggagcccttctaccaggcgctcgcgcatattgtttccaagcagcgtgcccctcttgacggcatcgccataagcgtgcccggcttcatcgacacggagaagcaggtcgccgttaccgccggcgcgctaagcatactgtacggccatgaaatcggcagaaaactgcagggctatcttgacgacccgatccccacatggatggagaacgacgccaactgcgcggcaatggcggagaagctgagcggcaacgccgtcaaactcgacgattttgcgctgatcaccatcgacagcggtgtgggcggtgcgttgttcctggacggcaggatccgccgaggcaaggattggcgtgcaggcgagctgggcatgatgatcccgaactatgagaccggtggattccacaccatgcaggattacctgtcgaccatcgtgctggcggaggagtacgccaaggaattcgacgtgccgacaggctccatcgtgccggccaccctgttccatcgtctcgatgagccgcgtgtgcgcaagatcgtggaccggtggatcgactatcttgccatcggcattttcaacatcgtcgccgtggccgaccccgaatgcgtgctgctgggcggtggcatctgccgtgaacagcaattgctgccgctggtcaatgcggcgctcgacaagatcccgcagtggagcgatttccacacggttgtcaagcgctgccggcacaccaacaacgccggtctgatcggagcctactacgccttcgaaaccgaggtcgaaggcatggagaaggtgccgatccgctagtcgcggatgcttccgatacgaaaatcggcgggtccgcttcccgtgaacggccccgccgatggcgaatatgcacaagagcggtgggcggtcgatatcgatcttccgctgtaatgctctgctgatcttcggggtcagagctactgccgtgccgacaaggtaagcggcagcaggcaggattcgttcttcgggtcgtgctccgaggggtcgcggaagccctgccattcgctatcggggaagatgatgtcggagatgctcatccattgctccagcagattcatcgaattgtcacccagccaacggtactgcagaccgtccatggcgctcatcgccagggtgtacaggtcgtagaaccgttcctcgtccacgtccggcggcagcagccagttcatcgagcaaatcatctcccattggcgcaaatggcggccgatgaagaaatcgtgggccgggtgcgaggggttcagcgcctcgccgttcagcaccgaatacagctgcacgagctcggggcgctgcagattgtacagcacgatgttcaggcaatagcgcgggtagtagtagacgcggtgcccgtcggcgtcgacgatggcggccgtcaccgcgttgtattcgtcggcatcgatggtgtcgtagcattccgacagcaccatgttgagcagatcgtccttcgaggagatgtaatggtacaacgccgcctcggtgatgcccagctcgtcggagatgttctgcaacgacatgccccagaaccccttggtggcgatgattttgacggcggcctgcaggatttgcaggtggcgttcctcctgactcatacgcttgcgtttgacgaaggtcttgtcgcccagcgtgtccctggcggtagtggcccccgtagcgttgccgatgcgtgaggcggccggccagttgctctggtcattcaggaatccatcccatgccgcgacgctcatagccagctccttacacccctgctcatcgtgtccctcataaaaccatccaatactattacgccctctggcctctaggcgaagagtcgccgtagccacgcgttggccaacaccggccattgctggacgcatggctcgatgccattaaccccctgccacgccgtttccgcagtgccaagcgccagaccatgcccgccttgggggaacagatgcgcctcgaccggcacgccggccttcttgcaggcatcgaccaacatcagcgtgttctcgaccggtacgcaatcgtcggtgatggtatgccatacgaatacgggcggcgtcttcgcgtcgatatgccgttcgatggacaccgcgtccaacgccacctgattatcgctgttgtcgccaagcagacagtcgaagctgccacgatgcgcgagcgggcctgaagtgatcaccgggtagccgagcatcaatgcgttcgggcgcaccgcgtcagggtcatagccatgtgcccgcatggtgtcgtcacccgccgtggtcgcaagattggccgcaagatgaccgcctgcggaaaatccgattaccgcgatcttactggggtcgcaatgccagtcgtccgcatgcgcgcgtatgcgctgcactgcttccgcggcttccagcaaagccgtggggaagacggatggcgcgacggaatagcgcagcacaaacgcgttgcatccggccgcgaggaactgcatggcgatcggttcggcctcgcggtcggaggtcatggcatagccgccgcccggaatcaccagaacgctggggcgttgacgtttgggatcgatctcctcgctgttgtcgagaacgtaccggacgaacgtggcctcactgccatcgatgccggtgatgatgtcttcacaatactgcatatcgctaccttagacggattgtgtgtgcgaatccatgcggccttctatgcggcacacggattcgcactgttctgatcggttcctgccttccacaaggttgcaggaaaccgatggaggatcgccggaacaacctatatgcaagatgctccggcaatccatgttcatgttgaggagagtgtaggcccgccccgtttgtgagcacgttctgatgctcacatcagaacgtgacctcgacatcgacggatttggcatcgctcaaagcgggaaccacattaccgccaatcttcgctccgtcgacgctcaccgtgcgctcgccggtgcgcttcatggcgatgcggtaggtcacgccgcggaacacgcgcgtcacggtcagctggtcgaaccgttccggcagatgcggttcgatggccaggccgtcgagcgtcggtcgcacgcccagcagatactgcgacacgtccacgaacgtccacgcggcggtgccggtcagccaggagttcttgccctcgcccggggtcgctgcctcgggaccggccaccatctggcagtagacgtacggttccaccttgcgcacgtcggacttgtcctcgacatacgccgggcagttgcgctggtagacggcgaatgcctcgtcgtcattgccggcgatggcgttggcgatggagatccacgggttgttgtggcagaagatgccgccgttttccttgtatccgcgcggataggaggagatttcgcccaattcgatgcggtaggtggagtaggcgggtgcgaggatggcggtgccccaatcgcaggtcaggcgttccttgacggacttcagcgcctgctgcgccttgccgtcatcgaggccgatgccggccatcacgcacatgccctgcggttcgatgtagatctggccttcggtgtcctcatgcgtgccgaccttgcgcgagtaggcgtcgtaggcgcgcacgaaccattcgccgtcccagccggcggttttgacggccttggaaacctggccgatttcggcgcgcacgctggccgcctcggacgcgatttcggcgtcggacatgccggccagacgtccataatgctcgaggatgtcggcatattggctgccgtacagcacgaacatgccgccgatgaacacggattcggcgacgccggtgtcgttgttctccacggtctggaagctttcgcccggagtatcggagaaacagttgaggttcagacaatcattccagtcggcgcggccgatgagcggaatgccatgggggcccttatgcgtaatggtgaagttcactgaacggcgcaagtgctcaagtagcggctgttcggagccctcgacgttgttgaacggcaccggttcggtcagaatgctcacgtcgccggtttcggcgagatacgcgtacacgccggccacgagccacagcggatcatcattgaagccgccaccgatgtccgcattgcccttcttggtgagcggctggtactggtgccatgcggaaccgtcctccatttgggtggaggcgatgtcgatgatgcgctcgcgtgcgcgttccggaatgagatgcacgaagccaagcaggtcctggttggaatcgcggaagcccatgccgcgtcccatgcccgactcgtagtaggaggcggaacgggacatattgaacgtgaccatgcactggtactggtgccagatgttgaccatacggtcgagcttttcgtcgccggaatcgacgctgtaggtggtcagcagttcggaccagtaggagttgagctccttcaaggcggcttcgacctgttcgacggtggcgaaacggcggaacagctcatgggccggcttcttgtttatgatgccgaccttggccggatcgttcggatcctcccatttctggtccttggccacttcgatatagcccagcatgaacacgagcgatgcggtttcgcccggctggagttccagacgcacgcggttggcggcgatcgggaaccagccgtacgccacggaatcgtgagccttgccttcggcgatgacctgcggggtgtcccagccgttgaactggccgaggaactcgtcgcggctggtgtcgaaaccgacgacgggcgcgttgacgccgtagaatgcgtaatggttgcggcgctccttgaattcggtcttgtggtacagcagcgtggcatcggttttgcgttcgatctccacctcgccggtggacaggttgcgctggaagttggacgagtcgtccacggcattccacaggcaccattccacggagccggtcacgtcgatgacggccggctcgtcggtggtgttcgtcacgtcgagccgattgatttccgcattggtgtgcagcggcacgaaggcggtgagcttggattcgatgcctcgcttggaagcttcgaacacggtgtagccgatgccttgacggcacttgtaggaatcaagcggggtcttgcatggaaggaaggtcggcgaccaggtttcgaccggcttggcatcggcggaatcggagtccatcaggctcaggtaatagcagcgggagccgttgtctgccggcacgttgttataccggtagcgggtgatgcggcgtagtttggcgtccttgtagaagctgtagccgccgccggtgttggaaatcagcgagaagaagtcctcgttgccaaggtagttgatccacggcaggggagtcgccggggtttcaatcacgtattcctttgcggcatcatcgaaatgaccgtagcgcatgggtgtcctttcgtcggtgaaatggctgtgacgaggtgtactgtatgggtatatcgtccattgatttaattaataggttagcatgttatttacaaacttataaataacgatttgctggcgtgttgccgtcggtcttccaatggtcatctgtcgacgctgccgcaatcgggcagaggttggggtatacttcctcccgttgccctcgtagctcagttggttagagcagcacccttataaggtgtttgtcctgggttcaagtcccagcgagggcacatgcggacctgccggaagcggcgggtcctttgcatatccgcggattgcagtccgtacgccctgcgtgcgacggcgcataccgtgtcccggccatcgcctacactccataaggttatccggttcacgccttgccatcggggcaatgcgacccgggtcccccgaatctctaggagacaaactatgaagcagggtatccatcctgattaccacgcagtgcaggtcacctgctcttgcggcaacaccttcgtcacccgttccacctacaacggcgatcacatgaccgtcgacgtgtgctccaactgccacccgttctacaccggcaagcagaagatcctcgacaccggtggccgcgtggctcgcttcgagaagcgttacggcaagaaggccaagtgagtcttattgcttaggcaatgaaaacgccagtccattcgtgggctggcgtttttcgttaccgacgtgccgtcgcccacctccgacgaccgcacttccgcgccaccttatatgatggacaggttgagtaaggttcagcgacgagtgattccgctgaagcgcagatacgaagaaaaggcgtacattggcagacgaacaattccccgcggccgtcaccgcgcttgaggaataccacaatatcgaacagcagatggccgagccggaggtcgcatccaatcccgacaagatgcgcaagctgggtcggcgccacgccgaactgggtgccatcgtctccgcctacaccgcatacaagcaggtgaaggacgatctggaggcggcccgcgagatggcgtccgaagatcccgatttcgccgaagaggccaagcggttggaaggcgagctgcccgcagccgaagagaagctgcgcaccgcgctgattccgcgtgaccccgatgacgcgcgtgacacgatcatggagatcaaggccggcaccggtggtgaggaagcggcgctgttcgccggcgacctgctgcgtatgtacatgcgatacgcggaaaagcgcggctggtcggtcaccgtgcaaagcgagaacaccaccgagctcggtggcgtcaaggacgtgcagctggccatccgcgccaaaggcactccggcgccggaggacggcgtgtgggcttccctcaagtacgaaggcggcgtgcaccgcgtgcagcgcatccccgtcaccgaatcgcagggacgtatccagacttccgccgccggcgtgatcgtcttcccggaagccgacgaggacgacgatgaaatcgaaatcgatccgaaagacctcaaaatcgacatcttcatgagctccggccccggcggacagtccgtgaacaccacgtattccgcggtccgcatgacgcacatccccaccggcatcaccgtgaacatgcaggacgagaagagccagatccaaaaccgcgcggcggcactgcgcgttctgaagagccgcctgctggccatgaaacacgagcaggaggccgccgaggccgccgatatgcgccattcccaggtgcgctcgctggaccgttcggaacgtatccgcacgtacaacttcccggaaaaccgcatcgtcgaccatcgcacgaactacaaggcgtacaacctcgacgccgtgcttgacggcgatctgcaggccgtgatcgacagcgacatccaggcggacgaagccgatcgtctcgccaaccagaagtaaggcgattgggtggcgacggtattcgaaacggtgcgttccgccgcggacgaactacgcgcggcgggcgtcgacactccgcagcacgacgccaaactgctgctcgccgaagcgttccatacggacctgcagcacgtggacaaagccatgctcatgggcgatggcgtcgaacgtctggccgaaaaagaagacgcggaaccggcgatggaacgtttccagaccatgctggcccgtcgtgtcaaacgcgagccgttgcagcacatcaccggccacgcgccgtttcgctaccttgatttgaaagtcggtccaggcgtgttcattccacgtccggaaaccgaactggtcgtgcaggaaggcgtcgactgggccaccagaaacggcatgtaccgcgccaaagtggtcgatctgtgcgccggcagcggtgcgatcggcctcgccttcgcttcggaagtgccgggcagcgaggtgtgggccgtcgagaaaagcgctacgaccgccgagtggacgcggcgcaacctcgacgagaccgcgaaacggtattccgcaatcgccggcaattatcatctggacatcgccgacgccacgcaaatgccgacgctaagccaacttgacggcaccatcgacatcgtgctcaccaatccgccgtacgtgccgcttgccgacattcccgaacagccggaagtgcgcgattatgatcccgatctggcgctatacggcggttcggcggatggcacgctcattccggaacgcatcatcgcacgcgcggcgaaactgcttcgtgcgggtggacttatggtgatggagcacgacatcacgcagggggagcggcttgccgccttcgcacgaacctgcggcttcgtcgacgttaccgtgcataacgactacaccggacggccacgttatctgacggcggaaaaacagccggcacagtaacttatattcttttgcgccatgctgacggggatataaccagaagttgagtctcactataagaacattttatgcaggccgccgtccgtcaggctataaagaacaatcggaatgcacagagagagaacgggcgtccgtcatgagtggtcgccgtggttccgcgcacggggtttgagatgaacatgattttttccaaggtgcgtgttgaaaggaatgtgcagcgttttcaagaaaagaggaagaacggaatgaacgcgaagttctccgccaagtgcgtcgccctgatcgcggcaggcgcaatgtcgatgtcccttgctgcctgctccggcggcagcatggacgattccagcagctccaacggtagcgcggccaacagcgataccatcacgctgggttccgtcaccaccaactccggcaccgccgccgcatacggcgaggccgaggtcgccggcttcaagctggctgtggatgagatcaacgccaagggcggcatcaacggcaagaaggtcaagctcgagtccatggacgacaagggcgacgccaccgaagcctccaacgccttcaacaagctcgccggcgacaacagcgtgctcggcgtggtcggcccgaccatctcctccaccaccgcggccgtggctccgctggccgaccagtccaagctgccggccatcgcaccggccgccacctccgactccatcgagaccggtggctacatgttccgcacctgcttcaaggactcctaccagggtgagatcgctgccaagttcgcagccgagaccctgaaagtcaagaaggtcgccgtgctgtacggcaccggcgatccgtactcctccggcgtgggcaaggccttcgccgctgccgccaagaaggccggccttgacgtcgtggccgaagagaactcctccagcgccgacgacaccgagtactcctcccagctgcagaagatccaggccgctggcgccgagttcctgtacgctccgtactactactccgtcgctggcccgtacatcatcccgcaggcccgctccgtcggctacaagggctatgtgatgggtcctgacggctacgacggcctgaagatgaccgacgacaagtcgctgtacaacaaggtgctctacaccacccactactctccggacgacacctccaacgccaaggtgcaggacttcatcaagtcctacaagaaggccaacaagaacgccgatccgaacaccttcaccgcactgggctatgactccgtgtacatgatgaagcaggccatcgagaaggccggcaagaacgccacccgcgaaggcgtgcgcaacgccatcgccggcatgagcttcgaaggcgtgaccggcaacttcacgctcgacaagaagggctccccgaagaagtccgtcgtcgtgcttgagctcaaggacggcaagccgcagtacaagaccaccattcagcctgccaagtgagcgtcgcttgcctgaaggcctgaatctgtgaagaggaggggaccgggaaaccggttctctccctttcgcgtatcaagacgaaaataaccatattcagccgctgggcttcttcagcggccaagccggacggttatgtcaaaagtccggcatcatcaacttttgaaaggaggaatgatgggcgatcagatcatcatgttcatcagtcagatcttcaacggtctgaagatcggcagcgtgtactcgctcgtggcactcggctacaccatggtgtacggcatcattcgtttgatcaacttcgcacacggcgatttcatcatggtcggctcctacgtgctgatgcttaccattccggcgatcgtcgcattcggcctgcccgcatgggtggccgtcatccccgcgatcctcatgtgcgtggcggtgggcgtcatcgtggagagggccgcatacaagccggttcgtgaaaagggcaacagcatgacggccctcatcaccgcaatcgcaatgagccttctgctggagaacggctcccaggccatcttcggcgccgactaccagaccgtgcccaccatcatccagattccgacgctggcgatcggcaagctgaagatcgacggcgcgaccatcatcaccatcgtgctcggcgtgatcatcatggtcgcgctgcagctgttcgtcacctacaccaagcagggcaaggccatgcgcgcggtctccgaagacaaggaggcctcgatcctgatgggcatcaacgtgaactccaccatcacgctcacgttcgccatcggttcgggcctcgccgccgtcgcatcgctgatgtactgcgtttcctatccgcaggtgtccccgatgatgggcgcgatgctgggcctgaaggccttcgtcgcggccgtgctcggcggcatcggctccatcccgggcgccatggtcggcggtctggtgatcggcgtggtcgaaagcctgaccaaggcgtacatcggcaccatcaccggcggcgtgatcacgtccgcgttctccgacgccattgtgttcggcatcctcatcatcgtgctcctggtcaagccgtccggcctgatgggcgaaccggaaaccgagaaggtgtgacctcatgaagaaatcaatgctttccaccaaacagtcctatctgatgtgcgcggtcggcatcgtcgtgctgttcggcattctgatgggtgtatgcgaatccggcatggccagcacctacatcaagggcatcatgatgacaagctgcatcgccatcatcatgaccacctctctgaacctcaccatcggcgtgctcggccagctgacgctgggctgctgcggcttcgaagcgatcggcgcgtacagcgcggccctgctgagcaagctgctcgtcgccaacggcgttgcgatggatccgacgctgcgattcctgctgacgacgctcgccggcggcgtggtcgcctgcatcttcggcatcctggtcggcattccggcactgcgtctgcatggcgattacctcgccatcatcacgctgggcttcggcgaaatcatccgcgtgatcatccagaacctgaaggtcgccggcggcatgggcctcgacaagggcgcggccggccaggcgctgatcggcatcgaccgactcgccaacctgtacgtcgtgttctggatcaccgtcgtcaccgtcgtgctgctgttcatgttcgcccgctcccgttacggccgtgccgtcaaggccatccgcgacgacgagatcgcggcaagcgcgtccggcatcaacatcacctacatgaaggtgctcgtgttcgctatctccgcgttcttcgcgggcatcgccggcggcatcttcgcccagtacatcggctcgctgaaccccgcgatgtccggatggctgcaatcgatcaactacgtgatcatggtcgtgttcggcggcatgggctcgctgacaggttccatcgtctccgccatcgcgctgacgatcctgccggagctgttgcgcgccttctccacctaccgcatgctcgtgtactcggtggcgctggtgctcatcatgatcttccgcccgcagggcatcttcggcaactgggaattctccctgaccaagaccatcaacaagctgttctacccgatgaaggtcaaggcgcacggcaagtcgaagcaggctgaatccaccgccaaggcagccaaggacaccgccaagacggacgaaaccgtcgagacggccgccgacaccaaggaggcgcaggcatgagcgagcccatcctgaaagccgaacatctcggcatcaccttcggaggcctcaaagccgtatccgacttcaacatgaccatcaactccggcgagctcgtcggcctgatcggcccgaacggcgccggcaaaaccaccgtgttcaacctgctgaccggcgtgtaccagcccacggaaggcgagttcttcctggacggcgaacgcatgaacggcaagaagacatatcaggtggtgcgcgccggcatcgccagaaccttccagaacatccgcctgttcggccagatgaccgtggaggagaacgtgctggtcgcgttcaacgaatcgttcagctaccacatgggcggcgcgattttccgcacgccgaaattctggaagcaggaacgcgagatgcacgccaaagccatcgacctgctcaagatcttcggactagaaggcctggccgaaaccgaagcggcgaacctgccgtacggcgcccagcgcaagctggaaatcgcccgcgccctcgccaccggcatgaaactgctgttgctcgacgagccggcggcaggcatgaacccgacggagaccgaggacctgctcaactgcatcaacaccatccgcgaccgcttcggcatcgccatcctgctgatcgagcatgacatgagcctggtgatgaacgtctgccagcgcatccaggtgctcgactacggacgcaccatcgccgccggcacgccggaggagatcgccaacaacccgcaggtcatctccgcatacctgggctccgacgacgataccgacagcgacgatgccaagcacgaaagcgaggaagcctgatgctggaagtcaagaacctttccgtttcatacggtgccatcgaagccgtcaaggacatcagcttcaccgtcaacgccggcgagatcgtgtccctgatcggcgcgaacggcgcaggcaagaccaccacgctgcacaccatcaccggtctggtaccggcgaaatccggttccgtgatgtacaacggagtggatctgctgaaaacccacaacaacaagatcgtgaccctcggtatggcgcacattccggaagggcgccacgtcttcacacgcatgagcgtcgaagagaacctggagatgggcgcgttcagcctgaaggaccagtcggacctcaagaaggacctcgacatggtctacggcctgttcccccgtctgaaggaacgccgtaaccagaaggccggcacgttgtccggcggcgagcagcagatgctggcgatgggccgcgcgctgatgagccatccgaagacgatcctcatggacgagccgtccatgggcctgtccccgaagctcgtcaaggagatcttctccatcatccgcaagctgcacgagcagggcatcacgattctgctggtcgagcagaacgccaagatggcgctgtcgatcgccgaccgcgcatacgtgctggaaaccggccgtatcacgatggaaggcgacgccaaggaactgctcaacaacgagcaggtgcgcaaggcgtatctgggcgcctgattcgtgccgtatccgccttgtcggcttggacgcatccaaaccgacagggctttttctatatccgatggaatattcgccggtcgtgttccctccattcgggcgcgccatcgagccatgccttacaataggtaagttgactggctgaaagggaggtgtcatgagcgagatttgcacagtaaacgacgaatcccttgcccgggccgttgaaatcatccatgatggcggattggtggtcatccccactgacacggtgtacggcgtcgcctgcgatccgcgtaacatcgaggcgatccgcaaggtgttcgcagccaaacaacgaccgaaatacaagtcgttgcaggtgttgctgccgtcaatcgaaagcatggagaagctgcatctgaccttgccggtgccgctcaaccgtctggccgccatgttcatgccgggcgctttttcgccgatagcggaagcggaagacgactgttcgcttgccacgttgcgtcatgatccgacaaccggcaaagccacacagggcgtgcgcatccccaattccgcggtcgcgctgcgtattctgcgagccaccgggccgttggccgccaccagcgccaaccgttccggcgaggaaagcgcacaaacggtgcaggaagccgcggacgcgctgggagatgcggtggatctgtatttggacgggggagcgactccgggacatgtgtcgtccacggtggttgcagccgacccgcacgagcgcgacggcatcgcgattcttcgggagggagtgattcgcgagctggtcatccgtaaggctttaacactgaatggcggtgctttgggcgcatgagaatctacctgttcattgccgcggtcgcaggtggcgtcacctatctgctcacgccgctgatccggcacatcgccatcgaaatcggcgcagtcggcgaagtgcgtgcacgcgacgtgcataccgtgccgacgccacgcatgggtggactgggcatgcttatcggcttcaccgtggccatgctgttcgcctctcgcatccctttcatcgaaggcctgttcgcccaatcgcatcaggcatgggtgattctagccggcgccattatgatcagcctgctgggcatggccgacgatttgtgggaccttgactggatgctcaaactcgccggtcagctgctcatctccgtgtttgtggcctggggcggcctgcagatcatctcgttgcctctcggctcgctcgtcaccgcgtcgccgagcttgtcgatggccatcaccgcgttccttatcgtcgcgtccatcaacgcggtcaacttcgtggacggtcttgacggcctcgcttcgggcatcgtcgcgatcggcggcatcgccttcgccatctattcgtacatcatcgcaagaagctcgccgtcgtacgcatccatggcaacgctgatcgacatcgccatggtcggcatgtgcgtcggcttcatcctgcataactggcatcccgcgaaactgttcatgggcgactccggttccatgctgcttggctacctgatcacctgcgcgtcgattgtcatgaccggccgtctcgacccggcatccatccacgccagcatctacctgccggtgttcatgccgattctgctgccgatgctggtgctgttcctgccgatcctcgacatgtgtcttgcgattgtgcggcggttgagcaaaggccagtcgccgatgcatcccgatcgcatgcacctgcaccaccgcatgctgcgcatcggacacaccgtgcagggcgcggtgctgattctctgggggtgggcgtcgctgatcgcattcggctcgatcatgattctgttcttcaaagcgcagtatgtgctgattggcttcctcattgcggcggcgctgctgacggtcgccacaatgtacccctatctgaagcaccgcattccggagatccgtgaggagaacgcggccgccgaatcggacgctcagcatgcgtcggtcggacgcgcccgcggcggcaatgcccgcggcgaacgctgaccgtttttcaacgcgtcaggcatccgcatcatccgtctaaaatatgatgaaacgctttgccaaacggtataagtagcttttattgagattgataatttcggctttcagagccgtgtcgcagtaagtcagcacacgttcatatagtgtgtttatggctacaattcctgatatgaatgcagattccacgttcgccccactccctccggttttcgcccagcttggcctcgcctatgacgatgtgctgctgctgccgaacgagacggacgtcattccgtccgaggtggacaccaccacgcatcttacccgcaacatcacgatgaaggtcccagcgatctccgccgcgatggacaccgtcaccgaatccgacatggccatcgccatggcccgtaacggcggcatcggcgtgctgcatcgcaacctttccatcgacgaccaggccgcccaggtcgacatcgtcaagcgttccgaatccggtatgatcagcgatccgctcaccgtgagcccggacgtgaccctggccgacctcgacaagctgtgcggccgtttccacatctccggtctgccggtcgtggacaaggacaacaagctcgtcggcatcatcaccaaccgcgacatgcgcttcatcgcatccgaggattacgaccgtttgaaggtctccgaagtgatgacccgcgagaacctcatcaccggtccgtccaacatctccaaggaagacgcgcacgacctgctggccaagcacaaggtcgaaaagctgccgctggtcgacgccgaaggccacctgaccggtttgatcaccgtcaaggacttcgtcaagaccgagcagtacccggacgccaccaaggatgagcagggccgtctgcgcgtcgccgcaggcatcggcttcctgggcgacgcctacaaccgtgcttccgctttgatggaagccggcgtggacgtgctcgtggtcgacaccgccaacggtgaggccaagctggctctcgacatgattcgccgcctgaagtccgattccgcgttcaatggcgtggacatcatcggcggcaacgtcgccacccgccagggcgcgcaggccatgatcgacgccggcgtcgacgccgtcaaggtcggcgtcggcccgggctccatctgcaccacccgcgtggtcgccggtgtcggcgtcccgcagctcaccgccgtgtacgaggccgcccaggcctgccgcgccgctggcgtgccgtgcatcgccgacggtggcatccactactccggcgacatcgccaaggccctcgtcgccggcgcatcctccgtgatgctcggcggcaccctcgcgggctgcgaggaagctccgggcgagaaggtgctcctgcacggcaagcagtacaagctgtaccgtggcatgggctctctgggcgccatggctccgcgtggcaagaagtcctactccaaggaccgttacttccaggccgacgtcacctccaacgacaaggtcgttccggaaggcgtcgaaggcgaagtgccgtaccgcggaccgctcaacgccgtgctgtaccagatgatcggcggcctgcaccagtccatgttctacattggcgcgcacaacatctccgaaatgccggaacgtggccgcttcatccgcatcaccgacgctggcctgcgcgaatcccatccgcacgacatcgtcatgaccgccgaggcgccgaactactccggccgtcagtgattggcgaataccgcgcgaaacgcatacgacgcgactaaacgctagataatacgaaacccgtccggtggcaggaatgccgctggacgggtttcgtgcgttttcggcagctattggtctagtgacgtttagttaattgagccatgccgatggcaccgtatgaacgtcaacttacgcgttccgtggtgccacgcagcaccagcgacgtcggcatgacggtgaacggctcgtcaagcgtctcgccattgagcagcgcaagcgtcttacgtgcagcgatacggccgatttccgccggatcctgatgcatggtggtcagatccaatgcggtggcggtgtcgtcatcatcgaatccgaccagcgacacgtcctgtggcacgcgccatcccatgcgccgcagctccttcagcaggggagcggccacggcgtcgacggagacgcagatggcggtcggctgctttggagcgctgagcagctgcgcgacgatgccggaatagatgtcctgctcgctgcgagcatcgatatgggatagtgacggcatgacgatgatgtcttcatccgcgtaaccgcaagcttgtgaggcttcgctgaatcccttcttgcgcagcctgtcggagcagacgaacggcgtggtgttgatgggctgttcgatgtaggcgagcgtcttatgccctaacgatttgaggaaccgtacaatcgtcgccatggaagcctcgtcgtcgatggcgatgccggcgtcgagaccgtgcgtgctcggcgcgttcatgccgaccaccggaatggtcagatcgccaagcacctgcttcttcgcctcgtcgaagtcaaatgacgcctcgatgaccgcgtcgacgttgcggttgcccggaagattttggaaaaacgcatccaaatcgtcctgcgtccacacgatgtaaggaacgatgtcgtatccggccttcgacatcacctcgtaaatgccttcgaaggcgtgggcgttgaaccagctgctgatttcgttcggcagcagcacggcgactcgcatggttttgccggacgccagggacgacgcgcttttcgaaaaggagaaatgcaggcgcttcgcctcctgctcgatgcgttccctggtttcgggactgaccctgtcgagcccgcgaagcgcgcgggacacggtggagacggacactccggctgcctgggctacgtctgcgatggtggttcgtggcatggtcggatggctccttagggtggactatgcgggcggtcggttgcccgcgactgcttcactctatcacgacacgctgcttttgtaaaaacgcttgcatggcttcaggtgttgttattgcttgctttttgaagtgctgccaccttgttctgcctcctgtggtttgcgcttttttgcacaagcgttattattgattatgtcaagcaatgcgataacagcaacgaagctacacaacacaacataaccatcgtaggaaaatcaacgaaaatcgttctacgtacggagttgtgatacgtgcgcacggtgcacaagcgtttgtatgaaaggggacaacatgaccgaagtcaacgatccgtcgctgtggtggaagcaggccgtggtctaccaggtgtatccacgttccttcaaggattcccgcggcgagggcctcggccagatcgccggcgtcaccgagaaaatcggatatctgaaggaactgggcgtcgacgccatctggctgagcccgttctacccgtcccagctggccgacggcggctatgacgtggacgactaccgcaacgtcgatccgaaactcggcaccatggacgatttcgacgcgctcgccaaagccgcgcatgccgacggcatcaaaatcgtcgtggacatcgtgccgaaccacagctccaacctgcacgaatggttcaaggccgcgttggccgcgaaacccggctcgccggaacgcgaccgctacatcttccgcgacggcaagggaccgaacggcgacgagccgccgaccaactggcagaaccacttcggcggccctgcatggacgcgcgtgcccgacggccaatggtatctgcacatgttcaccaaggaacagccggactggaactggaaaaacgaggacgtgcgcgccgatttcatcaaaaccctgcgtttctggcttgaccacggtgccgacggcttccgcgtggacgtagcgcacggcctggccaaggatctcgaccgcgatgatctggacgattatgtggtctggtgcaccaacgatcagcccgaagacggctcccatccggtgatcgaccgcgacgaagtgcacgacatctaccacgagtggcgcaaggtgttcaacgagtacgatccgccggcgttcgccgtggctgaggcgtgggtccgaccaagccgccagcatctgtacgcctccccggacgatctcggccagatcttcaacttcgagttcgccaagaaggattggatccgcgacgacatgcacctcgccatcgaggaaggtctggaaagcgccgaacggtccggttccaccgccacttgggtgatgagcaaccatgacgtggtccgccatgccacccgctacgcgctgccccaggtgccgaccggcgaataccaccgactgccgctcgactggctgctgcgcgacggcaccacataccgggaggaccgcgcgctcggcaccaagcgcgcccgcgccgcgatcatgatggagatggcgctgcccggctccgcctacgtgtatcaaggcgaggaactcggcctgttcgaagtggccgacattccgtgggatgagctggaggatccgtccgcatggcgcacctcccgttccgccagcaccaaaggccgtgacggctgccgtgtgccgctgccgtgggttgcggccgacgctccgcagctggacgatccgaacgatgagttcggccatggcggctccttcggcttctcgccggcagacgcgaaggccgagccgcatctgccgcaacccaagtggtacaaggatttcgcggtcgatgtcgaatcggccgacccggattccatgctgaacctgtaccgccgcgtgctggcattgcgacatgagttgcagaccaccgacctgagtctcgaatggcttccggaagaccagcccggcaaggcgcatgacggcgccaacggtttcccgggtggcaccatcgcgtaccgccgtgccaacggctgggcctcgatcaccaacttcggcgaagaaccgatcacgttgccgcaaggtgaagtgctgctgacatcaggaccgcttaccgacgacggcaagctgccgcaagataccagcgcttggctcaaactggccgattgaccgcacgcaggatgccccgatctgagggtgtccgtgccggataccgcactcgtgcgctgaaccatcgaaccggcagcgcgctccagccgtccgcgtccctccatttgggcgcggacggctttcctgtttccaacgaccgttttccaacgatgacggtccgacgtacctaccctgcggtatcttcatatgttcggcctgcgcagagggcgcgaccgcggaccaatcgaaagaggcaacgatggtagatgcacacgatggcgaaacatacacgtccgaaggctcacgtctgatctggatcgactgcgagatgaccggcctggatatcttcggcggcgacgagctcgtcgaggtttccgtggtgccgaccgacttcgacctgaacgtgctcgacgaaggtgtcgactatgtgatcaagcccagtcagaaggctgtcgaccacatgaatgacttcgtgcgcgccatgcacacccgttccggcctgatcaacgaatgggaacacggtctgagcctcgacgaagcgcaagccaaggtcatcgaatacgtcaggaaattcactccggccggcgtcaagccgctgctcgccggcaacaccatcggctccgacaagaagttccttgaccactacatgccggaactcatggagaacctgcactaccgcaccatcgacgtgagcactttcaaggaactcgcccgccgctggtatccggccgtctacctcaaccgtccgccgaagaacggcggccaccgcgcgctcgccgacatcatcgaatcgctcgacgaactgcgttactaccgcaaggcgttcatggccccggtgcccggtccgagcgaagcggaggcgaaggccatcgcctctgaaatccaggaaaccagcctgctcaacaaggactgacagcacgactccagcgagaggaaccgcatgaccgcagctgattggaccaccatcggccaaccgcaggatatccgccttgtggtcgccgacatggacggcacgttacttgacgaacgaagccgaatccccgacggattctggcccatgctcgcccggctcaaacgccgtggcgtcgaattcgtgcccgcgtccggacgccaatacgccacgctgcgcaacatgttcgccgacaaagccgcggagattctcgacgggggagaactgtcctatatcgcggaaaacggcaatgtggtggcgctcgacggcaaagtcgtggaagtgcatggcgtcgatttggacgtcacgcgtcacgtcatcgacctggtcgccgacgccgctgcctccggcgagcataacgtgggactggtggtgtgtggcctcaaatcggcatacgtgcagcgttccgacaagccgttcctcgatgaagtcggcaaatactacgcggcgctgagcatcgtggacgatctgcacgaagtgctcgacttcgcgcaggaaccgtccgcctacacccctgacggcgacgccgaaatcgttctgaaactcgcgatcctcgaccttgacggctccgaacgattcaccaacgaaaagctcacacatctgcgcgcggactaccaggtggtcgtctccggcaaactgtgggtggacatcatgaacatcgaaaccgacaaaaagcagggcgtcgaggcgttgcagcgcgtgctcggcgtcacacccgcgcagacggcggtgttcggcgactacctcaacgatctgctcatgcttgaggcgggcgactggtcgttcgccatgggcaacgcgcaccccgatttgaaggccgccgcgcgctacatcgcaccgtcgaacgtcgagcacggtgtgctcaaggttgtggacaggctggttgcctgacgatttcgttgcatggggcgcggtgacgtaaagaaggtggcgtaatgaggcaatccgaggcgcttgcgattctgggttccggcgcaagcgtgttcctgacgggcgcgcccggtgccggcaaaacctacgtgctcaacgaattcatacggcaggcgcgtgccgacggcgcatccgtggccgtcaccgcatccacgggcatcgctgccacgcatatcaacggcaccaccatccattcctggagcggcatcggcttggccacggcattgaccgacaatctggtcgaaaccgttcgcacacgccgcaaacgcaagctgcaggaagccgacatcctcatcatcgacgaggtctccatgctgcacgcgtggctgttcgacatggttgaccggatctgccgcatcatccgccgcgacgaacgtccgttcggcgggctgcaggtggtgttgtccggcgattttttccagctgccgccggtttcggtatcgggacgcaacaacgacctgattgcgccgtccgccgaatatctggccagtcgcgagcggtacatgcgcgccggactcaatcccgaaggtttcgtcaccgaatcgttggtgtggcgtgaattgaaccccgttgtctgctatctgaccgaacagcatcgtcaggatgacggccagctgttgaacgtgctgaccgacattcgcgaaggcgcggtggacgatggcgaccgcaatgtgctgctgacccggttgggggccattccggaacccgggcagcaggcggtgaacctgttccccgtcaacaggcaggccgacgcgcttaatgatctgcgcctgttcgaaatcaaggaggagccgcacgaatacctcgccgaatccgagggtgcggcgaatctggtggaacggctcaaaaagaacatgctggcccccgaacggttgtgtctcaagacgggcgcggccgtgatggcggtgcgcaacgacaccgaccaccagtacgtcaacgggtcgctcggcaccgtgcgtggattcgccacgcaatcgcagggcggctggccgatcgtcgaattcgaaaacggcaacatcgtcaccatgaagccgaattcctggcagatgcaggacggcgataccgtgctcgccacggtcaaacaggtgccgttgcgctgcgcgtgggcgatcaccatccacaaatcgcaaggcatgacgctcgatcgtgccgtcatggatttgcgacgcacattcgcgccgggcatgggatacgtggcgctgtcgcgagtggaagggctcgacggcctgtatctgcaaggcgtcaacgagcgcatgttcctggtctcaccggacgcggtccgtcttgatggacaattgcgattggagtcggctcaggccgccgatacgcttgcctccgacggtgtcggagcattccgcgcccgcatgccgcaaccggccgccggtgaggatgacgaattcgcgcaggacgtgctgttctgacccgctgctaaatatcagcccatcgcctgcagggaacgcgcaagatccgggtcgagctcaacttcgtcctcgacgctttccggatcggggtcccaacagctggcgatcacgcaggccagtccgacgagcaaccaaagcgggttgcgctgcaggaactcaagacctggaatcgcccgcgtgacgatgatccatatcaccatgccggccagcgcaatcgcattgaacggcttcttccatggcagggaaatcaacgtgacgcacaatacggctaggcacaggccgatccattggttgccttcggccagcacttccggcgctgccgccgcgaagacgaaatagcagatgatgccgatccagccgagtttgctccaaatcgaaatgtgcgcggtgacgtgacgcatgctgcgtcctttccttatgaagcgatatggtgctgattccagtatcatagaaacggctttagacttatttataactctataaataacgtttttcgcgtattggtgtgcgattcgaggacgtgtggcgcatccaagtcggcttacctgagtaatttggaacgtatgaccaaagcacttcgtatgtctaccatgttcctgcgcaccctgcgcgaggaccccgccgatgccgacgtcgtgtcggacaagctgctgcagcgcgcctgctacctgcgcaaggccgctccgggcatctggacctggctgccgctgggcctcaatgtcctgaacaagatcgagaacatcatccgcgaggagatggcgtccatcgacgcccaggaagtccacttctccggactgctgccgcgcgagccgtatgaggccacccaccgctgggaggaatacggcgacaacatcttccgtctgaaggaccgccacgaggccgactacctgctggccccgacccatgaggaaatgttcaccctgctggtcaaggacctgtactcctcctacaaggacctgccggtgaccctctaccagatccagaccaagtaccgcgacgagttccgtccgcgcgccggcctgatccgcggccgcgagttcatcatgaaggacgcctactccttcaccctcgacaaggaaggcctcgtcaaggcatacatggacgagcgcggcgcatacgagcgcatcttcaaccgtctcgacctgaagtacgtgccggtgcacgccatggccggcccgatgggcggcttcgaatccgaggagttcctggctccgatggagatcggcgaggacaccttcgcccagtcgccgtccggcaaggcctggaacgtcgaggcgctgaccactccggaaccggaagccatcgactttaccgcaacgccggcagccgaaaagcgcccgaccccggacgcggccaccatcgacaagatggtcgaattcgccaacgccaaccatcctcgttccgacggccgcgattggcaggcctccgacattctgaagaacgtcgtcatcgtcgtcatgcatccgcaggacgaagaccacgacgagccgtggcgcgagctcgtggtcgtaggcgttccgggcgaccgtaccgtcgacatgaagcgtcttgaggcgcagttcaccccggccgagatcgaggaagccaccgacgaggatctgaagaagcatccggaactcgtcaagggctacatcggaccgatggcgcttggcccgcaggcacgcgacggaaagaaggccgagaacgcgtccgagaccggtgacgcgctgcgctacctgatcgacgcgcacgtggcacgcggttccgcatggttcaccggcgccgacgagcaggacgtggattactacgatttggtgtacggccgcgatttcgaggccgacggcaccgtcgaagccgtgcaggtacgtcatggcgacatgagcccggacggttccggcccgctgagcttcgagcgcggcgtggaaatcggccaggtgttccagctgggcctcaagtattccaacgcgctcggcctgaaggtgctcgaccagaacggcaagaccgttccggtgtggatgggctcctacggcatcggcgtctcccgtgtgatggcctgcatcgccgaaacccatcacgacgagaagggtctggcgtggccggcagtcatcgcgccggcacaggtgcacgtcgtggccaccggcaaggatgcggccgcgttcgaagccgcagaacagctgatcggtgagcttgaggccaagggcatcgaagtcatcttcgacgaccgcaagaaggtgtctccgggcgtcaagttcaaggacgccgaactcatcggcgtgccgatcatcgccgtcgccggccgcgacaccgtcaacaacggcaccatcgaagtgcgcgaccgcaacggtgagaacgccgaagcggtgccggtcgcggacgccgcgcaggcgatcgcggaccgcgtcgctgcactgctcaagtgacatacggcaatccgtagcgcgtcggtttgatccgacgaacgacatacggcaacggaagaccatcaagcaggtggtcttccgttttttgtttttcatggggaataccgtgcgcatctcacgcacatgaggattgtggatgtcggtggataagtcgaaattatccaccgacaatccacgactcgcccgacgatctcaagttatccacattctccggttgggcttgcagacggatggaacgttcggcgatagtggtcttaccgcggaaacgtgaagatgcgggaagggcatgcagtttaccctctctcaccataaatccacctcactgcctgtcgcttccgtgccgtcaacggcgctttccgcggtccatcattcgtcaaacagaaagggccgaacatggcgcagcagcagggtctcctcaccatcacgggatatgtgggcggccagcccacgcaattcaatcgggaaggcatgccgcatgccagctcattccggctggccagcaccagacattatttcgatggccgaacgcaacagtggaaggacctgcccaccacatggatcacggtgaaggcatatcgaggcctttccgaaagcatctgccaatcgttcaaaaaaggcgaaccggtcatcgtgaccggcgtgctggcggcggaaagctgggtggaccagaacggcaagcaacagtcgaaactcgtcatggaagcgaatgcggcggggcatgatttgagctacggtgtctccaccttccgcaaactcgccaagaaaaacgattccggccagcaagacgcgcagcctggacaggctttaggacgtgatccatatgtgcaagccgcccaacagcggtgcgaaacttcagtcaatgcgatggacgggcagagttccggcgttgacgagcaaggcggctcgcaggccggtacggatagcaacgccgccgaacccctacgtgaggaattcggcggcgatggcttctgacgattgcctgacgcttatgcgatcgctggcatggcctgttaccagatgcgcacgcgttgctccggtgcgagccacatgccgtcgccgggctgcacgccaaacgccttgtggaacaggtccacattacgggcgatgccgttcgtacggcattcggcgggggagtgcgggtcgatctgcagatactgctccgccaactcgtcgcgattcttagtgcgccaaatcgaagcgtagctcaggaagaaacgctgcaggccggtgaagccgtcgatttcaggagcatcggcaagcgcggcttcgatggcttccgtggaaccatccttgccgcggccggccgcttcatcgagagcgaacgcataggccttgagagcgatgttcacaccgctcaaatcgccgatgttctcgccgatggtcaacgcgccgttcacatgaggggccttcgacgggtcatccgaatacttttcggcgagctgcgtcggcacgaactcgttgtactggtcgatgagcttctgggtgagcgccttgaaattggccttgtcctcttcggtccaccagtcgttgagtttgccgtcgccgtcgtattgcgagccctggtcgtcgaaaccgtggccgatctcatggccgatcaccgcgccgatgccgccgtagttcgcggcatcctcggcatccgggttgaagaacggcggctgcaaaatggcggccgggaacacgatcacgttcatggacggctcatagtaggcgttcaccgtctgcggattcatcagccattcgtccttgtcgacggccttgcccaccttggccagctggtagccggtctcatacaggttcgcggcacgcatgttctgggcgaagccggcgtcctcgcgcacatccagcgcggaatagtcacgccaatggttcgtgtagccgatcttcggcacgaacttggacagcttctccaatgccttggccttggtctcgtcgccaagccaagtggaattggagatggacacacggtaggcgtcgatgagattgccgaccagctgctccatacgctgcttggaggtttcggggaagtgacgcttcacgtattcgcggccgacatcctcgccgcagatgccgttgaccagcgagacgccacgcttccaacgcacgcgctgctccttctgcccggacagcgtcttgccgtagaagtcgaaattcgtttcgtcgaattcgtggggaagctccaatgtggagccgatcaccacatgcacgcgggcccacagcttgagatcatccagcgacgcttccttccagaacgcgttgagtccggtgaggaagcttggctcatgcacgatcgtgtggctgaaacagccgcggaaatccaacggctgcacggcagccgcggtggtcgcgtcgtaagcgttctgccaggcgtcgatccaagcgtccaggtcaacatcggcgagcatggcgcacaggtcggcgtaatccgtcgggttataggtcttcaccgaatcgcgcgtggacacgttgtcccaatggttcgccgcgatgcgcgtctccacgtcaaggaaacgcttggcctgcgcatgggcatcctcgtcatcggccgcaagatgcgcgttcttcagctgcttggcgaccatctcgacatacgcctcacggatcggcgcgtaatggtcttccctgtagtaggcctcgtccggcagatccaaaccgtcctgttcgatgtgcacgacattggtctccggcgctcccggatctccgtaaacggcgatgccgatcaggtctggaccgccggtcgggttcatggcgccaagcgcgcgggtgagcgcggccttgtcttcggcctcgtcgatggaagccaactggtcttcgatggcggcgagtccggccgcgtcgatggcatcgacgtcaaggaaactatggtacaaagcgcgcgacttgacggctgggcaatcatcctcttcaaggatgtcgcggatctggttttccgcatcctcggcgagcttgtcgaaggaaccataccgggaacggtcgtcgggaagacggtacatgtcgacccacgggccgttgacgaagcggaacaagtcctgagacgggccggtcacggcggagaacgatgccggatcgatacccgaaaccaaagaattcgaagtgttgttcatggtttcacactatccatctttggtgacaacatcgtgtattcgaatcgaatattcgggtggaacgcaaggtggaatacagaaaggagaacatcgttcgccggtgtatggcccgcgaagtagggttgaaggcatgatcgaactgaaaacccctaaagagattgaagcgatgaagcccgcaggccgcttcgtcggcggcatcctgcgcgacctgaaggaattcaccaaggtcggcaccaatctgttggaaatcgacgaattcgtccacaagcgcatcgtggaccgcaagggcgcctcgtcctgctacgtcgactatgcgcctgatttcggcaccggtccgttcgcgcactacatctgcacgtccgtgaacgacgccgtgctgcacggcgttccgtacgactacaacctgaaggacggcgatctggtcagcctcgatctggcgatcaacgtcgacggatgggtcgcggattccgccatcagcttctgcgtcggcacgcagcatcccgacgacctgcgcctgatcaagtgcaccgaagaggctttggcggccggcatcgaagccgctcagccgggcaatcgtctgggcgacgtctcctgcgccgtcggcgacgtggcacgcgaatacggctacccgatcaacctggagttcggcggacacggcgtcggccatatcatgcacggcgatccgcatgtgccgaacgacggcaaggcgcatcacggctacaagctgcgtccgggcctggtcatcgccatcgaaccatggttcctcaagaccaccgacgagatctaccaggatccgaaggacggctggacgctgaagagcgaggacggctcccgtggcgcacacagcgagcacaccatcgccatcaccgaaaacggtccggtgatcctcaccgtccgcgactagtccaaaaccttatgaaaacgggcttgtgcgattacgcacagcccgtttttttcatgcccgttttgagacggaacccacatatcgaaacgcgcatgccatatagtgggcggtactttttgaactggtaaggagcgaacgagtatggccacagccaatctgagtgtggaatccaaggacttcaccctgccggtggtcgaagccacggcgggcgcggacggcatcgtggtgtccacgctgcgcaatgatggctgggtcacactcgaccccggtttcctcaccaccgcgcaatgcgaatcgaaaatcacgtacatcgacggcaagaactcgattctgcgctatcgcggctatccgatcgagcagctgtgcgagcagtccgacttccttgaagtcgcttggctgctgcgtcacggcgaactgccgaacaaggaccagtacgaccgtttcatctctgacatcaaccaccgcacgatggtgggggaggacttccgtacgttcatgggctccttcccgcgcaccgcgcatccgatgagtgtgatggcgtccgcggtcaacgcgctcgccacgttctacccggacaccacggacatcaacgattccgaccagctggacgaagcggcgaccatcatcatggccaaggcgcgcaccatcgtcagctacatcttccgccaccgtcgcgatgagccgatgctgtacccggactactcgcgtggctatgtcgacgatttcctgcgcatgtgcttcgccgtgccgtatgagccgttcgaatccgatcctctgtatgtgcacgcgcttggccgtctgctcatcatccatgccgaccacgagcagaactgctccacgtccgtggtgcgcatcgccggttcggcgcacgccaacctgtattccgcggtcgcggccggcatcaacgcgctgtccggcccgctgcacggcggcgccaacgaggcggtgctccgccagctcaaggccatccgcgactccggcaaaaccgtcaaggaattcgtggaggacgcgaaggccaacgggcgtcgcatctccggcctcggccaccgcgtgtacaagtcgtacgatccgcgcgcggcgatcgccaagacctatctgcagaagatcatggaacgcaccgacacgctgaagctgccggcggacgagcgcgcgctgttcgacgtggccaccgaactggagcagatcgcattgagcgacgattacttcgtgtctcgtcatctgtatccgaacgtcgacttctacacgggactgatctaccgtgcgatcggcttcgatccgtccatgttcaccacgctgttcgcgttgggccgcatccccggctggatcgcgcaataccgtgagatgctcgccgatccgaacacgaagatcggccgtccgcgccaggtgtacaccggctacacggaacgcgattacgtgccgatggaccagcgccactgaacgatattgacacgcggctccggtttcggacgtgcgcatgcgcctgccatggcttgccgctacagtgtttcaaggaacgaaagaacctaacgaatcgctggaaccggtctacggctccggcatggtcaaaggagcgtacacatgattgaacagcgcaccgcatggggttggggtctggcaagcatcgatgcggccggcaacacccttgacgtgtggtatccggaactcacgttgggcgaggctccggctgaaacctcgcgtccgaatcacaacttcggcgccatcgcgcatgacgaggccgacgcgcgtggcgtgcgccgcatgcccgtgttcaccgtgtccaagctggacgagccgatcgaggacgccgccgacgcctatctgcgtctgcacctgctgagcatgcgtctggccaagccgaacacgttgaatctcgacggcattttcgccaagctcaacaacgtggtgtggaccaactacggtccgttcgccgtcgatgatttcgctttgcgcaagcttgacgtgatggccgccacccgacagtccggagccgtgttggcgccgcacgtcgatgtgaacgtgctgtcgattgacaagttcccccgtatggtcgactacgtcgtgccgaccggcgtgcgcatcggcgacgccgaccgcgtgcgactgggcgcgcacctgtccgaaggcaccaccgtcatgcacgccggcttcgtgaacttcaatgcgggcaccctcggcgtctccatggtcgaaggccgcgtctcgcaaggcgtcgtggtcggcaacggctccgacatcggcggcggcgcgtccatcatgggcaccctgtccggcggcggcaagctcaagaactccatcggcgagcactccctgctcggcgcgaacgccggcatcggcatctccctgggagacaactgcgtggtcgaagcgggcctgtacgtcaccgccggcaccaaggtcaccatctacgacaaggccaaggtcgccgccggcgaaccgctcgaaaccgtcaagggcgccgaactgtccggcaaggacaacatcctgttcatccgcaactccgtgtccggccgcatcgaggcgcgctaccgcaagaccggcatcgagctcaacgagaaactccacaagaactgaaaacggaatggcggagagcgtcatccgcgctctccgcaagaggaaactcgtgaaaatcacactgatcaccgtcggcaaggtcaaagagaagtatctgcgcgacgccatcgcggaatattcgaaacgactgggccggtattgcaagctcgacatcgtcgaagtggccgacgagaagacaccggagcatgccagcgacggactcgaacggcagatcaaggccaaagagggcgaacgcatcgccaaacatattcgtgacgacgcgttcgtcatcgccctcgccatcgaaggcaagcagctcaccagcgaacagctcgccgcgaaaatcaacgacctcggactccacggcaccagccatatccaactcatcatcggcggctcattgggactcgaccccgcgatcctcaaacgagccgactacctgctgagcttttccaaaatgacgttcccgcaccagctgatgcgggtgattctgctggagcagatctatcgcgcatacaaaatcaacgccggagaaccttaccacaagtgattttcgaggcgtttcgcaagaaacgctaagtaggggcgatccggtatagtggcgcgtatgagtgactacagggacgaacgcgagcagcgagaacgccgtcgccgcaccatggtgcgcacggtgtgcatcgtcatcgccgcggcgatgctgctgagtctggtcattcctgcgatctacgcggggctttgacgccttcgggcccgtatgatccgaaacgggccccggtttcccgtatgcgtgcggacaggttcgcggtccgtccatgtgggaaatggatgtgggcacgtggaaaaaccttatggattgtgcgggagccgtggacggctccatgtcagaatagtcaggaacgtaatagaaatgtatggtgtaaacgatggcagaatttgattactccgaggcgatcagcgaagcgcgcgccaaatacgagtccatttccaaggccctcgacgtcgatcgactgaccgccgaggccaaggaccttgaagtgaaagcggccgaacccggattgtgggacgatccggaaaacgcacagaaagtgaccagcaagctgtccgcggtgcagtcgcagctcaagcgtctggcatccgccgaccagcgcatcgaggacgtggagaccctggtcgagcttggccaggaggaagaggacgccgacacgttggccgaggcgaaggccgaagtcgaaagcatccaaaaggatctcgacgatatggagatccagacgctgctcgacggcgaatacgacgaacgttccgccgtggtgacgatccgttccggcgccggcggcgtggatgcggccgatttcgcgcagatgctgctgcgcatgtacctgcgttgggcggaacgcaacggatacaaggccaaggtcatggacacctcctacgcggaagaagccggcatcaagtcggccacgttccaggtggacgccccgtacgcatacgggcgactgagcgtggagggtggcacccaccgtctggtgcgtatctccccgttcgacaaccagggccgccgtcagaccagcttcgccgccgtggaagtggttccgctggtcgaagcgaccgatcacatcgacgtgccggattccgaaatccgcgtcgacacctactgttcgtccggtcctggcggacagggcgtgaacaccacgtattccgcggtgcgcatcacccacatcccgaccggcatcgtggtgaccatgcaggacgaacgctctcagattcagaaccgtgccgccgccatggccgtgctgcagtcccgactgctggtgctgcgccacgaggaggaagccaagaagaagaaggagctcgccggagacatcaaggccagctggggcgaccagatgcgctcgtatgtgctgcatccgtaccagatggtcaaggacctgcgcacggggtatgagacctcgcagacccaggctgtcttcgacggcgacatcgacgagttcatcgaagccggcatccgctggcgtcacgaacagcgtcgcgcggcagccgaggaacaagaagcctaagcgataggcggagggacaacacgatggcgctgatctcgcttgaacatgtgagcaaagtctatccaaagggcacgcgtcccgcattggatgacatcaatcttgacatcgatcgaggtgatttcgtctttcttgtgggcgcgtccggttccggcaagaccaccttgctgagcctgctgcttcgcgaggaggaagccacggatggcgagatccgcgtcgccggcaacgatctgcgacgcctgtccgcacggcaggtgccgcattatcgccggcagatcggctttatcttccaggattacaagctgctcaacaacaagacggtatgggagaacgtcgccttcgcacttgaagtgatcggcacaagccgttccaccatcaaatcgctggtgcccaaagtactgcagacggtggggctcacgggcaaggaaaacaactacccccatgagttgtccggcggcgaagcgcaacgcgtcgccatcgcaagggcgtatgtgaaccatcctcagatcctgctcgccgacgagcctacgggcaacctcgacccgaccacatcgctgggcatcatggaagtgttggacgccatcaaccgtaccggcaccaccatcgtcatggccacacacaacgaagagatcgtcaactccatgcgcaaacgcgtggtcgaattgcacaccggcaagatcgtgcgcgacgagcagcagggatcctacgattccgcgctgtatttcccggatgccgaagtcgagtcgaaatcgcaccaggcattgggtacttccgacccgaacgcgaaataccgtcgacagaacgccatcgattcaacgaacgctcctgacgacaccgtcgacgtggaaggcgcgacgcgcgccgaaaccgtggtgaacgccgtggatgtggtcgccgctgccgtccatgacggacaggggaacgacggcatcgcccgtcttgccaaatccgtgcattccggacgcaccggccgttacggcgaggccttcgcgtcagtggagaccaccttgacctggggcaagggactgagcctcgaacagatggccgaccaggaacaggccgagcaaaccgaacggaaccaacaggccaagacctccgctgaaaatgatgcctccgagactggcgccgacgaagcatcggcgctgtccgctccgcctgcaccgcccgttccaccgacccaaaccgagcctccgacaccgcccgaaccgccggcaccgtccgatgaaaaccctgaggacaccaaggagcacgactgatgcgttttcgtttcatcctttccgaaacatggaacagcctcaagcgcaatgtttcaatgatcatctccgtcatgctggtcacattcatctccttcctgttcatcggcgtatccggcctgatgcaggcacagatcaccgccgcgaagggcgaatggtacgacaaggtcgaagtggtcgtatggctgtgcccggacggtgccagccaggcggcgtcctgctcgtcgggcaaggcgccttccaaccaggagatcgtcgatctggagaacgtgatcaacgaggaagccggcaacatcgtctccaaaatcacatatgtgagccgtgaggacttctacaagaacaccttcctcaagcagtatccgaacggcgaataccaaggacgcgtgctcaccgccgccgacatgcaggggtcgctgcgtctgaaactgaaggacccgaccaaataccaagtggtatccgaagtgttgagcggccgcaccggtgtcgaggaagtgcaggatcaacgcaagatcttcgacccggtcttctcggtgctgaaccgtgcgacggcggtcaccgtggcgctcgccggcgtgatgatcctggtggccatcatgctgaccggcacgacgattcgcatgagtgccgcctcgcgtaagaacgagaccgagatcatgcgactggtgggagcctcgaactggaccatccgcctgccgttcgtgttggaaggcgtgttcgcgtcgctgattggttcgctgctcgcctgcggaacgttgagcgccatggtgaagctgttcatcacggattggctgtcgaagagcgtgcagtggatgcctctgatcaaccagaagacggtatggctgcttgcaccggcccttgtggtgggagccgtcgtgctgtcgatcgtcgcgtccagcatctcgctgaggaagtacctgaaggcataaaccggcggagtgctgaacgagatgttcagcatatttgaagtttgctggatacaatgtcgaaataggtggatttcgggaagggaatacatgtctaggaaaatgacgagacaggtgcggcccatcgttggactgatgcttgcttcggctatgttctgcgccggtggcgtcgcggtcgtcgccgcgccggctccgcaggcgcatgccgtgagcatgtcggaataccaggcgaaggtgtcgaaccacgccaagctgaagtcgcagcttgccggcgtgagcagcgatcttgccgacacgattctgcagttggccgatttgaacgacagccagattcctgcggcggtcgaggccgcggaatctgcccagcaggcggcagaacaggcgcagagcctggcggaagcgaccacgcagcggttgcaagcggcccagcaggacaaggcgaaccttgaggagcagatcaaacagaccggctccgactatgatgacgccaaggccgccgtcgcgcagctcgcccgcgaaagcttccacggctccagtacgtcggatgtgctggattttgtcaccgattcgacgaccgccgacgatttcgtcaacaagatgcagtcgcaggccgcggtcacgcgaagcgaatccaacgcggcaaccgacgcggcgaacgagctgaacacgtcgatgaaccgcaaggaccgtctgggcgccatcgaacagaagatcacccagctcaaggagcaggccgaccagcaggcggcaagcgcccagcaggcggcaagcgaggccagcgccaagcagaccgccctgcagaagctgcgtgacgagggcacggtgaaacgtgagaagctcgaatcgcagaagagccagctgacaacgcagagcgccaaggaagcggcggacatcgtcgccatgaaatcgcagatcgattcatggaacaaccagtacaacaattccaacaacgccgctgtcaaccccaataacaaccagcagcagtcgcgtccgaacaacaacacgaactacaatcccgctcccgcgcctgcacctgcgccggctccgacgcccaataacaacaattccggcggcgccggcggcatgaactatgcggtgcccggcaattgcccggccggttccggatactgctacggacacaacaccggcaacacggtcggcggtgccgcgtatccgtcccgccagtgcacgctgtgggcatacctgaggcgttcccagctgagccttccggtcggctcctacatgggcaacggcgccgattgggccaataccgctcgtggactcggatacctggtgaacaacaccccgcatgtcggcgcggcgatggtgttcgcgcgcggccaaagcgtaggcggacattggaccgccgactggcagtacggccacgtggccgtcgtggaacgcgtgaacgccgacggttcggttctgatctccgaaggcggcactggcttcgcgacgttcccggcttgggagacgatctccaacgccggagcctaccagtacgtccactactgacggttccgttccagacatgaaaccacggcaagcgcgccgtccgcatcgtcgggcgacgcgctttcgtgatatggtcgacggagtcgcgttgcatacactgatcgaaagaaccgggaaggaggtccgacatggccaaggaacagggaaccaaaccgatcgcgcagaacaagaaggcgcgtcacgactacgccatcgaagacaagtatgaggccggtctcgtgttgaccggcaccgaagtgaagtcgcttcgtgaaggacgggcgtcgctggccgaatcgttcatcaccatcgaccgtcgtggggagatgtggcttgagggagccaacattcccgaatatctcaacggcacgtggaacaaccacgcacccaaacgcaagcgcaagctgctgctgcatgcggcgcagatcgacaagctggcccgccaaacccaggccaagggattcaccatcattccgctgagcctgtatttcaaagacggccgcgtcaaggtcgagatcgcgctcgcccgaggcaagaaggaattcgacaagcgccagtcgcttcgcgaggagcaggacaagcgtgaggcgctgcgagccatgcgatacgccaacaagcaggtgcgataaatcggaaaaattccggtttcacatagtgaaagaacgccgattcaggaaaatttttgtaacacaccctctttacgctaggatacggttcggctgaacaggccgatatgaatccataggagagggaacatgcaagcaggaaaagccctgaaaaccgccgccgcgttcatgttgagcgtggccatgctcgccaccggcgcggcatgcggcaccagcgacgacagcgacgcctcggcgtcgaaatccagttcgaagtccagcgaactgaccggttacgatgtttccggcgtgaagaaggacgacgcgatcgccaaaatgctgccggattatgtgaccaaggacggcaagctcaccatcggcatggatacgtcgtacgcgccggccgaattcctggccgcggacggcaagacgccggtcggcttcgacgtggacatcgccaaggcgctggccggagtgttcggtcttgaggccgatccggaaaccgcgaacttcgattcgattattccggccgtcggcgccaagtacgacatcggcatctcgtcgttcaccgtcaccaaggaacgcctcgaggcggtcgacttcgtcagccacttcaacgccggctccgcatgggccgtgaagaagggcaacccgaacaaggtcgacacgtccgatctgtgcggcaagaaggtggccgtgcagaccgccaccatgcaggagaccgccgccaacaagatggccaagcaatgcaaggcagacggcaaggcggagatggacgtcatctccagcaagctgcagaccgatgtgaccaccaacgtcgtcaccggcaaggccgacgtgttctacgccgattcgccggtcgccggctacgcgatcgcgcagaccgacggcgaactcgaaacgcttggcaagaccgaaggcatcgccccggaaggcatcgtcgtcaagaagggcgaccagcagatggacgaggccctgcagaaggccctgcagaagctcatcgacgacggcacctacatgaagatcctcaagtactggggtgttcaggacggtgccatcagcaagccggagatcaacacccccggcaccaacgagtgaatgtttcggaacttttgcgtccgttaatacgctcgtagcaatccgctcttaggttatgccatagccacgtttggctggttgatttggctgggttgaagagaggacttgccatgatgaggaatctgaaaggttgggcggcgctcgcgttgagcgcggcgatggtcgtctcgatgggagcctgcggaacctccgacaaaacggattcccaagcttccgtcgattcgaattcgtcgtcgaccaccggttacgacgtgtccggcgtgaagaaggacgagaagatcgccaagatgctgccgtcctccgtcaccaaggacggcaagctgaccgtcggcatggatacgtcgtacgcgccggccgagttcctggccgcgggcggcaagacgccggtcggcttcgacgtggacatcgtcaaggcgttggcgaaaacgttcggcctcgaggcggatccgcagacgtcgaatttcgattcgatcattccatcaatcggttcgaagtacgatatcggcgtctcgtcgttcaccattaccccggaacgcatgaaggccgtcgacttcgtcagcatgttcaaggccggttccacgtgggtggtcaagaagggcaacccgaacaaggtcgacacgtccgatctgtgcggattgaagatcgcggtgcagaccggcaccacacaggaggaggaagtcaacaagggcgccgaacagtgcaaggcggacaacaagcttgacatccagatcctgtccaacaagctgcagaccgatgtgaccaccaacgtcgtcaccggcaaggccgacgtgttcgcatcctgtcaccccacagcagtttgctgatgtcgtcgacctgacgggtgctcactcccgccaggtacatctccatcaacgcctcctcgacgctggactcccgcctgcggtagcgttcgatgaccgcggattcgaagaccgcgcccttgagtttcggcaccctgagctcgagcctgcccgcctttgccgtgagcgtgcgttcgtagtggccggccctgtacgccttgcgcccctccttgcgttcgtatctggcggccccggtgatctcgtcggcctcggcgtcgagcatggcgttgaggatctgggtcatcttctcggtgaccagccggtcgagtttggtctcgaacaggttctggtcgatctgtatgatgttgctgtcgggcatggctgcgcgtcctgctttccaattgcgattctttgtttggcgactgaaaatcgtacacaggacgcgggccatgcccgcttcaacatctcaacgaagaacaaaaccgaaagtgcgcaggaattcggacgttatccaccaccatcgccgtgttccacaacgtcaaagcgcgccgttgttcatcacgcagccttggccaatcgcaatcgggttccaaagtatagttcggcaattgggcgaatatgaatggtagttccggacgcttgagtagcgcacgccactcctggatcagcgacatcaacagctgcacatagccataagacgcatgggcgttggactccctctgactccgccataatgaaggacctccgagcgaatcggaggtcctttttgttttcaacgctttcgttcgtcaaaaggccatcgtcagcaaaccatcaacgcgccaatcgttccgcggcagaggcgatcgccgcatcactggccgtagccgagaatcgcaggtattccggcgctccgtagaactcgccggggctggcgacgatgccgatttcggcaagctggcgcagatcctcccagcagtcgccggacttggctttcacccacacgtacaacgcgccttgcggcatgtcggtgcagtatccgtatgcgcgcagagcactcaccagcatgcccagacgctcctggtaacgggaatgctgggtcttgaccgcgtcgaagtcacgcagcccggcggccatcgcagcctgcaccggtccgggaatgatctgcccgatctgtttgcggtatgccgccatcggcccgatcagcgattgatcgccagcgataagcgccgtacgatacccggccatgttgctttgcttactcagcgaatacagcaccaatacgccttcggcggacccgccacacacatcggcgcgcaaggcgcacggcgtggaggcaagcgtatccgcatccgcttccgcaacgtcgtcttcccattgcatcaacgcatagcattcatcggacagcaccacggcaccaatcgcgcgcgcggcacgcacaataccggccatctgttccgcggacagcacctcaccggtcggattgcacggcgaattgacccaaacggccttgacgcccggcacatccttccaggaatccgcatccgccacgtcgtcgaccttcagcgtttgcgcgccggccaactgcgtgccgatctcgtacgtcggatacgacaccttcggctgcacgacgacatcgccctcgccgaaatgcagcagcgacgccatcaacgcgacgccttccttggaaccgaccgtcggcaccgcatcggcgccgatcgcacgcaaatcgacattgcgggcggccgcgaaccactcgtgaatggcgtcacgcaaatcggcagtacctgccgtaacgggatatccgtacgcgttcgggtcgttcgacgagatggcgagcgccttgcgcaccgaatcgggcacggggtcgacgggagatccgacggacaggtcgatcatgccgccgaacgcggccttcgccgtgcgcttgtaggatgcgatgcgcgaccaatcgtacggtgacgagaactcatgaaagcccatccgtaagtctccttttccaacgggaatctcaaaccatgctccagcatacggcaatcggcccgacggcatggtcgtccgtccatacgaaaaaccggttcgccttcggcgcatggaaacgtcgaagtcgaaccggtccagaaaacgaatcggccgtccaaatccgctcgacgagcaaaatggacggcacgacggttcaacaagccatgctcactggttctgcggcggcagggccgcgacctgctccgggtccttgccgatcggaccggctgcggaagcgccacccaaatcgccgacttcggcgaagaagctgacggcggcgtccttgtaccaagcccactcctccggcaggtcatcctcgtagaagatggcttcggtcgggcacaccggctcgcatgcgccgcaatccacgcattcgttcggattgatgtacagggaacgggagccttcgtagatgcaatcgaccgggcactcgtccacacaggccttgtctttgacgtccacacacggctgggcaacaacgtacggcatgcttacctcctcaacaacaacgtgtactgttccagattactcttgcgcggcaacttcgagttcgccggcaccgagacgggcatgacggtagccatagccgaagtagatggcgaagccgacgatgagccagaccacgaaacggatccaggtgagcacgctcaggttgaccatcagccacaggttggcaagcgcaatcagaatcggcacccacgggttgcccggaatcttgaaggagcgttccaggtcggggcgcttcttgcgcatgatcggaatggaaatcgccaccagcgtgaacgccgaaagcgtgccgatgttcaccatgtcggacaggatgccgacgttgcagcaggccgcgatcagcgccatgaccacgccgacgatgatctgcaggcgcaccggagtgccatgcttgccggtatggctcagaccgcgaggcagcagaccgtcacggctcatggcgaacaccactcgcgtcagacccagcagcagcaccatgaccacggtggccatgccgatgacgatgccgaggctgatgatcttcgcggcccagtcggcgccgaccatcttgaacgcgacggccagtgacggatcggactgtttggcaaggtccttataggagaccatgcccgtggtgacgatggccacgagggtgtacagcacgatgatcaggccgaggcccacgccgatgcccagcggcacgttcttcttggggttgatggtctcttcggaagcggtggccacgacgtcgaagccgaggaaagcgaagaacacgagtgccgcgccggagatgatgccggtcacgccataaatgctgggggccatgccggtggcccactgccacagcggctgttccatgaccgcggagacgccggagccgtcggtggatgctgcgggttcgctcggcggaatgaacggggtgaagttttcggccttgatgtagaagaagccgacgaccacgatgaacacgacgatggcgatcttcaaaatggtgagcgcgccgtccacgcgggcgccgatcttggtgcccatcaccagcagcgcggtgaagaaggcgacgatgatgaccggagccaggtcgaagttgaacgagccgatggcgatgttggtgttgatgttccagccgatcagctcgaagaactggttgaggtacacgccccagtatttggagacgaccgaaccggccatgagcatttcaaggatcagatcccagccaatcacccatgccacgatctcgccgacggtggtgtaggtgaaggtgtaggcggaacccgccactggaatcatggaggcgaattcggcgtagcacatcacggcggcgccgcacacgacgcctgcgatcaggaagctcagcaccaccgccggaccggcatggaaggcagccgcctgcgcgccgatggagaagatgcctgcgcccacggcaacggccacacccatgatggcaagatcccaccaggtcagatcgcgtttgagcgcatggccggactcacctgtttcagccagcgtctgttcgacggatttcttgcgaaatacgttcatgtctcgtccttctcttctttccgcccgcgcggtttcacgctccaccttctagagcacaaggcgcaagtataagtcgttttcgtcacattgacggcgtgcgtgacgctatttaagattcatgccgatgacgaccggctcgggcaccagtcggatgccgaacgcggcctcgacgccgtcctgcacggctttggcgaggcgggcgatatcttcggctgatgctcccccacgattggtcaacgccaacgtatgcagcgtggacaggccagccggagcgttttcgttgattttgaaccccttatggaagccggcatggtcgatgagccaggccgcggaagtcttgacgccctgcccgccgcccggcaatgccgcgtcgaagcgcggcgcgtcttcgggaagcgtctcggcctgctgtggcgtgagaatcgggttcatgaagaagctgccgcagctatggcggttgaagtccggaccgtcatcgccgttctgcttggattgcgattcaagagcgacatcgaccagattcgtcttcttggtgccctgcatggccggcgacgcatagcgatgcgcgtcttccagcatgcctttagccgcacgcaccttcagcaccgcgttgcggatgtccgcggtgttcatgcgatcgcccacggcgacatccaacgccttggcgagctgaccgtaaccgaccacgcccgtatcgctgtgccgcaacgcgaacgtgacggacagcaccacgtatcgcggcgtcgggaaaaattccgcggccggagtcgccggagcgctgtacatgctggctttcagcgcgctcatgcggtagccgaaggcgagctgatcgttgcgcaacgcctttaccgcacgttccttgcggtcccaaacctcgacgctgtcgacgctggtggcgacctcctgaccgtacgcgccgatgttctgcacgaccgacgcgccaacggtgccggggatgccggacaagccttcgacgccttccagtccaagtcggacgcagtaatcgacgaaatcatcccagttgcagccggcttcggcgttcacgtggacgacacgcccatcatcctcgaccggagccgcctcatccaacacgccgatggagcgtctcgcatcgcggaccaccacgccttcgaacggcgtgtcggatacgagcatgttggatccgccgccgatcacgcacaatggcagtccttgggaatcggcttcctcaacggcctcgatgacgccgacgcgcgtggtcggctccaggaaagtggcgataggaccgcccacgccgatggtggtgagatctgcaaaacttgtcataacgctccagagtaacaaaaaacccgaccaaattggtcgggtttcgaaagcttgattccgctcagcgggtctcgcgatgcacggtctgcttgccgcagcgggagcagaacttcttgagctcaagacgatccggcgtgttacggcggttcttcgtcgtgatgtagttacgctccttgcactcggtgcatgccagcgtgatgcccggacgaatgtcggcgctcttgcttgccatttagttcacctcttgtggttcgttgctataccgacattccgtcggcctttgtagcgagaaagagactcgaactcttgaccttacgattatgagtcgtacgctctagccagctgagctatcccgccatgagagcctcgagtgagaatcggactcacgacctcttccttaccaaggaagtgctctaccactgagctatcgaggcgtggcggatagtggattcgaaccactgaagcacgaggcgactgatttacagtcagttccctttgaccgcttgggaaatccgccgtgctgcctgtttggttgaaccccaaccggcaacccgtttagtatgccacagaccggccgacttatgcaaatacggcgtgtcgcgacagccaaaaacggcccaaatcgttgaaattccaacgttttacgcaaatcggcgccgaacaacgcagaaaccccgcctcccgagccttgcgaaccgcaatatacgggaaacggggtttcgacagctacgcgctagtctcagccgaggatggccaggatgtcacgagcggagacgataaggtaatcctcgccctggtagtgcacctcggtgccgccgtacttggagtacagcaccttgtcgccgaccttgacgtcgaccgggatacgctcgccggcgtcgttacgacggcccgggccgacagccaggacttcaccctgctgcggcttctccttggcattgtccggaatgaacagaccggaagcggtctgggtctcggcttccgcctgcttgacgatgatcttgtcttccaacggtgtgagtgagatcgacactgtggacctcctctttctaaagagaaatcgatacttaccgcgccgggacccgctagcaagaggctgacgatcacttacggcgtcgtcctttcgcgctgtgacttatcctagcgcgattattagcactctgccaactcgagtgctaacgctctgagagaaattatcaaaaaagcctgaaaccatgcggttccagactttgtaaaaaacggttcaagcgtttcgtcaggcgctacgacgggccagaatggcctccaggccggtgcctagggagtccgaagtcacatccggagcctccacatcggcacgtacttcggcatcgtggaatcccggaacgtcgacctctctgaggtgcacgccctcatccacgcgggcggcggcctcatcggcatccatgctgcccattgcgtcgcttggcggaatcaacggctcagcctcgtcggaaggcgtttcgacgggcacggccttggccacttgtttggtggatttgatctccatgctttccggagcatccacctcaacgtcggcaccgtcgcgaggcgcacccaacgagaaggaaatcaagtcctgcgtggacttgacggcaacggttttggcttcttcggccatattgtctcgctcatcgtggatggacagtcccacttccttgacgtcagcgggcgcggcatccgcacgttcggttgtctggtcgacggccttctcggcagtctgcgtctcttccttggaagacatctcttccttgcgccgtttcaccgcggcgtcccgatcggccttgccgcgggcgatcgcctggcgaatctccccctcgggaacgacatcggtcttcaactgctcgtcggcgaccttgcgggcctcggccagctcctgcgcgcgcagtctggcacgttccgcctgctccgcctgcgcacgtttgcgttcggcggcggcacgcttcttcaccttggcatggtatctggcgaccttccgctcccacgccacggcctgcttggacgcacgcacacccaacgcgagcaccgcggccagcaacgcggccggaatgagcgcgaacagcggactgaagtgcagtgcgaacgcacagaccagcacaacgaccgtgattgtcagcaatgagacggcgatggcgcgcctcctgcggaccgcggcgtgacgaagggcgcgaatttccgcgatccgttcttcggatgttgcgcctttgtgcgcctctgtggactgcatcagtacccctttcgctgccgcgacggtctcatcggaaaatcgcgttccgctgtcggcatccaccagatgcaacgacggtgaaaagcggtcctcgcgatgttcgatcaccctcttcatgcctttaatcgtccgtctgggcaaccaaatgagcatcaggatgacaacgatcgcaagcacgaccaccgtgcttaacgattcataacccatatgtcataagaataggtgacattccgacattcgaggcgagtcctccccggcgtgtcgaatcaggagggtgaattccctgtcatcagacgcgcggtgaaaccgtttggcgcgtcctcggccatcaatacgtagctttcatgatcgcgccattggccgttgacgtacatatacgcgcgccgcaccccctccaacgttgctccgaccttgcgtgcgacggcacgggaccgcttgttttccggcaaaatgtcgatttccatgcgatgcagtcgaggtccggtcgggtcgaacatggcccaatccgccaacagcgccaccgccatcggcgcgtagccacgcccggcgcaacgctcgtccacccaatagccgaccacgccggaacgcatcgcgccgtagcagatcgcgcccaacgagatctgcccgacgatacggccatgctgttcgatggcgaacacggcaccggtaccggcccgttcgttgcgccgcagttgtttcatccattccttgtaggtgatgggggcgccgtgcagcggatcgccggattcccacggcttgagccaggcatcgttgcgccagcgaacctcgttccactcgtcatagtcggcacccgtcaacgggcgcagactcaccgggacgcgcatgctatgcgattggatgaattccggcatttcaaaggaattattccccggacgacgcatcatgtcgctcaaggattgcaaaatcgtcacccttccattgtgccccacccataccccatgttccgttttccacgcaatcgaaccgtggtacaacgaacgatatggacatgtatgagcaacaacgcgagctgaaacggcattggcgcgcggctgcgatcgaacgacgaaagcggacgtccgccgaccagcggcgcgaagcgggacgactgcttgccgaacacgcattggaagcgtcgttgattcgaccgcgatcaaccgtcgcggccttcgcctcgatgggcagtgaaatatcgatgatgccgttgctcgaagcgatgttcgacacggattgccgtgttttggtgccgcgtctgggtgctggcatggaagtcggctggagtgagctgaacggtcttgacgatctgcgcgaccagcgcaatgctgatggttccatcaacacacatcgcccgcaggagccggaaaacgcagcggaaggaccggaagttctcacttcggccgagctgatcattgtgccagcgttcgctgtggacgaacatggtttccgattggggcgcggcggcggttggtacgaccgcgctttggagcatcgtagcagcaccgcgcgcgtggtcgccgtttgctggccttgggagccgaccgacgagaccgtgccgcatgagccgcatgatattcccgtcgacggcgtgctcacgccggatggttatgccgatgtccgaggataggacggttgcggggccgtctcagggaacgtactaggatatgtcccgttaagaaatttgggattgtgcgtaaagcgaggatatcgtgcctacttaccattaccgttgcaagaactgcaactacgacttcaccgagcagcagtcgttcaccgacgatccgatcaccgtatgcccggaatgcggcgaggagcaggtccgcaaggtttattccgcggtgccgatcgagttcaaggggtccggcttctaccgcaccgacaaatccaagtgacccacaggcgcggaatccaacgcgacacgccggagattgtggataactcccattctccgaccacaaccccggattccgcttgccgtggtcataacaatcaggtcatcatgcatgcatgatgaccttttttcattccttgatggaccgccggccacattcgagtttgcgcacatcgacggcttcggaaggacggaccgcgcgcacgacgcgtctgcaacgagaccgtcatggttcgactgccgcatcgttggaagccagacgaagcaacgcacgcctgcatcggttcctcgccgcattgtgcgctggcctgacggtattcgccacgctgcaatgcgtacgcgcagccatcgccacgcagcctattgtggtcgcggtgcggaatgtcgccaaaggcacggccatcacacgcgaagacgtggagttacgtgaggcgccgagcgatggctcgctgagcaacgccttccatacgcttgacgacgccgtcggcttgatcgcacaggtgggcatcggcgcgcacgatgtgcttatgtcgggcatggcccgtgcgtcccccgttgtgccgcagggccatacgagtatcgaagtgcgtttggcaagtgtggccggcggtttgattcccggagacaaggtgacactttccagcgccaccatgacagatgctgagatgcagtccggcacaccgaatgtcgcggatatgccgaacggtacggaaacgccgtccggcatggctaatgatatgccggacggtggtgtggatgcgcagttacacacgatctgcgccgaagcgctgctgaccggcaaaccggctaaggatgcgcaaggcaataccatcgcggtgttcgccatgccgcccaatgaggcggccgtcgtgttgcgggttcaggaatacagtgcggtcatcgccaccatcaattaatggctgataatcctaatcgatagctggcacccggctggacgtatcagcggccgcgttcggagaagaccgcccaatgtggcggaagctcgtttaggatgcgcttgtcgtcatccgcctcgcgttggcgcttggtgagcacgtccgaaggttcgagtttgacgccatcggcatcgaacagttccgtaccttggcggaccacgcgcttatgcttgcgtgcggtccgccgcgtggcggaataactgggtatggagtgtgtctcggactgggtctgcgaatcgtcatgctccatgacgttttcgatatgctcggcgctcaccgttcctcccggtacaggcttcccagtcgtgccacgatgcggtcaacttccttatcggggttcacgaacgcgccgacgctccataccgtcatcaccgaccagccaagcgattcgatgtcctgcagcagcacgcgatggcgttccctggtggattgcagtcccatgaactgcgcgtcatcggtgagcacggccaaagcgaacggctcgcctttcagaccaaccaccaacggcagtttgagtccgtcatcgaaaccgtaatcgacggccacgtccaagccgcgttcgcggatcctctcggcgagatcgttgaagagcacgttctctccggactccttgatcgccgggcggaccatgctgtcatcaagctgttcggcccaacgcagcacggttttgagcgccttcggaccatcctgatgcagtcgctcgtcgtccatatcgtcggatgcgaaggacgagacaatgtcgagatgacggtccggtaccgccaaagcgtccagcagcatgcctcggccgccgtcggattccagcgcgccgaactgctgcagcagcctgccgtgcgaggtcttggcgtagcacatcgcaagaatcgcgtcggtggcgtgggcgccggccacatcgacgatgtccacgatgcgcacgtggcgcaggaacatgcccatggccttgtctttgttggcaagcgacttgagctcggcacccagacggatgcggaacgtgtgcgtgagcgccaccacggtaagcacatacgatgcgggaacgatggtgaaaccggccgcgcgcttgcggatgatattcaccacttcgtcgatctcctgctggcttgattcgaccaggccggaattgatgaccggcacaccgttggcgtccggcacgaaatggtacgcgacttcgccttggtatccttcacgcgccacatcgcacggcacggagccgtatccttccgattcgaggaaggcgttgagcttcggcgcacggcgaaccggcctgtcggttatcttcacgcttggcagcagtgcgatcagtcgctgcaggccatcggatgtgacggtcttgcggtgcgcgatcaccacgacctgcttcgcgcgggcgatgatgctgagcagctcgatggacggaatatgcgcggccgtatcgatgatgacggtatcggcaagcggcgccgggtcggtgatggcagcgagcgtggctggcgttgccaccagaatcggctttgccgcggccaaaatctgcggatgctccctacgcagcctgttcaacggcacgtttcgggaaccggcaagcgtggtatgcagcagattggcttcctgcgtgcgggagaaaagcatgtcgcacagacggcgtacggactcttgggcgaccatcggtccgatggaacgcacgtgttcgacatccacctgggtgaatcggtcggcggcgctttgcatggcggagccatcctggttggaaatgatggcggaggacttcacgatgtcttcgaaagctgtggtccaccacgccagctgcagttctccggccacggcgtcgttcggcacgccgcggttgctcaggtccgccacaagctcatccagaccggccgaatggaactcacgttccagacgggcgcgttccggcagcgtatccaacgcctgcttgtcgtcatacagggccttcagacgctcttccacctggttgaggtcgacggtgtccagattgccgccctgcggtgtggtggcgagcgccacgttcaacgcggtcatatcgttcgtcagctggtcctgcgtgttgatgatgtcgtcgagtttggcgggcagcaccggccatccgccgtgaggaacgaacatgtgccactgttcggcctgcttggccaccacgagcagcgcctcatgcaggttctccacctgcgcgccgacgcgcagcatcgacttggcctccttgatatggcggcgacgttcccagaatcccatggagctgccttcggccttgcgctgggccttgggcttggtggcctcgatcatggaatcgatgtcgcgttcgaagatttccggctggaagacgtcgagcacgcggcgcaggttcttgagcaccatgacctggcgtccccactcctgcgcggtggtgggaatcgggaagccgcaggtctgcacggtgctggacacctgtttgcgggtggcgggcagcaccttgcgcagcagctcgaccacacgctggtatgcgctgaccgcttcctcttcggaatacagggaggctttgtaccaggcggtgtcctgcgcgccgatggtgtattcgccgagttctcccgcgcgatacagcttctgagcccattcctccatcttgtccgcgatggaatgggcggactgcttggccagacgcacatgcgtggtcggatgcgtgggcaggacggcgatttgtgcgaggttctggatggtctggtatgcggacacgccccattcctggctgacgccgtgcaggtcgcccagatagcgggccaggcgggaacgcacacccaccagctcatccgaaatctggtcgaaacgcgaagtcgcgacgccggattggaaaccgactgcggctatcagctgacggtcgattgccgcattggcgccgtcatcggcgatgtccagcaattggccgctcatctcgttggccgcgatcgtctgcatgaaacggcgcttttggtcggtgacgcacggcacgtacagcacgctgtgtccgcccatcacgcaacgggaggcgattgccgcggcctgttcggccgtgttgccgctgatcgcgctgtccacgaaaatcgaatgcccggatgcggccagctgcgccgcgtatcggacggtgttgtcaacgtcgccaatctcgtattcgccatggggatcggcgtcgaacggactgtattcgggaatctgcgcgtctttcagcgcgtccgcggcttccttgttcccggcgagcgcgtccaggacggtgttgcctgtcgggccttgggacagctggttgatgatctggcgactttccaccagcatctgcgaggacgggtccatgaagcagccgaggatgatgtgacgttcgatttcgaaatcggggaaaacgctggacgcgcgcgctgtgatggccgcgaacaccgcggacgtttcgggggtgccgctttcgtaattcgaaccatcgaagagcttggtctcgtccaatgtcacgttgttttcacgcatcacggcggcgaaggccgcgttcagacgcactcgtccggtgaacgcgatgacggtgccgttctcgatgttgcggccttccttgcgcacttcgaccggatacatgagcaccggcatctggttgcctttccaaatggccacgccgaccaccaaggagagttcgccgacgccgctgacacggcttttcgcgtcacggtcgtcgagcacgcgttccacacgcctgcccgcggcgcgcagcatgccgttgtctcggaacaacgagtccaaggtgacgtgtcctttggcgaacagctgcgcgatgcccgatgggtgcgcatgcgtcaggtcaagctgggcgctcagttgcgtcacatcctcaagcggggatggtgccagaccaaggcgatactcctcacgccatccgcggatacggtccaacgcggtggccgtctcttcgttttcgctcatataccgactcacttccctactgccttgcggtattcctcatatcccggattgtgtgccaaagccgcatcgatgtcttggttgcccaatgcgcccaaccacgcgtacaggtcatcgtatagggatgggttcatggcgaggaacggcaacagttccggatgacgcgccatctggaactgcactgtgaaatcatccgtgcgtttggcgtcatcggaggtcaggccgtcgacctcgatggtctgctcctgcttggcgaggccgcctttggacacacggtcgaataccgatcccggttcgaagatcggcttgaatgcggcggtttcgtccggcgcgggctgcgattggctgttttgcgggcggaaccgctcgtcgtcgtcttccgcggccaccgttcccggctgttccgtctgcggctgcgtagcgtgcatcggcttcgactgctgttcggcgggctgctgttcggcagtttccgatgtgggctgttccgccatctgcgattgttcggcggactgcgtctgttcctgggcggacgcgtcagccgcattgtcagccttgtcaacgttgcctgtgttatcgccagtgtcgttcctgtcgagcagagcgacggcgattggcgtgttggggcgcgcgctgaacagcttgtccaccggaatcaggttgttcttgttaccgtcatgggatgcttccaagggccgagcggctgtctcggttgagacggcagccacctcggcatcggtcgcagccgcatcagcggaatcggccgcatcggcctcgatctcagcttcagcctcggcctgcgctgcggcgtcggcgaacaggtcgcggggcttgtccgcggccacgacggtttcctgaaccaaggagaccgaggggaatgcatcttcgagttccggcttgtcggcatgctccggcgtgaaggtctgacgttccgcctggtgcagagcatcggcacggtcggtgacattgcgcgcgtggaagaacgtcgtcggctcgccggcacgcagattgaggatgtcgtccacggacatgtcggctgcatccggttcctgcggagcctcgtcggagaccgcgtattcgaacaggttcgaaaccggctggcttgtatcatccgagacaccggaggtggcgtcgtcatcctcgtcatcgtgttcgaatgcggattcgagcgtaagacgcacgtcgccgaactgcagggtcatcgagtcgatgggcagcttgatgtcctcgcctgcgggcaggcgcatcagttggccgttgttcgtcaccacgaacgagccgttggtggaatgcagatctcgtacggagcaattgccctgcttgtcgacggagaggaccgcatgtcttttcgacatggacttgcccggatccatgatgtcgagacgagcgaacccgtcatccgacagcgggcgcaacggtttgcgcccgatttccacgctttcgccgtcatgaagcgttttcacgttgtttccgtcaactttgacggtccactgccgcgtcattcgtcgatcctcgctcaccgttgtcggccttcctttcgcactacactatctgccattgtgtcatgattcatcgcgaaagtaaggattccgaaccgataaattgacaactttcgcctaattcccccattttagaacatgcctgagtcatgctccatatgcggaaaaccccgctgccttacggcaaacggggtttccactacagcttggtgattgcggcttgaagccgcgcgaatcacttgagctcgacggtggcgccggcttcttcgagctgggacttggccttctcggcgtcttccttcttggccttctccaggacagccttcggagcgccgtcgacgagagccttggcctcagccaggcccaggttggtgatagcgcggacggccttgatgacctggatcttcttgtcgccaacggcggagaggatgacgtcgaactcgtccttctcttcctcagcagcagcgccagcagccggagcggcggcaacagcggcgaccggggcagcagcctcgacgtcgaacttctcttcgaaggccttgacgaactcggagagctcaaccagggtcatctcaccgaaagcttcgagcagctcatcgttggtgtacttagccataatggcttcctttcattcttggcgacggactgaattgaagaggtggccgtcacctaaaacaattgttttttcttttttgtggttgcttcattcatgcggcgagccgcagcgaaatcaggcagccttttcctgcttctcgcgcagcgcatcgatcgtacgcacggccttggtcggcagagcgttgaacaggtacgcggccttggacatcgtagccttgatgtcgccggcgaactcggcgagcagctgcgggcgagacttgaggtctgccagcttcttggcgccttcagcatcgtagacggtgccatcagcgaagccgcccttgatgatcagtgccttgttggtcttggcgaagtcacgcagggtcttcgcagcttcgatgaagtcacccttcacgaaggtcacagcggtcgggccggcgagaagttcatcaagaccttcgatgccagcttccttggctgcaatgcgaacgagcgtgttctttgccacagtgtaggaagtatcgcggcctagcttttcgcgcagttcagagatctgcggaacggtaagcccgcggtactcggtcaggtagatagcgtcggcgtcacggaacttgtccgtaagctgagcgaccaccgcttccttttcgggcctcttcatggcgttccttccttagtcaaccgttgactgtgagattcggaacacctcgcagggcaataaaaaaagccctgcacgcaggcagagcaacattcgaccgctaagcggaaagcccttggtgggcgtatgttcttcaacctgcgctggcttggcgaaccaaacttcgtgagcgcttgcacgctccaaccaacggtctgtggtttacaagtgggtaatttactgacccgtttggactaatccagaccggcgtgtcgcgccgccgcaaaagcaaccccttaccaatcgcacgaaatttccatgacttacataggtgctacgtttgctttgttcagggacgcatgtcccaggcgagtcgcgattctcgccggcgcacgccaccatatggcacgcgcctaccaacccaagaaagatgagaaaagagaaaatggagaaattcttccatctcaaggagaacggcaccaccgtctccacggagatcatggccggcctgaccacgttcttcgccatgtcctacatcatcatcgtcaacccgcagatcctgtcttcgaccggtatgccgtggggcggcgtgttcctcgccaccatcatcgcggccatcatcggcacgctcgtgatgggcctgttcgccaacgttccgtacgcgcaggccgccggcatgggcctcaacgcgttcttcacctacaccgtgtgcttcggcctcggcttcaagtggcaggaaaccctgtgcatggtgttcctgtgcggtttgatcaacatcatcatcaccgtcaccaagattcgtaagatgatcatccaagccattccggaagtgctgcagaacgccatcggcggcggcatcggcctgttcgtggcctacgtcggcttcctcaacgtcggtttcttcaccttcaccaccaagtccgcggccaagagcggcgacaccgtgcaggccaccccgggtcttgccgtcatgaacaatccgaccatctggctgttcatcatcggcctggtgctggccatcgtgctcaccgtgctcaaggtgcgcggcggcatgctgatcgccatcgccgtcaccgcggtcgtcggcattccgatgggccagaccaccatggccaactccgtgtccatcgccgacaccttcgcccagctgccgcagaccttcggcgtgatcttcaccaaggatggcttcccggcgctgttctccgacgtgtcgaagctgccgatcatcctgctgaccatcttcgcgttctccatgtccgacaccttcgacaccatcggcaccttcatcggcaccggccgtcgtaccggcatcttctccgccgaggacgagaaggctcttgagaacggttccggcttctcctccaagatggacaaggccctgttcgccgactccatcgccacctccatcggcgccatctgcggcacctcgaacaccaccacctacgtggagtcctccgcgggtatcgccgccggcggccgcaccggcctgacctccgtggtcgtggcgatctgcttcgcgctgtccgccttcctctccccggtcatctccgccgtgccgtccgccgcgaccgcaggcgtgctggtcgtggtcggctgcatgatggcttcctccttgaaggaaatcgagtggggcgacatctccgaagccattccggcgttcttcgcgtccgtgttcatggcgttcagctactccatctcctacggcatcgccggcggcttcatcacctactgcatcgtcaagacctgcaagaagcaggccaaggacgtgcatccggtgatctgggtcgtggccgtgctgttcattctggacttcatcatcaccgcagtgctgtaacagtccttttcatacggaaaatgggcggttccttcagtggaatcgcccattttttatatcgactttcgtatcggtttggcgcagatccgcattagatggcttgagagaacgcgtcgacgagcgcggccatccagtccgtcagggaatcgtactgctccggcatctgctcggtcagctccacgattggaatattggacgatttggcggcggtgacgatcttgccggtcagctcggtctcctcctgaatgttgaccaccagcaggccgaccttgccggcttccagcatgtcggtgaactgtttgatgtcggtcggcgttggctcgctttcgttggccgtggcacgcgtgtagccggtcggcgtcgcatctttgaggcccaggtccccggccagatattcggcgaccgattccgtggcggcataggcttcgccatccgccttgcgtttggtctccgtgatttttcgggcgatctcgtcttccttggaacgccattgctggttcagcttgtcgaaatcggccttgccgtcgggccttgtgccctcgtatgccctggtgatggcctgtgcgaccgctttgcgcaccgccgccgagaaccagacgtgcgggttgccgccatccttgacgccaccgatctccgccgcgttgatgacttgcgatttggcggattgcgcggctttgacggcccatgagtcgtacccggcgccgttgacgatgacgattcgtgccttctgcagtttggcgatgtcggacgtggtcggctcatagtcgtgcgcgtccacgttggtggagttgatgatgctggtcacctgcacgccgcttccgccgagctgctcggcgagggtgccccattggttgatggaggagacgacggaaatcgcgccatgcgcggaaccggcaccgttctgcgacgttccgcaggcagacgcggaagtgagaaggccgacggaagcgagtacggcaatcgcaattcttgcataacggttcacgatggttcctccattttcatacgcttcatgcttcggtgaatccatcataaccgtaactgagaatgattctcaacagcgcgtgtcgcttccacaagaaaaacaacgaaccgacgccgagagcaatctcaacgtcggtttgcggggaaaaggagctgccgatcagccaaaacgtacaattacagagtctcgcacagcgaagcgctattaactggccagctgaagctgactcgcaccaacccaccgggttggcactacgttttggcgaatcggccttatcgatcagccaaaacgtccggagacgtagcgttcggcttcttcgttctgcgggttgttgaacatcgtggtggtgtcggtgaagtactcgaggtgacccggctggccgacggccttcaggttgaagaaggcggtgtagtcggcgatacgggcggcctgctgcatgttgtgcgtcacgatcacgatggtgtactcgttcttcagctcgttgatcagatcctccacggccagggtggagatcgggtcgagggcggagcacggttcgtccatgagcagcacctgcgggtgcacggccacggcgcgtgcgatgcacagacgctgctgctggccgccggacaggccgatgcccggattgtccagacgatccttgacctcgttccacaggttggcgccacgcagggcccactcgaccagatcatccgcgtcggacttggagatcttgcggttgttgagcttcacaccggccagcacgttctcgcggatggacatggtcgggaacgggttcggacgctggaacaccatgccgacgtcacgacggacggcgaccggatccacatccttgtcgtacaggttcttgccttccagcagcacctcgccttcgcagtgggcgcccggaatgatctcgtgcatgcgatcgagggtgcgcagcacggtggacttgccacagccggaaggtccgatgaacgcggtgaccttgttggcttcgatgttgatgttcacatcctccacggccaggaagtcgccgtagaagatgttcagatggttgacatcaatacgttgtcccatttgttttccttattgttcttatgttttcgactattcgaccgcgctcagcgttccgacttgacggcgaagatcttcgccacgagacggccgatgaggttgaggatcagcacgatgaggatcagcacaagggctgcggcccaggcgcgttccatcgggatggtggtgacgcaggccgcggaagcgttggccgggcagttcgcgttgagcttggaatactcctggtagacgtacaccggaagcgtggtcatctggccggagaagaggttgacgttcgtggaggcgatgtagcctgcggtcatcagcaacggagcggtttcaccgatcacgcgggcgacggcgagaatcgcacccgaaacgatgcccggcagggcggtgcgcagcacgatcttcgtgatcgtgcgctgcttcgtgacgcccagggcgtacgaggcctcgcgcaaatcgtgcggcacgatcttgagcatttcctcggacgacttgaccacggtcggcagcatcagcagggaaagtgcgacggagccttcgaaaccgttgatggtgccggggccgatcagaatcgtgaacatcgagaaggcgaacaggcctgcgacgatggacgggatgccgctcatcacgtcgaccagcagggtgatgacctgtgccagcttgccacggttggaatattccaccaggtacacggcgcacatcaggccgatcgggatggagatgagcatggcgccgaaggtgatttccagcgtgccgatgatggcgtgcaggatgccgccgtagccgccggacggggtcgggttgccgccgaccacgccggtcatgttgtagctcaggaagttgaggttcagcctcttgacgccgttgatgatggtggtgagcagcaccgagaacagcgggatcaacgccacgatgaacgcgcacgagatgagcgccttcatggcgaagtccttgcgcttgcgcgctgaggtgaaggaacgggtcggcttgaacttgtcgaagtcgatgacgggagcgccgtccatcggcgaagcgtcgttatttgcggcggtcatcacacactcgctttctcggtgagcttacgagcgatgaagttcaccacgaaggtaatcaggaacaggaccaggccggtgccgatcagcacggaaacacccagatcgttggcttccggatactgcgcggcgatgttcgcggcgatggtctggttctgcgaggcctgcagcagcttgacggagtagttgaggcccggagacaggatcatgagcacggccatcgtctcgccgagcgcacgaccgaggccgagcatggaggcggacacgacgccggacttgccgaacggcaggaccgcgagcttgaccatttcccacttcgtggcgccgagggccagagccgcctcttcctgaaggcgaggggtctgcaggaagatgtcgcgggacatggaggtgatgatcggcaggatcatgacggccagcaccacggacacggtggccacggtacgggagggattggcggcgggaccggcgaaaatcggaatccagccaaggtatttggccacccaattccagaacgggtagatggcgggcaccagcaccagaccgccccacagaccgtagataacggacgggatggcggcgagcagatcgaccacatagctcagggcggtggcgagcttcttcggcgcgtaatgcgagatgaacagtgcgatgccgaccgacacgaagaaggaaatcagcagtgccagggcggaaatcagcacggtaccgaacagcagcggtccgacgtagccccagaagctggaagccttgccgccggtgaagttgctgatggtcgcgctgttggccttctggtcaccgccgatcaacggccacgcgcggaacagcaggaacagcgcgaccgcggcgagcacgacgaggatcaggatgccgcaggcgtaggccacgcccttgaacaccttatccgcgttcttgccgctcaccggctgctgtgccgttttgctttgcgaactcacgggttctccttttggtttgcttgcgattgctttcgatttttctggttttgcgtatcgtccgtaggtatcgtttcaggccgcagccgttttttacgcggctgcggcctgaaacctacggtcagtcaccgatcacagaaagcgatcgccccactgtgatgggctcacttggttttgatggcgtcgatggacttgacgaccttctgacgcagggtgttggacatcggagcggagccggctgcggaagcggcggtctgctggccttcgtcgctggtcacgtaggtgagccaggacttgacgaacttggcggtgttggcgtccttgtatgccaggcaggcgacgtcgtaggagaccagcacgatcgggtaggcgcccttctcggtggtgttgtggtcgagcttgacgaccacgcggttgtcacccttggcggaatcgtcgagcggggaggcgtccacgaccttggcggcggcttcagcggagaacgggacgtaatcgtcgccgaccttcacggccacggtgcccagatcgccggcctgggaggcatcggcgtaaccgatggtgccgtcagcctgctgcacggtggagatcacgccggaagtgcccttggcgccctggccgacctcgttcggccagttctcgccgaggtcgtagctccatgcgtcgccagcggcgtccttgacgtagctcaggaagttcttggtggtgccggacttgtcggaacggtgcaccacggtgatgtcgaggccaggcagatcgaccttcgggttctgcttcttgatggcgtcatcgttccacttggtgatcttgccgtcgaagatcttggcgatggtctcggcgtccatgttcagggtcttgcccttgccggacacgccctgcaggttgaagacgacggcgatcggggaaatgtagaccgggatgtcgaaggcggtgccggaagcgcacacgctcttggactgctcgacctcgttatcggcgagagcagcgtcggagccggcccatgcggttgcaccggtcaggaaggtggacacgccagcgccggaaccggacgggttgtaagcgaccttggcgtccgggttggtgccctggaagccggcgatccaagcttcgacggcggcctgctgggaagaagcgccagcgccggagaagttgccggaaacggtttcggtcttggtatcggacttggccgaagaatcggtggaagcggtggtgttgtcaccgcaagccgcgacggaagccagcatcacaatgccggacacagcggcgatggagcgtacgagaatggagttacgcattattcttttccctctgtcaacgttcagatggcgtgtgtttctgatttttcgattttctgttgtcgccatcgttcttcatgacaatctccagcctattgggcgtttcactcgccccaaaccaaaaacggtgaacggaagatgaacagtctacgacaccttcgccgttcgacgttccttccgttcaccgttctttgcaagcacgatgcgaatgcgcgctataccaagcctttcatcatcattcgcttggcgtatcgatcttgtatccgaggccgcgcacggtggtcagatacttgggatggcccgggtcctcctcgattttggcgcgcacgcgcttgacatgcacgtccagcgtcttggtgtcgccgacatagtcggagccccagatgcggtcgatcagctggtggcgggtcatcacgcggcccttgttctgcatgaggtattccagcagttcgaattccttcagcgggaagaacacgttctcgccgcggaccgtcacctcatgctggccgattctcatggaaatgtcaccgcatacgagcggaatatcgtcgtcggcggcttctccggattcggcgaccatctggttgcggcgcagcaccgcgcggatgcgtgccagcagctcacggaaggaatacggtttggtgatgtagtcgtccgcgccgatttcaaggccgacgaccttgtcgatttccgcgcttttcgcggtcagcatgatgatcggcacacggctttgctcgcggatccgacggcacagcgcggtgccgtcaagaccgggcagcatcagatcgagcagcaccagatcgataccacccttggtgaacagttccaatccttcttcaccggtggccgcggcggacacgtcgtacccttcacgggtgagctggtagaccagcggctcacggtacgactcttcgtcctcgacgatcagaattcgcgtcatcagtggttctcctcattctctgttgtggtggagtggtcggactgtttcttttcacgggtgttatcattcgccgaatccgccggatggtcgggttccgcagcgcccgaagcctgcggcatcgtgatggtgaaggtggatccctccccctcgcgcgaccatacggagatggtgccgccgcaatcctcgacgcaatgcttggtgatggccaatcccaggccggtgccgccggtttcccgggagcgcgccggatcgacgcggtagaatcgctcgaaaattctgctgagcgacgccgcggggatgccgatgccctggtccacgacgcgaatcgccaccttgccggattcgatgccgatgccgacggccaccgtggtatgttccggcgaatagttgatggcgttctccaccaggttcttcaccgcagttttgatggtctcatggtcagcgaccacgaacacgtccaggttctgttcggcttccttggccagttcctcggcgttcgcatgcaccagcacctgccggccgttcacggacaggaccaggctgatgtgcttcgattcggccttgacctggttttcggcgagcgcctcgcgtgccacggacagcacggacagccgttccgcgttgagcatcgctgccgcgctttgcgctttctgcaggtcgatcagacggtggaccagttccgtcaatcgttcggattccttggagattcggccggagaagtatttcaccgcgtccggatcgtcggccgcgtcgccgatcgtttcggcgagcagagaaatcgcgcctgccggggttttcagttcgtgcgagacgttggtgacgaaatcgcgccgcatgatttcgaaacggcgttgctcgctcatgtcggaaatgaaaatcgcaaataggttgtcggcgatctgtccgacgcgcacgtgcaggtagagcgtgtcttcgggcaacggcttgccggcttcgacgcctttgccgttcgtgttcaccacgcccgttcgcgtgcggccgtgcagggggatggtcagttcgcgttcgcgcaccacgctgtctgtggagaccagtttcacgatgtcgcggatttccgcgagcgccatcgcctggtcgtggatgatgccgaagcgccgcgcggccggggatgcgtattggaccgtggccagcgagtctacgaccaccaaagcttcgggcatgacggccaccagctggcgttccgtggactgcacgggaacgcgggggccgaacagggacgtgttcttcgcagctccgaacaggctcggatcattggggtcgacgccgtcctgcacatcctggaagccttgtctgcggccaagcaggaacgccacgacgaacacgaccacggccacgaccaccaatgccgcaaccaccgacggcgttgccagcatctgctccaacgtcatgcgttcaccttccgataatcctcagttcttccttaagactagcggtttcggagaggctttcgcgtatgcgattctctcacgccaccggaagttttcctgccgttcatcttccgaaacgcagcatatcggaatatgagacgtcccgtttgccgatatgacgatgcatgatgacgggtcatgcggcaaacgggatgtggaaacggcttttcgcaacgttaggcgtttcgcaacgccacatgaacgctacatgcgtttggcgatgttcaccgtcagtttcgcggcggtgtccgcgtattcggaaatgtcgaacgttttgaaatcctcgtagtcggtgtccgcgttgtcgctcagcgcgcgaatcaccaatgcgggaacgtcgttgcgggcggcgacatgcgcgacggcggcgccttccatttccaccgcgtccgcgccggtctcacggatcacctgctcgaccttctgcggatcatcgacgaaatagttgccggtggcgatgatgccgacgatatggtgaatgttcaagtcgttcagcgcctggtcggccagttcgagcagacggtcgtcgctatggtattcctcgatgggccggtcggcggtgccgggcttgaattggcccactaatcgcatgtcggtgtcgagatagcgcagggtgccgccgagcaccacgtcgttgatgtgcagattcgtgttgagattgcccgcgatgccggagaagatcacggcgtccggctggtcagcgtcgatcagatgctgcgtggtggcggcgatgttgacggtgcccatgccgccgacggtcgcggcgacgttgacggcggtgcccttgttggtttcgagggtgccgcgcaccaccttgacgccggcttcctcggtgacggtgacgttgctcagtgccgttgcgatattggcgacttcctcatccatggcgccgatgatggcgattgcggtcattgcactctccctgtcttacgtgctgtcttgagtgttgttttacgcgattgcgattcgcgtttcccgaattttctgcaatcgcgcggatagtgaatcgaatcggtcacttccagcggcgcgcggccaccgcatgggcaagctcgcgtagcagctgttccgtggtgttccagctcaaacatttgtcggtgatggacttgccgtagacgagctggtcgagcggcgcggccttctggttgccgccttcgatgaagctttccatcatgatgccggtgatgccctgctcgcctttggcgatacggcccgcgatgtcacgcaccacctgcgcctgacgatgctcgtccttgccggagttgccatgcgagcagtcgacgatcagcccatgtgccgcagcggaatcggccggcatttcggcgcggatggtgtccatggccttggccaccgaagcggcatcgtaattcgggccgtgcgaggaaccacgcaacaccacatggcagtcgggattgccgagcgttttgaccacggcggcacggccgagatggtcgatgccgaaaaacgtgtgctgttgtgcggaagcgaagcaggaatcggccggagccttgatggaaccgtccgtggcgttcttgaagccgatcggcatggacaggccggacgccaactgccggtgcacctggctttccgtattgcgcgcgccgatcgcaccccagctaatcgcgtcggaaatatactgcggactggtcggctccaaaaactccgtggccgccgccaaaccctcgtcaagcacgccaagcagcgtgcggcgggccaacagcaagcccttcctgatattgcagctgccgtcgatatccggatcgttgatcagacccttccaaccgaccgtggtgcgcggcttctcgaaatacacgcgcatgacgatcagcagctcgccatccaactcgcctttcaacgcggacaggcgacgcgcgtaatcgagcgcggccttcggatcgtgaacggaacacggaccgacaaccaccagcaggcgatcgtcctgaccgtacaggcaggcacgaatctcatcacgcgaataggcgacgatctcctgcgcctgctcgctcaacggcaggtcgcccagcacctgcgccggcgtgggcaacacttcgaattccagcacgcggcggttcacgatgcggctgatgcccacctggtcctcccagcgcggcacgtcggtctccaccagcggattcttgccctcatccatggcctgcctaatggcacgtaaatcctcaggcgtgttcagctgctgctgcatgatctcgctctccttgtcgcttcctttcccaaggatagcaacgatggtgcagaaacatcagccaagcttgcgacgcgcgtcgaccgcgtcggcaagcgtgtgcagcagctgctcggtacgatcccacggcacgcatgcgtcggtgatagacttgccgtattccagctggtcgagcggcgcgggcttctgattgcccgccttgaggaagctttccatcatgatgccgagaatgccctgttcgccggccgcgacgcgtgcggcgatttcttcgaccacttcggcctcgcgcacctcgttcttgccacagttgccgtgcgcggcatcgatgatcagaccatgctcgcttggtccggaagccttggaagccttgagatccgccaacgcttgggccacggaagcggcatcgtagttcggaccatgcgaggaaccacgcagcaccagatggcagtcgggattgcccttggtctccgcggaaatcacacgaccatccagattgatggagaggaaatgatgctcgaaagcggccgcgaaacacgaatcggccgccggcttgatggaaccatccgtagcgttcttgaaaccgatcggcatggacatgccggacgccagctcgcggtgcacctggctttccgtattacgcgcgccaatagcgccccagctgatcagatcgcaaatatactgcggggtaatcggatcaagccattccgtagcggcgggcaagccgagccccagcacgtcggtaagcaccttgcgagccatgaacatgcccttgcgaatattgaactggccgtcaagatcaggatcgttgatcagacccttccaaccgatcgtggtgcgcggcttctcgaaatacacgcgcatgacgatgaccagacgatcatcaagctccttcttgacggcggcaagcctctccgcatactcgtgcgcagccttcggatcatgaatcgaacacgggccgacgatggccagcagacgatcgtcacggccatgcagcacgtcacgaatctcctgacgggacttcaacaccagatcgctcatctcgttcgtgagcggaagttccttcagaaaatatcggggagcgggaatcgggtcaagctgacgaatattgacatccacggtctccggaaacacggcgcgctcatccaacagctgtgcatccttcgaactatccggaccgcgaagacctgccatcgcttctgttcctcccctgcatcgttatgcttgcgtagcgcgatagcgccaccgtcgttaccttaacggatggggacggaatatggggatgggcgactgcatggtggaatgggtggggggtgacgtgggacgaagaaagcgatataggaaagacccaacgcggacggagagtccgggttgggtctttttttgggggaaacgtgcgtcatggggcctgccgggctgaggcgatgaggcctgcagcctcgaaaacgcctgtcggcgttttccctcgcggcggaagcccaccgggcttccgctattcgctcggcgcgtattggccagcgcgcgctccgcgcgctatttggccaatgcgcccatcggatcccacgcggggagcatggtggcgggttcttctagggccttgaggtattcggcgggaaggagggccttggggacggcgacctcgtagacgtattcggtgaaccagtcgtcgctcatggtgaagtagcccttgtcggcgatcttgtctccccacgagttctccacacgccaacggcgggtggtgtggccatcctcatccacatccacaccgacgaacgccatcgcgtgattcatcgcggaatcgccgaaacggacacgctgttccttgtccagatcgaaatcgacgccatacacgcggccatactcgaacaggtcggtggcccacgcgccattctcacggtccatcatcggatggcagtcagcgccgaaccataccggaatgccctgttcctgaagaatctgacgcacgcggtccttcatgaactggttcggcacgttgaggtactcggtcgggtctcccccggccacgttgcccagatgctcgatgccgatcttcttgcccttgacgtgctcctgacgcggatcgtccaccaggcagacatagctttccaaatcggcggaacccacatacttcttccagaactcgacaggcgtgatctcgccatcgcggtggaactcgccatccttgtcggtccactcccaatcgaagctcttcggcggctcgcccaagtgaatcgtcagaatacggtgaccggcggcgaccgcatcggcgatgatcgcatcgatcgcggacggatcagcgtacatatgcgcaaccgcggtgtgcagcatgcggcgcagctgcacgttcatctcaccggtgttcttggaggattcggtctccgggaacagatccttcggcaccgcgccatacttcttgtacacgttcatggccatggtccactggccgccgtcgcccatcacgtcggacagcagatgccgcatcagacgcgaatcggcaggctcgccggcctctaccagagccgccacgtccttcaggaagtagttgacgcgttcgagcttgtcgtagtacatggcgtagttctgggagaactcgaactccttgagacccatgttctgcttggccacgaaacgggccacgttcagcgagctgaacagccagcaacggccggaacggtcctgatgggtgacggtgccgttgtccacgacggtggagaaacgacgctgcatcagacgggcgcgatcgtagttgcgcgccaccttgtcgatgccggccgccgtgacggcgttcatggccatgcgattgtgctcgcttgcttcgaaatcgtcgacgagcttgttcagttcatcaccgctcaatggcgtgatgtcggtcattatccattccctttctatggtttcagttgttctgcgaagcgtctgcggattcggcgtcgccttccggctcggtctcggctgcggaatcgttctcgacggcatcctgcgtgtcggcgtctgccggtgcggcggtctcatcgtcgtgctgcgcgtcgtcatcagattgcgcgtcggaaggctcgccttcatcgacggcgttgaccacggacaggtcgttcatgccgaaaccggagaacgcgttggagaacatggcacgcagttcgctgacgcgctgcgtgatctgggcctcacggctctgcaggtcggcgatgcgctgctgcacgccgtccagttccttcttcgcggcctcacgacgctcgttgatctgctcgtcggcgtcttcggtggcctgcttgaggatgcttgccgcgttcgcgtccgcctcgtcacgcttgctggaagcgtacgcctcagcctcgtcacgggtcttctgcgcggaggaaatcaactcgctggcctgcttgttggcggcctcgcgacgctcgttcaggtcggtgagcagctcattgaccttcttcgtggcctcctcctgctgggcggagatgtcggcgcggatctgctccacttcggcgttgacctggctgatggtcttggtgcggtgcacttccgcctcgtcggtgatctcctgggccttcgccttggcggtgtcggtgatttcggcggcacggcgctgcgcgtcggtcatcatcttggacacctgctcgcgcacgtccgccagcttcttgttggcttcggcaagcgcggattcgatctggtcgttggtctcgctcttcaggcgggagatctcctcattggcgttcttgcgctgttcggcgatcttgctggtcgcctcggtgcgcatgtcggaaatctcacgttcctgcgtggcgcgttcggcggcaagacgcttgccgtgttcctcacgggagttggtcagttccagatcgacggtctgacgctgcgccaccacggccttctgggcctcgctgcgcatctggtcgacctcatgctgggcattggccctcatggcttcggattcgtccttggcgtcaccgagcaccttggccgccttggcgttggcgtcgtccatgatgcgcttggcgtcgattttggcgttgttcagcagtgtttcagcctgcagctgcaccgtggcgcgggccgcggaagcgtccttcttggctcgttcaagcagctcggcgctggtctgttccgcgctggcgagcatctgctgggcgttggcgcccagtgacgcgaaggacttcggagcggccttcttgttcttttcctcctgcagctgcgcctgcagctcaaggatggtctggtcgtcggccttgacctgctcacgcagacggttcaccgtctcctgagccgaagcgaacgcctcgtcgactcgatccttgtcgtaccccctcaacacgattgggaactgctcaaccatgcccttttcctttcacgaattccctacactttgcgcatctgccagcgcgcactcgttcagtactctatctcagtcagcaggcggcacgcaggacgaaatgcattattctcacagagagcacagaaatcgttcgaaaaagtctgtcgggggtatggcggtatgtccgcgaccacgtgtcgaaaccgcatgactcacatgtcgcagaaaatcgtgccgtagaaagcggagccgtcctcagccaagcagaatgtcgcttgacgagggttgcaggaagtatcgtaccgattcacgcagcacgtcatcgaccgcagcggtctgctgttcgatcgacagtccacgttcgtgcggccgaccgttgacgatcggcaggctgacgaaccccgacagaatgcgacgttcctggcccgccggccagttgagcagatggtagaacagcgaattgcatacgaacgtaccggcgtcggaactcaacgcggcgggaatctcgtgtttggcgaaatcgtgcagtatcgaccgcaacggcaggcgcgtccagtacgcggccggaccttccgggtcgatcgggcggcggggcggaatcacgttgtcggcatccggcttggccgcatccatgagatttgtggcgcatcgttccagcagaatgccacgggaggtgcgcttgagccctgtggcgatgacgatgtccggcttggcctgttcgatggcttccagcagcgtgggccaggctttggcgaagctcaccggaagcgtgacgttggtgacggtgacggcgatgtcctgcagcagttcttcggagatcgcctgcgattgcgccggatcggcccattgcttggctaccgccgccggcacgagcacggccggattgacgtcgatgccttcatagggcgtgaaaccggagatgacgatgttgatctgctgcatggtttccagtgtacgtggtgaatgtgttgaacgttaagtctgccgacacgtcgacggacttaacgttcgatgaaaatcaacggctgtgcatctgggagaacgcttcggcgaacacggcgtgcatgcgcgccttggcttcctccttggcgtgttcggggtcgaggctacgggcgatgccttcggcgatcggcatgtcggatggcgtggtgattttgaggttcgtttcggaaccgtccacgatggcgaccggctcgtcgggcaggtagtccaccaccacgcgcgtgtcgtcggtcgggtggaagtcggggtcggcggcggccagttcgtaggctttgacgatggtgccgaaacggaacgcctgcggggtctgcgcgcggaaggtgttcggacgttccggcacggatttgaccaccttgcggtcgcccagatcctctgtgagcagaatcgtgtcggtggaggcgtaggccacggtggcggcgttgaactggtccaagctgtcgatgcagccgtcgatggaccgctcctcgacgaacggacgcacgccgtcatggatgaggattttcgcgccggagggaatgccggcctgtttgagcaggtccagggcggcgagcgtgctgtccacgcgttcggcgccgccgggaacgatggcccgcactttggcgtaaccggcttcgtcgataagctcgttcaccgtctcttcgacacgttcgttgaccaccacgatgatgtcgctgatgcggtcgttgttttcgaatgcctcgatgctccagcagacgattggcttgccgcccaccgacaccagctgcttggggttgttctcgtcgaatcgggtgccgaatcccgctgccagcaccacggccacgaccggcatcttctgttcctgcatctgctctcccttactcatatgctccaccgtaaagccgcggccgcatgccaccccgttccgcggcgggttctgcacgcaatccgcaacagtggccacgcgaatcactcgaatcgcgtggcttgtatggctcgtatggtgattattcgcgtacgatcagcgccagcatgcgtccttcatgctgttttttggcgagcgacgcgcggcgatgcgagaaccacaacgggttttcgagcgtgcacaggctgcggcggatcttgttgaaccgttcggaaagcttcggatcgccttcgccatcggcggcgcagatgccggccagttcctcgtcttcggacaggtactgcgtggccgcgttgacgcgtggacgggatgagacgatgttgtcggccggcacgcccgctttggcaagctcctgcagggcggccgcggcgatgtcgatgcccggctggccaaatcggctcaacgtgaaggttcccgggaactgcgcatcgaattcgtcggcgatgtcgccgccgacctcgtagcagtcgccgcagatgcaggggccgagcgtggcgacgatacgttccggctgggcgcccttggccaccatcttctcgatggtcgcgccgatcacgcctttctgcagaccgcgacggccgcagtgtgctgcgccgatcacgccggctttgggatcggccatgagcaccggcaggcagtcggcggcgaacatgccgagcgccacgttcttccgggacgtcacttggccgtcggcttcgatgacggtcggctcaccgtcattccccgtcgcgttgttttcgccgtccgtctcgtcttccggcttcttcgtgccggacacgtcgaatccgaacggctggttgatgacgaatgattcgtccacgtccaccgcgtcgccggaatgcacctggctgatgaggctgattttcgcgccgagcacgtcggcgagcgccttgcggttggcgagcacgtgttccggtttgtcgccggatttgccgccgaggttgaagtgcgcgaaatcgccttcgctggtgccgccgagtcgcgtggtgtagacgactttgatgccgggggccagcatgatcggaatggtcacgggaatcgggttgccgtttttgtcagtggggtcgatggcgttggaatcgaggatcgcgtcatcgtattgtgtgctgctcatgtcttgtttttccttggttttgcgattggaaggcctgcttgcgattgccgtcttctattcggctttcagcgtcggctttttcgtgcgcgagcggatggccgcgttgacgggcacttcctgcgggcacggcatggagaagacgtgcgcggggttgttgatggcttcgacccagtggccgtcggcgtcacggaaaccgccggcaggcacggtgtaggcgaagggggccgcgccgggcagcacgaattcgacttcctggccggcttcgatcttgttgcggctcatgatggtcacgcgtcctccgtcttccggactccatgacagcacttcgccgacgacgagccatgcgcggaagtatgcggaacggtcggtgctttgctgcactttgtgttccggatagtagaagccggtggagtagtcgcggtgcgccactttgtcgggctcgtcgagcagccaatccggcagggtgacgtgtggtgccggccgtacaccggcgtgatgccagccttccggcagtatttcggcggcggtgttcgacttgcgtcgggtgctgcgtgcgtggtagctcagattgtccggctcgccaatcgcgatattgccggacgaaacgttgccagccgaaacgttgccggacggcacgcccccaacgggaatggcgtcgatgtcgggcttgcctgcgaacgcgccatcggcgttggccatgatcgcatcctcggtgtccggcttgccgtattccgggtcaccgggacggatcacgcggtcgcggaacggcttcagcacattgccgtcggcatcttcgaagccacgctggaccatgtattcgttgacggccgtcttgtaggcgttcgtcatggcggcgatgtagtaggcgctcttggaacggccttcgatcttgaggctcgtcgcgcccgaatcgagcagatcgtcgatgtgggcgagcatgttcatgtcctgcgaattgaacaggtacgcgccttccgcggtctgttcgatcggaaaataccgaccggggcgtttctcctccacgatggaatacttccagcggcacggctgcgcgcattcgccgtggttgccgtcgcgtccggtcagatagttggagaacaggcagcgtccggagaaggccatgcacatcgcgccatgcacgaagcattcgatgtcgaggtcgtcgggaatgcgggcgcggatgtcgcgcacggcctgcaggtccatttcgcgggccagcaccacgcggcgcgcgcccagttcgtagaacgcgttggcggcctggtagttggtgacgccggcctgcgtgctcacatgcagttcgaggttcggagccacctgcttggccatgagcatcacgccgatgtcggagacgatcagcgcgtccacgccggtgtccttcagcttgccgaggtattcgcgcatggcttccacctcgttgttgcgcggcagcacgttgaaggtgacgtacacgcgggccccacgctcgtgggcgtagcgtgcgccttcctcgaaatcctcgaggctcaggtttttcggcgcgctgcgcatgccgaacgccttgccgccgcagtagacggcgtccgcaccgtaatcgaccgctgttttcagtcccctcaaattgcctgcgggggccaacacttctggcttgtttcttctttgcacggatgttcctcttactcgtaaaagaccatcagatattgtcgtagattcacgggacaggcaaagcccgtccagccgttacgcaagctcgggctacgccaggcgctacgccagctcgcgtgcgacggcggcgagtacgtccactgcgtcggcgaactcttccggcgtggtgtaggagtagctcaggcgcagggagttgtcggcggcgaaatcgtagatgtcgccggggttgagcagcacgccacgttcggcggccagctggaacaggcggttcatgcgtatcggccggtcgaaggtcatccaaatgtagaagccgccggacggcacgttccagtgggcgagcccgtccattttctcctgcagcgtaacgagcgcgcggtcgcggcggtgccgcagctcccgtttcaggccggccacgtattcgtcgtacatgccgttcgtgaggaatcgcgcgaacgtccactggctcagcacgctcgcaccgtagtccatctgcattttcacgtcggcgagccgctgcacgatcggttcggcggcgaccagccatccgatgcgcagtccgggagccagcgacttggacgcgctgccgagcgtgatgaccatgccggtctcatcgagggccttcagcgacggcagcggggcatcatcctcgaaatacaggtcgcggtaggcgccgtcctcgatgatcggcagtcggctgtccacggaaagctcgaccagttcatgccggcgtttgtcgctcatggtgacgcctgtcggattgtgattggtcggaatcgtgtacaggatcgcattgcctttgcggttgcgcgcgttgagcggcgccggacggccggtgtcaagctccccttccgccagcaggccgcgcaatgcctgcacgttgaggccgtcgtcgtccatcggcacgccttccagatgcatgccggccgactggaacacctgcagcgacttgatgtagctcggcgattccgcgtatacggtggtgccggccggcagcaggctcaccgaaatcatctgcagcgcctgcaacgcgccggatgtgaccagcacctggcttgccgtgcagtcgacgccggtggcgcgcatgtgcgccgcgatggcctcgcgcagttcgggcaggccttcgggcggcgggtagccgagcgtttcgatctcgtccgcggcctcgccgagcacctgccgccacatggctttcggaaagagccgtgggtcgagctcgccggtgccgatgcgcgtcatgttcggcgtgaactcgtaccggttgatggcttggatggtgtcgttgttggctttgaagaagccggaatccacgtaatcggcccagtcgggcgcgcccggcagcatcagcgaccacgtgttgctgacgattcgcgtgcccgctccatgctgcccttcgacgatgccataatcggacagctcgttgatggccgcgatgacggtggaccggttcacgccgaaccattcggcgagcgcgcgttgcgacggcagacgcgagccaatcggccaattgccgctgtgcacctgttcgcacatgtacccgacgatttgttcggtgacgggttcgccggtggtacggtccggtttccaatcgatgttcagcggcgcgatgcgtgccatgacgctccttcacattggtggtgtcggtatggttcggcgttttccgcggtcggcgcatctggtttctgacagtggaccgtcctgcgattggctgagccaaacctcagcttttggctggttgcctattgtagcaacacctatacaatatgacactggttacgttgtttttcgcagaatagaggtttttcctgcgattacaaaatgagtaatttggttggttttggctgggttgattacaaccaaccaaatatgtttggatggataagaggcgagtatgggattctttttccaagggctgacgttgggattggcgtatgtcgcgccgatcggtatgcagaatctgttcgtcatcgattcggcgctgaccaagccgcgccgccgcgcgctgctgaccgcgctgatcgtactgttcttcgacgtgtcgttgtcgctgtcctgctttttcggcatcggcaagctcatgcaggaccacgcatggctgaagctggccattctggcgatcggcggcttggtggtcatccgtatcggcgcgggtctgctgtttcccggcaagggtggcgatgatggcgccgcgcaaacgccgcagtcgcagacctcgcaatcgcagggccttgcgcaacgcgtcacttcgaaattcggcggcgacagcgagctgctgcacaccatcgtcaccgccggtgtggtgacgtggtgcaatccgcaggccatcatcgacggcacgctgatgctcggcgcgttcagcgcgacgcttaccgtcggtcagtccacgccgttcatcaccggcgtggaaaccgcgtcggcactgtggttcttcggcatcaccctgctggtgtcgctgttcagccacaagttcagcccgcgaatcgtcaccgcgatgaaccgcgtgtgtggcgcggtggtggtgctgtacggcgtcaaactactagctgatttcgtgatggccgtgctgtaatccccgatagccgtccggttccgcaaaaacgtatgcccgtccgtgttttgctgcccgagctgagtggttgggttaacaaaatgcggacgggcagtgctttttcagccgaggaaggcgagctcctcgtcagtgagttcgagctcgtcggccttcagggagtcgaggatggtttcgggacggtgtgcgcccggaatcacgaacatgtggtcgcccttggccagctcccaagccagcaccacgcgctggtagctcacgccatgcttggcggccacttcgcggaacgggtcgaacagatgctcgtcgtacgggtggcggtagccgccgagcggactccagcacacgaaggcgagaccttccttcgcgcagtattccaacgtgtcctgggtttccagatggatcggcgaatactggttctgcacggcaacgagcttgtcgccgagaatctcctgtgcgattttgagctgttcgatgctcacgttggacacacccgcccactgggcaacgccctggtcgagcagcgccttgataccttcgcaggactcgttgtacggcacttccggatcgtggcgatgcaggtagagcaggtcgatcgagtcgacgccgagcgcctgcgcggactgcttgccgtattcgatgaggtgttccggcttgccgtcgcgcggccagatcggcttgtcgccatcccacgcgcggcgcagaccgaccttggtggccacggtgacttcctcacgcggccccttccatgtgtccagcgcttcgcggaccagcttttcgccggtctgttcctcttcgcccggcgtgtagtaggcccatgccgtgtcgatgtggcggcagccggcgtcaagcgaggcgtgcagggtttcgatgccgacgtcgtggccccggttgttttcaatggttagcggcatctcgccgtggccgatggcggtggtgtggaacggtccgagattacggaacaacgtcatgtcttctccttcgaaagtggtgtcttccggcaggcgcgagccggttggagccgggtcggaaccaagtcggacggcatctcgttcaggttctgccaatggaaaagcctaccaatcgccatgggcgaaaggtaggcttttcaagccggaccgggcgtgggcaaacacaatgccgacaatcgcaatgtcatagggcgtcacgttgtccgacggcgggcggcatgtcgtggatcagcggccaccgccgcctccaccgccgccgcctccgccaccgccgccgaagccgccaccggagaaggatccgccggagccagaggatgaggaaggcgcggccgcggaaatcgtggaactcaccgaagcgaaaccggaactcagctgcgaaccgatatcgccaatgccgcccatgaactgcgatccgccaaacgcaccggtcgacatgcctcccatagtggacataccgttccacgcgtgggagcgatacgtccaatagccgagggaatcgtacccatacgcgtcaagccattgcggatcgttgacttcggggtacgccttggcgaattcctttgccaccttgtcggaaatgccgaaggcggccgcatagaccatataccagttccacatcaccaaatcgagcgcaccacggtcggagaaattggagaaatcctccatatagcgtttgagtcccaagcattcgccggcataggtctgtccggattcggtgaggccttccttgcgtccggtagctaaacagaacgtgccgacgcatgcgaacgcgccgccgaagcacaacgccaccgcgatattgcttccaatattgaccagcattccaatcacgccaaagaccatggcgaagatggtgggcgctatccaacgtccgctgacatccctgaccgcgttcaattgcaggaattcaatatcgcaggcattggtgaaatggttcatctcctgatagccgttctcccagctggagcaagcctccttcatctggttaaagtcgaataccggcgaacccacgcgtgcggaaatacgaatcagcagttgcaggcaggcttcctcggagcgactcagaccaagggtttcccgatgggatagcgcctgaggcagaatcaccaacgtactagtacttgacgcggcagaggcacgggatggatcggaggaaatcatgcgcgccatatcggccgcgttcgccctgctcaggtcgatgccacgatacatgtcggcaggtcccggatatacggcgagcgctttcttgaccaccaatgccagcaccgtcgccgtcatggcacgcgaggactgttcacccttggaatcgtccaccacatcgatcagatgcgcggcgcaggcagggctgacttgaggtgactcacgccagtattcgatgccaccgtggtaggtggcctcacggtttgaggaaatcacgccgcgaaccgccagcacgagacacaatccgcccaatacaaggcataccagccagcctgcgacggtgagctgcgctttcaaccgttggctgtcgcgccactgttgttccttggcagcctccgtgtctttcagctcgtccagatagtcgccggaccgtgtgcgttcgacgccgcttgcgccggtgttgtcgaaggccgcgacgaggtcgacgtatcggtcggtacgcaggtcgctgatggtgaaatgcaacgtgccgtccgtgtcgcgagacgtttgagatgtggcctcagtgtgcagccatgcccacgaatcgtcggaaccgatgcctttggggaagcgcacggtgccggtgactttgccagccggcacctggttgtcttcggggaacatctcccacatgagattcgtcacgtcactatgctgcgtgcccatgttatgaaacgtcatggtcacgtcgaatttgagactgctctgtttgacggtggcgggaatgttccagccgatttcgatttgtttgtcattgtccgaaccgttggggtcaagcccgccggtggcagagtcgaatggttccggatagttggagccgattgtggtgtcggcgatataccaatgtccggcatattccgattcccattcactgtcggatacatcgctcggcaactgcggcgcgatctgtgtgtattcctcaccggtggacacgttgattacggaaatgtcggtgatgttcgtcagatcctggttgcgcagtttgaacgtcagatatagctgtttccacggtttcgtgtcgccgtcatcattctcgcgctccttcaactggtaatccagatgttccgtgaaacggatgtcgccgttgctttgcagctgcgcgtcaaaatcgacggaacggtagcttagatcggcttcgtcgccggagacgaagaacagcaggagcgctacaacgagcaccgcaacaaatgtggcacccgccgcgagcagtcctccacggacacgtttcgcatccatataccatcaccctttcttcctgcgtataccgtgtgccactcgtatatgcgtatcgcacatgtcagcgtcctccgaacgaaccgccgccggagccaccaccaccgccgtcgaaaccgccaccggagaaggaaccgccggaaccaccgccaccgaaacccgagccaccggaggacggcgccgccatggaaatcgtgttgcgcacgtcggcgaaactggagctgagctgcgcgccgaaatcgccataattcgcactgaacaccgacgcggcggcaacacttgcacccaccgcagcgccagtggacgcgcccataacgctgctggaatgcaacggcatgtacatgtacgacgaagcggcatgctcatccagccactgaggatcggccacttccggatatgctttggtcagctgcgccatcaccttgtcggaaatgccgaatgcggtggcatacaccatatatcggccccacaatgtcatatcaagcacgccacggtcactgaaatcactgaaatcaagcagatagcgcttcagcccagccacttggccaccatatttctgaccattgtcggtcaatgcatgatatttgccatacaccaacgcgaatgcgcaggccagcacgacaggcacacagatgctcatcgtcactgcgatctcacctctctccgcgtaccgcacgcccttatagaacgcgaaaacaagaccaagaatgccgaccagattattcaggaatcccctcgatgaatcaacggcgcgcagattgtcgaattccgtggagcaggcggtatcgaaatcctgtagcaacttgtagccctttttgtagtgtttgaacgccttgttcatctgtttgagatcgaatacctgcgtatccctcaaccgtgaagacgctttgagcaggatgtcaagcgccgcatgttcggatgagctcagcagcagcgaaccgatgtcattgcgcgccaccggcatgatgacgatggtgctggtcttcttcatcttgcgtacggttgcggcgtcagagccgagcctgcccgccactgatgccgcgttggtcgtggtcaggtcgatgccgtcatacagtttcgccggtccgggatagatggcgattgccccttttgacgcgagcgacatcacagtggaggacatttgccgattgactagtttgtcgccgttttttattttgcctgaaccgagaatcgaagatgacgcgctcatgacatcattcatccgtgccgcggcggccggactcatgtagggcaaatcgcggtaatattcgacatcgcctttgtattgcgacttacggaagctggtgataccgaggtacagcgatcccataatgaacgccaggccgatcagggccgaaacagcccaaccggtcactcgcttgaccgcttgatcatgctgtttatcgcgccattcctcctctttctgagtttcgctatcgatgagctcttgcttgtggttgccgcttatcttgcgttccacaccttgcgatttcgagacatcgaacatggccacgacgtccagatagtcgcctgcacgcacgtcatcgaccgagaagagcagcgacccgttcttgccgcgtttcgcggtggacgtgttcttggtatgcaaccatgcccaagaattcttcttggtgacgccgtctgggaacgtgaccttgccggtcaccttgccaatcggaatctggtttgtcgtgccgaatggctcccattggaaagagacgacgtcgtcataggcggtgcttacgccatgcatggtcatggacacatcgaatttgaggctgtcagcggacgcagtttccggaatgttccagccgatttccaaagtcttatcggatgaggagtcagctttcaaaccatctgtttcaggattgaacggttggggatctctgagtacgctgacatccgcgatataccactgacctgcgtgttcagcgttccaatcggtgacatcattgggattcacaaatctaccttggatgtacgtttcgttgttggtgacatccttcacgctgatatcactgatattcgtcagattattggcttttagcgtgtactgctggtacatctgtttccaatcaaagccacggtcattcagcttcatatcaatatgctgcgtgactttgaggtcgccattcttaagcaccataacatcgtaatcgagcgtacgatagctcaaatctggttcgacgtcggacgtcaaattcacatccagaaaagtgacgcccaacagcagcgcggccgcgaccaccgcagacagcataccgatcagcgcacgtctgatattcataagttctctcttgaccctctatgcaggcagtccgcgagaagccgacataccgtatagacaaaaagggagtaccggcgaagtatccaccccgtcagcgctccccttcttttgtatggaaatgctgtatggaaacgctcagaacttgacctgcggagcctgacggtccgcttcgtcgacctggaagtacgccgcctgctcgaagtggaacagtccggcgatgatgttggtcggcacgacctcgatcttggtgttgtacttctgcaccacatcgttatagaactggcgggcgtaggcgattttctcctcgagcgccttgagctgggcctgcaggtccaggaagttctggttggcctgcagctgcggatacgcttcggccacggcctggaggttcatgatcgcgcggctcagctggttttcggcttggatgcgctgtgccacatcaccggactgcgccgcctggagtgcgctggcgcgggcctgggtcacctgtgtgaacacctgcgattcatgggcagcgtaccccttgacggtctccacgagattcgggatgaggtcggcgcgctgcttgagctgcacgtcgatctgcgcccagccgtttttgacgcggttgcgcaatgtgaccagaccgttgtaggcggacactccccacagcactatcaggacgatgacaatgagtgcaataatgccgaatatcatgtgaaaatccttgcttctttgcttgtttatttgtctaattttcgcatgagggctacacatttcgttgtattgtcggttttccatgcacccgtaaatcgattgatgccaatattcgcacagcatgtcgaacgtacgaaaaacccaccccttacggagtgggtttttcgttagattacctatcggcttcgctgcgaagaatccgtgagaagacgtcagtcttcgaatgctgagccgtcaagcgagaagcccagtgggcttctcgtaggtgaagtgagcagcttcgctgcgaaggatccgtgagaagacgtcagtcttcgaacggatcaaagtcgcggcgcacgcggcgacgcggacgctcggagcgctcttcgcgatcggcacggtactcgtcgtagttctcgtcggcggcgtaacgcgggttgcggtcgtcacgacggctaccacggcgacggtcggaacggcggtcatcgcgatcgtagtcacggtcatcgcggtcggaacgacggcgacgcggacgatcatcataatcacgatcatcgcgatcggaacgggacgaacggcgatcgtcacgatcgtagtcgcgatcgtcacggtcggaacgacggcgacgcggacgatcatcataatcacgatcatcatcgcggtcggaacgacggcgacgcggacgatcgtcgtaatcgcgatcatcgcgatcatcggaacgacgtcggtcgtcacgacggccacggccgccacggcggtcatcgcgatcgccacggtcacgacgcggagcggaggattcctgatcctcgaagcccgggatggcaagggagatcttgccacgatcgtcaacaccctgcacgaccacctcaacggtgtcgccttccttgagcacgtcttcgacggcgtcgatgcgctcgccgttggcgaggttgcggatctgggagatgtgcagcagaccgtcggtgcccggggtcaggttcacgaaggcgccgaaggaggtggtcttcacgaccttgccgttgtaggtctcgccggcttccggcacgtgcgggttggcgatctggtcgatgatctccttggccttctcggcggcctcgccgccttcggaggagatgtacacggtgccgtcatcctcgatggcgatttcggcgccggtgtcttcctggatctggttgatcatcttgcccttcgggccgatgacctcgccgatcttgtccaccggaacggtggtggtgatgatgcgcggcgcgtacgggctcatctcggccgggccgtcgatgcactcgttgatgacttcgaggatggtggtgcgggcttccttggcctgctgcagagcggacgccaggatgtcggccggaatgccgtcgagcttggtgtcgagctgcagggcggtgatgaattcggaggtgccggccaccttgaagtccatgtcgccgaaggcgtcttcggcgccgaggatgtcggtgagcgttttgtagatgtgctggccgtcgacgtcgccggacacgaggcccatggcgatgcctgcgaccggagccttcagcggaacgccagcggcgagcagggacagcgtggaggcgcagacggaacccatggaggtggaaccgttggagccgattgcctcggagacctgacggatggcgtacgggaactcctcacggctcggcagcaccggcacgagggccttctcggcgagggcgccatggccgatctcgcggcgcttcggggagccgacgcggccggtctcaccggtggagtacggcggcatttcgtagttgtgcatgtagcgcttggactgcgggccggacagcgcgtcgatctgctgctccatcttgagcatgttcagggtggtgacgcccaggatctgggtttcgccacgctggaacagcgcggaaccatgcacgcgcggcacgatgtccacttcggcggacagggtgcggatgtcacgcaggccacggccgtcgatgcggtagtcctgggtcaggatgcggcggcgcacgatctggcgctgcagctccttgaacgcgttgccgatttccttgtccttctcggcgtcttccatgtcggtgaactcgccggcgagggtggccttgacgccttccttgatctcgtggatgcggtcctggcgcggcagcttttcggcgatggacagggcttcgtcgaggtcggcgtgggcgatctcgtcgatgcggttgtacagatcctcggtgtactccgggaagagctggaattccttggtttccttcgcggcgatcttcttgagctcggcctgggcctcgcagatcaccttgatgaacggcttggcggcttcaagaccgccggcgacgacttcctcgtccggcttggtctggccttcgtcgtagatgaggtgccatgcgttcttgccggcaccggcttcgatcatggcgatggcgacgtcgccgttctcgacaacgcggccggcgaccacgatttcgaacacggcgcgttcgcgctcgctccagcgcgggaaggcgacccactggccgtcgatcagggccagacgcacgccggagaccgggccttcgaacggcaggccggagatcatggtggaggcggaggcggcgttcagtgcgacaacgtcgtatgcgtcatccgggttgacggcgagcacggtttcgacgacctgcacttcgttgcgcagggtgtgcgggaacagcggacgcagcggacggtcgatgatgcggcaggccaggatggcttcggagctcggacggccttcgcggcggaagaacgagcccgggatcttgccggctgcgtacatcttctcttccacgtccactgtcagcgggaagaagtcgtagttctccttcgggctggaaccggcggtggtcgtggacagaatcatcgaatcatcgtcaagataggcggcgacggcaccatccgcctgctgggcgagacgaccggtctcgaagcgcagcgtgcgcttgccgaatgaaccattatcgattacggcttcaacagccttgatttcgggaccctccatagggttcctcctttgttttcttttcttgtgtacctactatcggcagtcctcttcagcggactccaaccgattcctacatgcgtgacgcggcgttacctccgccgcttcctcatctctagattctagacctcgtgcgccccaaacctcgggccttcaaactgtctgttccttgaactcggctgtcatgcaaaaaacgcccgggcgccatgtgacgctcgggcggaagaatgttatcggcgcagacccagacgctcgatcagggagcggtaacggttgatgtcaacgcgcttgaggtaatcaagcatacgacgacggtcgccgaccatcagcagcagaccacgacgggagtggtgatcgtgcttgtgctccttgaggtgctcggtcagatcagcgatgcgcttggtgagcagagcaacctggacctccggggagccggtgtcaccctcgtgggttgcgtaggtcttgatgatttcctgcttttcctcagccgtaagtgccacggcatcctccttattttgctgcgcggtgctgccggcccaataccggcgcgctctctatccgcgggcgaaacacgccaaggaaacatcttacacgacgtccggaccaaaatcgccggccgatatttccgcccccgccgacggccgttcttcacgtcacgccatggacgtgagcagaccgccgaacaacaccacggcaagcgcgacgagttcgattgcgaagaacaataggaacgaggcccagctgcgtgtgaggacgttgagcttcgattccttcttgatgcacaccagcaggcccacccagagcaccgcgtagaccgcgacgccgaaaccggcggcgatgatgccgagattcgcggcgttcgccagtccggccgcctcaccgtacatcacgtaggtggcgttccagaagttgaagctcagcaggcacatgccggcgacgaattgctccgcggcaaggccgatcacgaaaatggccccccacagccatttcttcgcgtccgcgaccatcagtccgagtccggtgagcgccacgatggtcaccgtccatgaaatcagcgccacgcctttgggatcgaggaaattcaggttcgccaccatccatgaggcgtcccgcaccgcgatgtcgcgtccccaccagtacggcgcgatcatggccagcagcaccaatgccatgaacagaatccagcggaccggatgcgatttgcggcgttcgatgtcggccaaggacaggtccgacggttcgatggacgccgtcgggtgtttggagacgtcgacggtctcgaccacgccatccacgacttccgttgccttgttgcgttccttctgacccatgttccgctccgtatatattgcgatatcttgcgattgcgccgccgcacgccgcggcccgttccagcatacccgggcaatcgtatgcccgggcatacggatatacgaaaggcgtgccttgaggcacgccttcttcttctctgatgctgttgtggagcggatgacgggaatcgaacccgcgtaatcagtttggaagactgaggctctaccattgagctacatccgcgtgttgccgctacggccgaagccgacacgaaacgactcgagctattatacacatcccaccaacttttgcaagcgggaatggcatttcagatttcgagcatgaccacggcggaggcgatcggcccgtcatggcttatggagatggagatatcgtacgactggcgcaccggatccaacggcaggcccaacgactgctgcaccttgcgttgcacttcggaggacagtatgacgcgcggcacgccgtgggaatcgtcgagaatttcgatgcgcacccatgggaagttgtcgagcgtgtacggatatgcgacttcggcgccgtctttcgcatgccgcgaaatggccgcgcaccacgctttcaggaacgcctccttgcctgcccagcgggcggcgaggtgcaccgcctcgtcatcatgcttgagctgcgaccgttgcgccgtctgccatatctcgcgcatggagaacagattgcgcatacgcgtccccggctcattcagctgcttggcgaacgcaggcacgtcaacgacgtcatgccctagacccagcattcctccgccttcctaggaattattgatcggggttaccccgggaatgccccgaccatgtcatatggaaaagggcgatacatctgtgcagaagtatcacccttttcttatcaggccgtcatcatttgcccatatttaggacagatttcgacgtagccgtctcacgcttcgaaatagccggtggacgcaaggcgcgcgttcggatcgagcagcatggccttctccacttcgtgcgcgtcgtagccgcggccgtcctcgtggaagcggcggttgtcgatcggctcgtagagcgcggcgcgtcccatcatgccctcttcaaggcgacgctggccggcggcgagacgcgcgttggcacggtcgcgccattcgctcagcgcgtcctcgccgacggtgttcgccacggaagcctcgaaggcgcccgggttgacgatcgcggcgaaaccggacacgtggccgaagccgagcgacgtggccaggccggccttgacggaaccgaccttcagcggctcgcgcagccagaccatgtggtcgtcgcgcttgagcttcgggtcgacgcagtcgagggccgcgttcgccggaacgacgccggacttgaacagctgggtcaggccgttgacctggaagatgcaggcaccgcccttggcatggccggtgagcgacttctgggagatcacgaacagcgggttgccgtcggtgcggccgatggcgtgggccagcgtgttgtgcagttcggactcgttcgggtcgttggcgttggtggacgtgtcgtgcttggagaccacggcgatgtcgtccggcgtgacgccgagcttggcgaggtcgtgcacgagcttggagtccttgccgcccatgccagctgcgagcgcgcccagtcccggagccgggatggaggtgtgcgcgccgtcggcgtaggagtggacgaatccgaccacgccggcgaccggcaggccgagcttcagcgcgatgtcaccgcgcgtcagcaggatggtgccgccgccctgcgattcgacgaagccgccgcgacgacggtcgttggcacgggagaagaagcgcgcgtcgatgcccttggcgtacatctcctcggagttggcggtggcgttcatgttgccgaagccgatcacggattccacgccgatgtcgtcgatcgcgccggtgaccacgaagtcggccttgccgagggcgatcttgtcggcgccttcctcaagggagacggcggcggtggcgcaggcggagaccggctggatcatgttgccgtagccgccgatgtaggactgcatcacgtgggccgcgacgacgttcggcagggcttcctgcaggatgtcggtcggaatctcgtggttgaggaaccggtcgaggtacagcttcctcatggaggccatgccgccgaagccggtgccctgcgtggaggccaccatggacgggtgcacggcttcgaggatctcggccggggtgaagcccgcggacaggtaggcgtcgaccgtggtgacgatgttccacagggcgatcttgtccacgtcgccgaccatggaggccggaatgccccacttgaccgggtcgaagcccttcgggaactggccgccgacggtgcgggtcatggccgcgcggcgaggcacgcggatcatggagccggcgtggcgggtgacgttccactcgccggattcggcatcggccgcgtagctggtgtgggcttcgtcgagcttgacgtattcctcggcgatctcacgggtcggaacggagaaggtcacatcgtggtcgaggaacacctcggcctcctcctcgtcggcaccgtccttgtaatcgttgcccatgccctcttcgaacggacgcacgccggagcgggccacgacctcgtcgtggtagcgttcggcgatgtcctcttcgggcaccaggttgccgtcggtgtcgtaccagcccggcttcggactgtcgttccaggtcagcaggcccatgttccaagccagttcgagcaccgcgccggcggacaggtcgaccttgccgtcggagtggatgccgagttcggcttcgaaacgggtgcggccggagccccacggacccagctcgccgatggagacgatgacgatctcgtcttccggacgggcggtgacgtgctgccaatccttcagatcgaccttcgcctgacgcggggcgcgcgggctcggcagcgccttgatcagcgttgccgcagcggcacaatcgccctgcttgtcctcatcgccggcttcggcggcagcggccttggccgcgtcctccatggcttcggcgcgcagtgccttgatgtcgatcggctcgctgccgaggccgccggtcaggtccacgtcgagcggggccttgacggcctgctcgcgggattccttggtggacagctcgagcagcttgaccgcgatttcggcggtggagtaggtcttcaggccgtgacgttccacgacttcgaccagcggatcgttgccgcccatcaggccggtgccacgcacccagccgatcttcgggtgggcgaaggtgacgcggctggaccacaccttttcggcgcgggcgcggttgacgatcgcgtcgaaggcgctcttgacctcgccgtacgcgccgtcgccgccgaagacgccacggttcggggagcccggcaggatcacatgcagcttgtgctgcacgtcggtgtcggcgccgatcttcgcgaagccggtgatcgcacgttccacaccccacagcatgaggcgcgcctgcgattcgaacagctcgccggaatcggccaacgtgccgtgcaccggcggagcggcgaacgggaagaacaggctcggctcgtaggcgggcttcagaatcgtggtggtcgcgccggaggtcttcttctgcacgttgccgacccacgccacgagagcgtccacgtcacggtagctggacaggttcgccggaacaagccacagcttggcgtcgcctgccgcatgctcgcggtaggtctgtttggcccatgccttcacgctctgcctgaagctatgcgaggtggccacgacggtcgcgccgccggccagcaggccgttgacgacctgtgcggcgatggagttcggggcaacgccggtcacgacggcgatatcgcctgcgaaacggcttgcttcggcggattcgtccgtctgctcgagcgcctcgccggccacgcgcttgaacgcggcggcaagctcggcgtcagcggtcttgcccgcgtaccatgcggcttcatcggcgacggccttgcccaggccgatgaagctgccgtccagtgcggaggcgtcgttgtcgtagtaggcgcgggacaggtcctcgcgtgcggatgcccaacggtcgtcgaacaggatggccttgcgctcgtcgaagcgcggttcgacctgcttcggccagtcggagccgagctcggcttcgacggcggccaccacggcggcgttctcgtcggcagagtcgtcggccaccggagcggtgacgcccagctggttcagcacgaacttggcggtggaggcgagcacgccgtcggcaccggtcaccttggccgcgaacgcgtccagggctgcggaatcgaccacggcaccgccggctgcgccacctgcgctcggcatggcgacggccacgcccttgtcggaggcgaccttctgcacggccgcgtcgatcagcgcgttggcggcggccgcgttggaagcggcttcggtgctcagcgaggcgaggtcgccaccgcgggagctggcgccttcgcgggtttccagcacaagggctgcgaccacgtgggaggcccagccttcgccgagctgccaggtgtcggtcacgcgcttggtgatctggccgagcttcacgccgacggcgccgaacaggccgcgcacacggtcgcggacgatgtcggacagcaccggaccgaacgccttgtaattcggagcgaccttgttgaccagcgcgctcagcgccttgacggtcgcttcggcggcgccgtccacggaagccacgcccagctcggagctgatgtccatgagcagctggttacggcgagaggagacgccgttggtcagggtgtcggtggtgtcggattcgccgatctggtccggacgcaccttcgccgaatatgccagcagcatggcgatcgcgtcggaagcgttgaacggaatatccgcgactgcggcgccggacggagcgccggcaggtgcggccggtgcggcggcagccggggctgcggcgacgggtgctgctgcgactgcggcaggcgctgcggcggcagcggacggagccgaagctgctgccggagcggctgcggcggaatcgtcagcatcgtcgtcggcaacgagggaatcggaatcggtcatgtagacgcggccttcgtcgcggccgacgttgtagacggtcacgtcacggccggcgaactgcggcaggcgcagcgtcttggcaccaaggttggcgagcgtcggagcgttgccgagacccacctcgacgtactcctccacgccaaggccgccctgttcggcggaaccgaacagcagcgcctgggtttcgatccaacgcaccggggaggcgaactgccagctcagcagttcggtgagcagcagacggccgagcttctggtcgtcctcggcgtaggaatcccacaccttcggatcgtccaacgcggccttgatgcgctcggacggcacgacctcgaggatcttcgcggcgaattccttggtcatctcgaacggcacggccaccaggttcggaatgtaacggccaaccagacggccacggtagtcgatgtgcttcggcagcagcgcgtcaagcttgtcgcggaactccggcacacccttgcgcagcagcgtggagtggaacggcacgtcgatgcccggcaccagcatgaacgccggcttgccgccgtattcggcgacgcggcgggcggaatcggccttcagcgccttcagaccggcgatggtgccggccacggcgtactgctgtccggcaaggttgtagttgacgatctgcaggaactcgccggaagccttcgaaacggattcgacgtattcgcgcacgccgtcgtcgcccacaccgaactggttcggacgcagcgcgcccatacggtagttggaacggcccttctcgtcacgcggaatgaggtggtgcatggtggagccacggtggaacaccagctccagcacggtttccagcggaatcacgcctgcgaaggagctcagcgcgttgtactcgcccagcgagtggccggcgaagtaggcgggccagatgtccgcgccggcttcgcgcagacgagcggtctgggcgaacgccacggtggcgagcgccacctgcgtgaactgggtcaggttgagcaggccttccggatgacggtaggtcacgccgttggcggtcagttccttcggattatcacgcacgacggcgaggatggagaagccgagcttctcgcgggtcaccttgtcggcgcgctcccacacctcgcgtgcggccggggacttggcacgctcgtcgagcaccatgccctgcttctggatgccctggcccggatagacgaaggcggacttcggcgcacgcacgatggcagtgccacgggacacgatattgccgtcgatgcggctggtcacttccagcaccatgccggcgtgggccacacggccgacgcgttcgatggagatctccacctcgtcgtcgagctgcaccatgccgtacatgttgtacgtccagcctgcgatctcgtaatgcgcgcccttctcgtcgagcgcctgcaccgcgtactgggcggtggcggacagccacatgccgtgcacgagcggcgcggcgagaccggagacggcggcaccgcgatgggaggtgtgaatcgggttgaaatcgccggaagtacgggcgaaagcggtcatctcgtgcggagcgacgaccttcacacgacgcagcagacggcgcggagtgctttcgatttcggcttcgattccaccatagtcgggcgcttccggcggcagcgcgtcggagtacgcgcggccgcggatggcgaaacgctcggtttcgttggcaagcagcgtaccgtcctgagcggtgtgcgtgacgtggatggtcaccacacggccggaagcggattcgaagtagtcgtcggcccagctggtgagctcgatgcgctcgccggtgtgcttcagcagctcgtcctcgctcacctcgagttcgatgaggtggtcgagatgcacggcgttgagcaggccttcgatgaccgggaagccgttgacgtacacggagccgagggccgcgtagatggcgggccaagccgatccgacgagcgcgtccggggcgatgcgggacggcacgaggtcgctcggcagcgcgccgccggtggcggcctcatggtcgaaaccgaggttggcggacagcgtgtagccggtgtgcgcctggccgaacgggaaggcggtcttgtcggacacttcctcgatctgcggcatggcggtgagcttgtcgccggtgatggcggtgttgccgatgcccgcggtgtcggcgagcatgcggtagacgtgctccggcagacggtcgcggtccacgaccgggaacaggccggattcgttgccgtcgacgttcagcggaatgacgatgtcgcgtacggcgtgcttggaggcgccgccgtccggatcgttgtcccagaaggtgtcgagatggatgtcgaggtcgtacttttcgacgctgccttcaacggccaccttgcggatctcgtagttggcgtcgccgttggcggtgccgtacgccgggttggccatgaggtggccgacccaggagatgttcggggatttgcggatgaattcctcggcggagacggccgcgcccaactgggcgaaggcggtcttgtcggcgctcgccgattcggcggacacgcgcttgaccatggcggcttcgaagcggccgaggatgtcggccaccggctcgtccacggtggtgatgccggccacggagatcgggccagggatgatgcgcacggaatcggcggaatagcgggagtcctcggactgccacagctggtcctggccccaccaacgcagcaggtcgttgtcgatgaccggcacgaacggcatcggcttcggatactcgcgtacgagcaccgggaaccatgcctcgtccatcggggtgacggtcagctcgccggcctgcgggtaggtttcggcaagcttggcgatcgcggcgttcggatcggcttcgacgtcggcgcgggaagcgaacagcgatgcgaattcgccgctttcctgcgtggtgacgcgggcttcgatgcgctgcagcaggtgcaggaagcgatcggcgtaggtttcgtccacccacgggaaggagaggtcggcgaaacgctgggcccactcaaggtaggtcatggtcttcagatcgccgaaatacggcttggcggtggcgttcagcgccgcgatgatctcgtcgcgacggctttccagctcctccgggtgcttcatgacgcgcaccagcaggcggccgcagcgggcggaggagttctccagctcgtagatgtcggcgtgcaggtggctcagaccggaggtgacgccgcccttggcctggccggacggcacccactgctcgcccagcggggcgaacggatcgttgccatcgcccttgaccggaatgccaggagtgctgacgagcatctgcttgacttcagggttggtgtgcgcttccttggcggtcatggcggcggtgccgacaagcacgccgtccacaggcatgagcggacggccgtattcggcggcccattcgccggtgatgtagtcggcgccgcgttccggcgtgccgatgccgccgccgaccacgagcacgaggttggactgctcacgcacttcggcgtaggtgctcagcagcagatcgtcaagcgattcccaagagtggtggccgcctgcggagccgccttcgacctcgatgagcaccttggtcggcgcgacggccttggcgatgcgcaccacctggcggatctggtcgacggtgcccggcttgaagctcacgtacgggaagccgtcggcgttgagattgtggatgagttccacggcctcgtcgaattccggaatgcctgcggagacgacgacgccgtcgatcggggtgccgctggcgcgcttcttcggcacgatgcgctgggagccgaactgcaggttccacaggtagcggtccatgaacatggcgttgaattcgacggtgcggccttcctcgagttcctcctcgagcttggccacgtgacggtcgaacacgctggcggtgacctggccgccgcctgcgagctcggcccagtagccggcgttggcggcagccgccacgatctccggctccacggtggtcggggtcatgccggccagcagcaccggagccttgccggtaagttcggtgaacgcggtgcgcaccttgtctccggcggacgtgtggatgatgctcggcgcgaaacgcgtccagttctgggtgcgttccggcagggtctcaagcgtggagagcgcgccgcgatcggccacggtggaggcttccaccacgccgacgccggtgccttgggccacggtggagaacagtttgccgacggtgttgcccggaccgaagtccagcacccacagggcgctcggatcggtggacttcatcagggcgcgcacgcgggcggcccaatccacatggttgagcagcacttcggcggcgagctcacgggcatggtcggcgttgatgccgcaggcctcggcccatgcgacggcctgggagacggcatcggccatcagcgggctgtggaacggcaaggtcacgtcaagatattcgagcacgggattgaacacgcggccgccacgcaccttctcctcacgcagctgcgcctgacgcttgtgctccttggccacttccacaccgaatgcggccaggtcctccggatagccggacaacacgtaatgcgtggcggaattggtgacggccacggcgatcgggccacgtgcgccgtcgacgcgttcgatcagcgcgtccacctgggcgcgggtgatgtccttgacggacagcatcggggtcgcctcgccgtggcgtgcggcgagaccgagctggcgtgcctgacgggtgccggcgacgccgatcagcgttgcgatcgcaagaatctcgtcgatcttggctgcggctgcgtcgatggaaccggcttcgcagatcgcctgcaccatatgcacggcaagcacgccctgggagtggccgagcaccgcgaccggcttggcctgggccggattgtagccgagtgcggcggcgtcgagcagcgcgcccagctgggtcagcgcgatgccgggaacgctggcggaagccgcggctgcggcgcccagacgtgccgggttcggttcgaagccgaacaggtcgaccgggcgtccggtggtggcgagcagctcggcggacaccgggtacagcagcgcctgcgcagcggccgcatgggtgtgcagggcctcgtcgagcgccggattggcgctctggtcggcgagcgccaccggccacggggtggattggccggcgaaggcgagcgcgtggggctcgctgttcagtcgatcaagaaaaaaggtgttcataatcttccttacttgttccaaaatttcttgcgattgttgtggttgcttacgttggttgcgtcgcgttgcgtccgtcacagcggctggttgccgtggtgtttgctggttcggcgcacgcgtttcttgctggcgagcaggcggagcgattcgatgatggtctcgcgtgtctgttcggggtcgatcatggcgtcgatctcgcccatttccagcgaaaggttcgcgttgacggtggtgcgttcgtagtcggcgatgtacttggcgcgcagcgcttcgacgtccttgccgttgtctttggctttctgcaggtccttgcggtggatgatgttcaccgcgccggccgcgccgagcaccgcgatctggctggatggccaggcgaagttcatgtccgcgccgatggctttggaacccatcacgatgtatgcgccgccgaaggccttgcgcaggatgatggtgacgagcggcacctgcgcgttggcgtaggcgtagatgaccttcgcgccacggcggatgatgcccgcatgttcctgttcggcgcccggcttgtagcccggggtgtccaccaaggtgacgaccggcaggttgaacgcgtcgcacaagcgcacgaatcgcgccactttttcggatgagtcgacgtcgagaatgccggcgttgacgttcggctggttggccacgatgccgacgggatggccgtcgatgcaggcgaagccgaccaccgctgaagcggcgaacagttcgtgcacctgcacgaattcaccgtagtccacgatgcagcggatcacgtcgagcacgtcatacggctggcggtcgttgtccggcacgagggtggcgaggcgtttggccacgtcacggtcggcgcgggtcgccgcgtacgcgtagaccggcggctgctggtcggagttggacggcagataggcgagcacggtacgcgcgtagtcgatcgcatccgcctcgtcctcgccgagatagtgggccacgccggacgtggcgttgtgcacgtagccgccgcccagatcgtccatgctgatcacttcgccggtggccgctttgaccacgtcgggaccggtgacgaacatgttggaattctcgcgggtcatgatgatcaggtcggtcagggccgggcagtagacggcaccgccggcgcaggggccgaggatcagcgatagctgcggcacgaaaccgctggcgtcgcaggttttgcggaacaggtggccgtattcggtcaacgcggccacaccctcctggatgcgcgcgccaccggagtcgatgagcgcgatgatcggcaccttgaggtcgagcgccttgtccatcagatggcagatcttgcggccttcggccacgccaagcgtgccgcctttgacggagaagtcctgcgcgtagacggccactttgcggccgaacacctcgccgaagccggtgatgacggcggagcccgcgcggccaccgttgatgtcgccgccgcggaaacggccgatttcctcgaaggaaccggtatcaagcagcaggtcgagacgttcgcgcgcggtcagcttgcctttgacgtgctggcgaccgcgggcgtggtcttcggcttcggcggcgagctgcgcggcacgcagcacggacgtacggatcggctgcgattcgcgggcttcggcagccgcttcgtcacccagtcgctcctgctgttccatgacgaccttcacggcctctttgacggccgggcttgcgatgatgtcggtcatttcgcgccgccttccgtcttggtttccgtattaccgtccgttgccggcttgccgtcagccgccttggaagcgccgttgacgtcgatggtcatcaacgtctcgcccgcttcgatgcctgcggccgggccgacgaagatcttggtgacggtgcccttgaccggcgcgtacacgtagttctccatcttcatggattcgagcacgacgagcaggtcgcccttggccacgtcctggccttcggcgacgttgatgcgtgtgacgaccgcctgcatcgggctggcgatcacaccggactggccgtcgttgccctgctgcttcttttcgacgtggtgcaggccctgtccgcgcagcggctggatggcgcgcttggcgtcacgcgccttggcgccgccggtcagattggccacgatgtcgttcggcacggtcagcgacacacgatggttgttgacttcgatgacgaaggtttcgctggattccttctgctcggcttccttcgcacccgaagcgccggccatggatgccggctggccgcccttggtggaggatgcttccttgttcaggtacttgcgttccagccatttcgtgctcacgtcgtaggccacgccatgctcggcggtgaactcgtcgtcgttgaagatctgctcgaacaggcttgccggggtcggcacgccttccaccttgagctcttccaacgcgcggcgcacacgtgccacggctgccgcacggtcggaggcggtgaccacgagcttgcccatcatcgaatcgaacttcggggagacggtgtcgccttccaccacgccggaatcgacgcggatgccagggccggacggccatgcgagcttggtcagcgtgccggagctcggcgccagattcttcgccggatcctcgcaggtcagccggagctcgaagctgtgtccgcgcagcgggtggtcgacggtcagctcgccgccgttggcgatggtgagctgttctcgcaccagatcaaggccgcagacctcttcgctgacggtgtgctccacctgcagacggggattgacctccaggaaatacaccttgccctgttcggtcaccatgaattcgcaagtgcccagaccgatgtagtcgaccgcttcgaaaagccggcgtgagtaagtctccagctgttcgagcacgccgtcggaaaggaacggcgccggcgcttcctccaccagcttctggttacggcgctgcacggagcagtcgcgggtggaatacacggtgaaattgccgtgcgaatcgcgtccgcactgcgtttcgacgtgacggcccttgtcgatgaaccgttcgacgaaatactcgtccaaatcgccgccctgcagcgcatcgtggttcatgtagaagccacgcagctcatcgtcgttgtgcacgagagtgatgccgcggccgccaccgccgtcggtgcgcttgagcatcagcggatagccgtgcgtgtgcgcgaagtcgagcagcagtcgcatgtcggaaatcgactgggaaatgccgggaaccggcggcaccttcgcgaaagtggccacgcggcgggccgtgatcttgtcgcccaggtcgacgagcgccttcggattcgggccgacccacgtggcgccggcgtcgaggaccttctgcgcgaagcttgcgacttcggaaaggaagccatagccggggtgcaccgcgtcggcaccgctgcgctgcaggatgtcgatgagcagatcctcgttgagatacgtgtccttgtaggtgtcgccagacagcagatacgcatcatcggccatctgcacgtactgtgcgtgacggtcctgttcggcgtagaccgcgaccgtgggaatccccatctcacgtgcggtgcgcacgactcgaagcgcgatttcgccgcgattcgccaccagtagtttgttgacattcttaggcataatgtcaagtttggcggtcgaggtgtgattcgacgaactcgtttcccacaaaagattcgcgatctttttgtaaggctccacaaacgttaccgaaacttagcaaccctacgatggggagcattgattgacgaaagactcattttcgtcagtttttgtagcatcctgtagcatccgcaaaaaagggaggattccaccatgcgcaacgcaatcctgaccatctcatccgcggccaaaacggccaccagcggcaaattcggcgccgttttgaagtccacgctgttcgccgtgctgctcgccgccgcctccatggcgggcgccgtgccgattccgggcactccggttccgatcaccctgcagaccttcgtggtcatgctggccgcgctgatgctgccgtggaagcaggcgggcgccgcggtgctcatgtatctggccgcgggcgcggctggtctgccggtgttcgccggcggcgcgtccaccatggctttggtcggcccgagcgccggcttcctcatcggtttcctgccggccgccgtcgtcacctcgctgctcaagggcaaggcgcgtgtcgattccctgaagcatgttgtgttgaccgccgcacggtatctgttcgcctgcgtggccggctgcatcgtgcttgactatctgctcggcttcatcgtgcagtccgccattacgggcgtggcgatgccggtggtggccatcgcttcgatgggcttcattgtgggcgattgcatcaaggcggttgtggcttcgctggtcgcgagcggactggcaaagctgcagtgacttttatcggcagcgacttttctgcggtagttttctacaactttttgctgggaattttcagctgagggttttccgctgagaatttccgctgtgatttccgggtttcttcgtgatttccgggttttgatacagtcttccgttttcgctgtgattttcgttttcgctgtgtccggtggggccggcggataccaacgtgcgacacgctccgggccgctcaggccgagtctttacggtcttacgttggtatccgccggccccacctcgttttgggggaatgttgcgtttgcgggtggcgcggtttttggatattgcgattttgggaaatgccgcttttctcgaatattgcgtttttttgaaacgtgcgattttcgaaaaaagcgctttacgactttatgagggatgagggttagagaattattggggtaggacgcctacgtcggcggtgcgcacggtgtgcaggttgccgttgtcgtctctgatggtgagggaggcgtcggggttgagttccagcgcggtgccgcgcagggtggtgccgtccacgaaatgcgcctcgcatggcttgccgagcgtccagcagaccggacgcatctcctccatcgcacgcgtagcctcacgctgcgggtcggcttcgaaatcggcgagccttgatcgcaaaccgtccaccagatgggccgcgatcatgtcgcgcaatgtcatggaatcgggcaggccatgcgcgaccagctgcagcgacgtggccttgtcggttggcagatggtcttcggggacggccaggttcaggccgatgccgaagacgatgccgacgcgttccgttgcagcagccacatcagtggtaccagttgtaccgtccgcgatgggagttgcggcaagcggaaccatttcggcgagcacgccgcccagtttcttgccgtcgacgaaaatgtcgttcggccatttgagcacgatgtccttgccgagcgggccgccgcaatcgcggatggccgcgataatcgcgttgcgcgcctcgcagccggcgatcatctgcagccagccgttgacggacgtgtcccgcacaatcgccgtaggcacgctgaccaccagggagacgatgaacgactcccccaccgcgctggtccattgatggtcgagacggccacggccggcggtctgctcgtcggcgcagatcgccacgatttcacggccggtccaatcgcgtccatcgcagccatcgaggccatctcggctggtcgagccgaacagcgcgcctttgcgcaccaattcggcggcgtacgtgttggtggaacccactgagtccagcgcgatcacctggtcggccgcgacgcaggtgcgtggcatggtcaatgcggaatccaatatggtcgtcatgattccttctcctgtccgtcgagctgtcgtccatcaagctgtcgtccatcgagatatcgttcgtcggcgtcctgcttgtcggactgctgtctgtcgatgcgacgcccgccgatacgccgtttgcccgccgtcgacgtgccaacgtacgacgcctcgcgtgcggcaagccgcgcggcacgcgactcgcgccagaactccaggcacaggaatccgaacacgaatgcgatcggaagcatatgccgttcgaaattgttggccggtgcggtgatcatcacacccataagcagcagcaacggcagatgccatgacagcgaccgccatcggcgcagcaccacttcggcggcgccgatcagcagtgtcagcgtgacatacaggttgccgtgcgtcacccagccaagcacgggaatctgtccccatttcttggcgaaaccggccacctggttgcgccactggtggttgtacaggtgaatccattcgttgtcggactgcacgtaatcgttgttcacgtagtagtccatcgacacgtatggcaggtcggtcacgttgaagtatccgaagcattcggcgaagagcgcgtcgagcgcgatctgaggattcgccttgacgatctgccaccatgcgtcgttgaaatccttcatgtcgtccttggtgacggtacgccacttgtagctgaccttcttggactggatgcccgacgatttcaccgggtcggcgtcctgctggaagtatgattcggccatctggtcgaggttgaagacaggagcgagtttcttggccgcgtcctcgggaatgccctgcggattgtatttcgccacgcgggcgatctgctgcagctggatgccacggctttcgatcggatcgccgccgatgacggcaccgctgttcaccagatagacgaggccgccatggatgagcacggtcggcagcatcaatgcgaccacgtacgtcttccaacgtttacggtcgttgatgatggccagcagcgcggcgaacagaatgatgtaccacgcgtatttggcgctgatcagcatgacgcagctcgacatgaacagtgccgccaaggaacgtttgcgcagtttcatgggcttgtcgttgatggtgggcagcgccttgatatgcgtcatatgcagctcataccacacgccgaaccaccagacgaacgcgaacgcgaacaacggcgatttggtcagtgagatcgtggcgaacaccgccaacgggcacaccatgaagaacagcagaatcacgaagcgtgtcttcgcgccggcgcgcagtctggacggacgcgccaccacacccgcctcgggatgggtgaaatcgcgcatgttccagcagtcgtgccgttcgggatgggagaagtcgaacgtgccgacgcccagcctacgccacggcagattgaagaaacgattggcggtggctgcacaacaaaacgcggcgaacagccattgcagcgcggccagcgccacgatgccggcgtcattggaatcggtgaaataccgggagaccgcggcgaacgcaccgtagaaaacggtcagcacgatgttgtgctggtcggtcagatacgtgggattggccggccacatgtaatgcgcggtcggatagatgtccatcggcacgaatgagaagaagccgatgtacggctgtttcagtccggtccactggttcaacgcccaactgaattcgcggatctgggagcggatgtcggcgccgtacgcggcgagcagggtggtcggaatccacagccagccgatgacgaacagcagcatgagcttccaccagcagtcggtgcaacgtgtcagcttgcggccgatccagacgatcaccgcatggatggcgcgccccggacggctatgcgcggcgtcgctcagatgacgcagcatgatgcccaataccgtcgtcggcgtgccggacacctcctggcacagcttgacgtaccgacgcgagaaatacgtcggcagcacgcgctcgccacggccgtaacggaccagagaccgcaatatagcaaacgaaacaacgaaggcgatcgccatgtacagcacgttggcccagccgaagtcggcgagtccggtgccaaaccagtacagcgggccgatgccgcagcaccacgccacccacaggcatgcgagcacgcccaacgtccagctgaggaacgtgtcggcttttccggctttcttgttttcgctcatagtcggcatattaccgccactgcgcgaatggggaccggaacggtcggcgaacgtgcggcaattcgcagatacgacgattagaatggacggttatgaactccgagcaggcagacatcctcgaccttttgtcaggccataccgacgatacgaccatcgagcggttggctttcgaatgcctgttgacgaacatgaccgacgatcgtgtggtctccttgatgaacattctcggatggcaaggcgatttcaactgttttgcgatcggcggggtgccttcggccagtcttgcctcgacatccctcgccatccgcaaggcggtgcgcgatttgggtggcgagcatgtggtcatcggcacgtacggcactttcctgctggctttggcttgccagatgggcgcggtcacgccggaggtgacctgtaccgcggtcatgccggcgttcagcgaggacgagccactgtatttgagcccggtccgttccggtgtggcgggggcttcgcatgcgttgcgtgagacgatgttctcgctgcaggcggctccggcgctgtccactccttcccgtccgctgcgtgccgacgagctgttgccggagcgtgcgctgctgggtgatgattacgcgcgtgaggaactgtatcggaacgtatatcaggtgctgcgcggcgagaatcccgatgatcccacttatctgacggtgtccacgttcctgaagtatggcagttcgttggagaacacggcgaaggagctgaatgtgcatccgaacaccgtgcgctaccgcttgaagcgtgccgccgaaacgaccggctgggatgccaccgatccgcgtgacgcgtatgtgctgacgaccgcgctggcgattggccgtatgcgcgaccgctgagccgctgcccgggtggtgtggcgtctgggtacgcccgttgcgtctgtcatccggtcataaagtcatgaatctttccgaacatatgaaaagacccgcatgctgcgattgcagatacgggtcttttggtgaagcttagcttctgtgcactcaggcaacgaccgccggatcaaccgggacgcccgggttcatcgtggaggtgatggtcgccttggtgacgtagcggcccttcacggtggacggcttcagacgcttgacttcgtcggccacagccttgaagttctcgtccagagcctgctcggtgaaggacatcttgccgatgaggaagctcaggttgccgttcttgtcgacacggaagtcaaccttgccgcccttgatgtccttgatggccttggtgacgtccatggtcacggtgccggtcttcgggttcggcatgaggccacgcggaccgagcacgcggccgagacggccaaccttgcccatcatgtccggggtggcgacgacggaatcgaagtcaaggaaaccgtcggcgaccttctgcacgaggtcgtcgtcaccgacgatgtcggcgccagcctcgagagcttcggtggccttcgggccacgggcgaagacgaggaccttggcggtcttaccggtgccgttcggcaggttcacggaaccgcggaccagctggtcggccttgcgcggatccacgttcaggcgcagcacggcctcaacggtctggtcgaacttgtactccggcatgctcttgaggagagcgatggcttcgttggcggtgtaaaggttgttgcgatcgatcttctcagccgcttcgcgatacttcttggaacgctgtaccattagtccttctcctctcagtcggtaaccgtgatacccatcgaacgggcggtgcccgcgatgatcttcatgccggcttcgacgtcgcgtgcggacagatcagccatcttgatttcagcgatctcacggacctgagccttggtgacggagccgaccttgtgggtcagcgggttctcggtacccttctggatgccagcggccttcttcagcagagctgctgccggcggggtcttcaggatgaaggtgaaggaacgatcttcgtaaacggtgatctcaacagggatgacctggcccatcttgtcctgcgtggcagcgttgtactgcttgcagaagtccatgatgttcacgccatgggaacccagagccggacccagcggcggagccgggttggccttgccggcctgaatctggagcttgagaagcgccgagactttcttcttaggagccattgtatggttcttctttctgtgaagcggtggttaacggcaccggagtaggtctcccgcgtccggttccttccgcaacgtatattgctgtgctgtgctagcaggtgccgccgccttgttcaggcacacgagaccctccagacacaacttttctattatgcgattccgccacgacattgcgcgtatggcaatacatacaaagaaaccccgccgaagcggggttcaaaagaatcacgatttcaggttcctgaatgggtgtgacgcgtgcggtagcaaggcgcccaagcgcaggcgtaccaaggtgcgtcaagcttggagcaacgcagctaacgctccgtcatgcacgttcaggctaatttttcaacctggttgaagcctagctccaccggcgtgtcacggccgaagatggacacgagcacggtgagcttctgcgtggacggatccacttcggagacaaccgcggccatggtggtgaacggtccatcggtgacggtgacctgatcgccaggagcgtaggagacctcaagcttgcgcttcttggctgcggccggcttgtctccggcggccttgagagcttcggaagcgatcatcggagccatcatggagacgacttccttgcgggtcagcggtgccggatccttggtcgggccgacaaagccggtgacgccttcggtctcgcggacgatacgacgggcgttctcatccgacagcatgcggatcagcacatagccggggacacgcacgcgggtgatgaccttcttgcccttttcggtgtgcttttcgacttcctccatcggcacttcgacctggaagatcttgtcttccataccgaagctggccacgcgggattcgacgttggtcttcacgcgcttctcatagccggaataggtgtgcagcacataccacttgccttcaagcgtgcgcaggctcttagagaattcctcgacggccttggcaccggcatcctgctcagtgtcttcatcctcagtggtttccgcggtctgctcttccggagcgtcctgctcggactgggcctgctcatcggtcgcctgatcggcggcgacggcctggacggcctcgccttcggccggcagcgcctcaacagcggcagcagcctcggtatcagccttggaagcctcgtcgaggttgtcggaaaacacttcgtcagtcatgcactttcaccttcaagttgtttatcagccgaatatccacagggtcagcttgcccagaccgtagtccatgccggtgaccagtgccatcagcagcagcacgaagataaacacggcgagggaccagaagaacagttccttgctggtcggagtgacgaccttgcggagttcgtcgataatctgtttgatgaacaagccaatgcgcatgaagatgttcggcttaatggccttctcgctgttcttcgccttcgccataataatcctccgctgggcttgttgtaagaagcttggcagggaaggcgggactcgaacccacaacctacggttttggagaccgttgcgctaccaattgcgccacttccctaggtgaactctgccgtctccacttgccggcgaggattctatgcaaaaccacgcaagaagcagacggcaaaaccgccaagtcgaaataatagcgggttttcgcgacttcgtccaacccgattcacgacgaatcgcaagaaaccgctattttccaacgaaaaaaagattcgcgcccggcatgtcaccgaagcgcgaatcgctaaaaatatcgtctatcaactgaactttccgtcagttgagcgcggggccggtcggctcagtcctcgacccaacgcttcatgcgacgcatgccttcgaccagatcgtcgtcggcaagcgcgtaggagaagcgcaggtagccgggagcgccgaacgcctcgcccgggacggcggcgacatggccttcgtcaagcaacgcggcggccagttcggacgtgttggcgaacgtggtcttgttggtgccgatcggtttgttcagcagcgcggtcacgtcggcgaacgcgtagaacgcgccggtcggggtcgggcagttcacgccttcgatgtcgttcaacgcggcgacgatggtctggcggcgcttgtcgaatgcggcgcgcatctcgtagacggcgtccagggagccggagacggcttcgatggcggcacgctgggagatgttgttcacgttggaggtcatgtgaccctgcagtttggatgcggccttggccacgtccacgggggcgatcatccagccgacgcgccagcccggcatggcgtaggttttggccacgccgttgagcacgagcagctgggagcgcacttcgggcaccgcggcgccgatgtacgtggttttggcgccgtcatagttcaagtgttcgtagatttcgtcggaaatgacccacacgtggtgttcgatggcccactgcgcgatggccttgacggtttccggcttccacaccgcgcccgtcgggttgttcggcgtgttcacgatgatggccttcgtgtgttcggtgcgcgcggcctcgatgtcctcgatgctcggctcgaagttgcggtcggcgccggcgaacacggtcacgggcacgccgccggcgagcttcacggcttccggatagctggtccagtacggggtggggatgatgacctcgtcgccctcgttgagcaagatctggaacgattcgtagacggcctgcttgccgccgttggtcacgatgacctggctcgggtcgatttcgtaacccgaatcgcgcaacgtcttgtccgcgatggccttgcgcagttccggcaggcctgccgtcggcgtgtaacggtagtttttcggatcctgcactgcggcggccgcggccgcgacgattggcgccggggttgggaagttcggttcgcccgcgccgaatccgatgacgtcgattccggcggctttcattgccttcgccttggaatcgacggccagagttgcgctcggagccacgtgattgatacggtcggatagagtctgccagtcagccatagtcatgcctgtaatgctagacctgccacgcgaaaaacgacagccccacgacacacgtctatttctccgcgaacgcttcgcttgaagcgaaatcgatggcctaaccacaccttttgcactggctcagaccagtacgagattgtcgcggtgcaccagcggatgcgcgtattcctcgccgaggaaacgcttgagctgggccgtattgcgtccaagcatctgcgggatctcctcggagtcgaagccgaccaggcccttggccaaatggttgccctgctcgtcgtcaacccagacggcgtcgccggcggcgaaatcgcccttcacttccaccacgccggccgcgagcaggctggccgctcccccgcgcaccgccttggccgcaccggaatcggccaccagcgtgccctgcgggtgggaggcgaagccgatccacagcctgcgcgacgaaccgcggtcgttgatcggcgcgaacgcggtgccgaccggatcgcccatcatcgcgggacctgcgttcgacgcgcatgtcaacaccgcgggaatgccggacaccgcggcgacgcgcgcggcctccattttggtgaccatgccgccggtgccgacgttcgagccggttccgccgacctgaaccttcgccagcgcgtcctcgacgttcggcacataggagatgcgcttcgagccgggctcgcttggcggcgcggtgtacagcgcgtccacgtcggtgagcagcacaagcgcgtcggcgacgacgatgttggcgatgagcgcggacagacggtcgttgtcgccgaaccggatctcgttggacgcgagggaatcgttttcgttgatgatcggcaccgcgcccaagtcgagcaggcggtcgagcgtacggcgcacgttgcggtactgctgtggggcgatcgtgtcagaaacggtgatgaggatctgtccgacacgcagcccgtaccgtgcgaaagcggcttcgtactgtgccatcagcaggccttggccgacggcggcgcacgcctgctggtcggctacgtcggtcggacgcttgtcgaaaccgagcgtgccgaaaccggccgcgatcgcgccggaggagaccagcaccacgcgtcctcccatcagccgtacgcgggcgatggccgcgacgagcgcgttcagacgttccggatccaagtgtccgctcggctcggtcagcgagctggagcccaccttcaccacgatggtctgcgcttcggcgatggccctgcgcacttgcgcttgcgatggcgtgttcatagttcctcccggtaccgttaccggctattgaaaaagcccaccgacatgccatcggcacatcagcgggcttcgttggatggttctattgttccacatcctcgtcgtcggcggtctcgccacgtccaaaaagactggtttcgtcgtgacggtcgtcgtccacggaaggatcggcccagtgtcctgccttgcgttcggccatcatggcttcgcgcacggcctgacgggcgtccatcatctcgtggtactggcgacggcgttccgtgttggaacgacgctgcgcacgaccatccgattcctgcagtcgcaggtcgacgccgcgtgcgcccaactgggtgccgtcgagcatttccgcgccggccgcgatggtcggatcccaatcgaattccacggcacggtcgccacggccgatgcgcacttcgtcgcccggcttggcgcccttgtgtcgcagctcgtcttcgacgcccagcttggccagacggtcggcaaggtagccgacggcctcgtcattatcgaagttggtctgcatgacccagcgttccggcttggtgccgagcacctcgtaccagacttcgccgttgccgttctccttgcgttccacggtgaagtcgagcgcgttgccgccttcgtcgttacggcgacggcgattgcgcggctcctcgagcggcttgatgaccacgcgggcctcttcctcggcctgctcgcgtttggcgacttccgcgcgcatgttggtcacgaggtcggccagcgcccagttgagttccttcagaccctcgtgggaggcggtggagatgatgtagaccttgaggccgagcttttcgaattccggcttgacgaattcggcgagttccttggcttccggcacatccaccttgttgaggatgatgatgcgcggacgttcggggatcggaatcgcgccgagcggcagttcgagcttgccggcgtattcggcgagctcgtgttcgagcgcctggtagtcgctcatcgggtcgcggccgggttcgagggtggcgcaatcgatgacgtgggcgatgatttcagtacgttcgatgtggcgcaggaattcgaggccgaggcccttgccctgggatgcgcccggaatcaggcccggcacgtcggcgatggtgtagcgcatgtcgccggccaccactacgccgaggttcggcacgagcgtggtgaacggataatcggcgatcttcggtttggcggagctcatcgccgcgatcaggctcgacttgcctgcggacggaaagcccaccagcgccacgtcggcgatggacttgagctcgaggatgacgtcgcgttccttgcccggctcgcccagcagtgcgaagcccggcgcacgacgggtgcgattggccagcgccgcattgccgagaccaccgttgccgcccgcggccacgacgaacttgtctcctgcatgacgcaggtcggcaagctgctcgcccggatgcttcggcttgccctgcggtcccttggcttcgaacacgaccgtgcccaccgggacgggcagaatcaggtcggcgcccttcgaaccgtccttcgtgtcgcccaggcccatggtgccgctttccgcctcgcgatggggcatgaaacggtagtcgagcagactgttggcgttcgaatcggccatgaagatcacggaaccgccgtcgccgccattgccgccgttcggaccggccaacggcttgtatttctccctacggatgccggcggaaccattgccgccgtcgccgcccttcacatggacggtcactcgatccacaaaatcactcatgtatctaccttacatagcagaaagaccgcgtccataacgggcgcggtctttcatcaaaaagcgctatttgcgcgtgtctcaggcggcaatcacgtcgacgaccttgcggtcacgacgcacgccgaacttcacactgccgtccttgagggcgaacagggtgtggtccttgcccatgccgacgttctcgcccgggtggaacttggtgccacgctgacgaacgatgatgttgccggccacgacggcttcgccgccgaacttcttcacaccgaggtattgcgcgtttgaatcgcgaccgttgcgcgagctagacgcgcccttcttatgtgccatgtctgttcctttcggtccttgactctaaccctacgcgaatcaggcgatcgccgtgatcttgacgagagtcagctgctggcgatggcccttgcgacgagcaacgccggtcttgttcttgtacttcatgatgctgatcttcgggcccttggcctcatcgttgacaacctcagccttgacactgatgttggcgagatccttggcgttgacggtgaccttgtcaccatccacaacgagagcgaccgggaattccacggtgtcgcccttcttggcgtcgagacggttgacgaggatgacgtcaccgacctcgaccttttcctgatggccgccggccttcacaatagcgtacatatccgttcctttattaacttggaaagcttactgcccggcacgttcgagcctcgcggccagacaccagcaatctaatctacacatacccgcgtacaaccgcaagtctgctcccggcgtgtcaggttgacataccgggattttcctttattcttcttgttcttcctcgcccaggtccgcattgttggcggccacggctgccgccgcgatctgcgcgagtttggccttcacgtccggcgaggagcccttcggcacctgcacgtccgtgccatggccatgcttgttggtcttgacgaacggatcgccgcccttcagggcgtacggatcgtcgtaatccgccgaaacggtcggttcgtcatggaggatgaagccgcggcccttgcaggtcgggcattcctcggagaacgcctccaccagaccctggccgatgcgcttgcgcgtcatctgcaccagtcccagcgaggtgacttcggccacctgatgcttggtgcggtcgcgcgccaggcactccaccagtcggcggagcaccaaatccctgttggccggcatgaccatgtcgacgaagtcgatcatcaccatgccgccgatgtcgcgcagacgaagctgtcgcgcgatctcttcggccgcttcgaggttgcaacgggtcaccgtttcctcgaggctcttgccgcggccgatgaaacggcccgtgttcacgtcgatagtggtcatggcctcggtgcggtcgatgacgatcgaaccgccggacggcaggtagacctgacgttccatgcccttacgcaactgggagtcgatctgccacttgtcgaacacgtccttgccgtcatgttcggccggatcccacttctcgagcttgtccttgagatcgggggccatcgtgtcgaggtattcctcgatacgctcgtacacgcggtcgccttcaacgatcatcttggagaagtcgtcgttgaagatgtcgcgcaccacgcggatggccacgtccggctcgccttgcagcagcttcggacgcttgccgtgcaggaactcgtcgcgcttggcggtgatgcgttcccactggcgcaccaggttctcaagatccttggtaatggcctcttcggaagcgccttcggccgcggttcggatgatcacgcccatatccttcggcgcgatcttcgacacgatgttcttcaggcgggcgcgctcacgctcgctcagcttgcggctcacgccggtcatgccgccggacggcaccagcacgaggaaacggccggccaaggtgacctgcgaggtaagccttgcgcccttgtggccgatcggatccttggttacctgcaccagcaccggatcgcccgacttgaacgccagttcgatacgacgcggctggccttccagacgtgcggaatcccagttcacctcgccggcgtacagcacgccgttgcgggcctgtccgatgtccacgaacgcggcctccatgctcggcagcacgttctgcacgcggccaagatagatgttgccgacggtggccacttcctggatgtcggacacgtaatgctcgacgagcacattgtcttcgatcacggagatctgggtgtggcgctcacgttcgcgcaccaccatcagacgctcgacgtgttcgcgacgggccaggaagtcctgctccatgagctggttctgacggctgcgttcacgacggttgtcgcggcggcgctgcttcttggcttccagacgggtggatccttcgacgtcggtgatttcgtcgatgtactgctgcttgcgggagcgacgggacatcgtctcgtccgattcctcggccttcgaccctccacggcggcggcgacggcgacgggtcaccgtgccctcttcctcatcgtcatcctcatgacggcgacgggattcgcgttcggaggtctgctgctcgtcggcttcctcatggttgccgcgtccgcgacggcggcgacgggtgcgcgtcggctgctcgtcatcatcatcgtttccattgcgggactcgtcatcgatcggcgcatacgtgatgccatcgaggaccaggtcctcctcgatctgctccacttcggcagcggcacgacgttcctgcgcgttcagacgacgggaacgacgggaacgacgggaatcgccatgatcatcgtcttcggcgtcgttgttgcggtcattgccgtcatcacggccgcgaccgtcattcgaagcgtccgtgcggtccgtgtcggccgtgtcgtggctgcgacggcggcggcgacgagtcggacggtcatcgtcgcggtcatcacggctgtcacgggcatcgtccgaacctctgcggcccgtatcgtcagcatcgtcatcgtcggacgatccgcggcccgcgggggcggccggcagaatcggctcctggaacagcagcgacgtcatcggacgcggattatgacgcgtctcatggccttccggcagcgcgctgacggcgtcgagcgcacggtcttcggatgattcgtcacgattgtcacgattgccacgattgccgtaatcgtcacgatcgtcacgatcgtcacggtcatcacgcggctcgtcgctgatacggcgacggcgacgcgacgggcgatcatcctcgtcctgcacgtccacagaggaacgacggcgacggcgcggacgttcgtcacgcatctcatcgtcgtcatcgtaacgggtcacgcgacgacgacgcggacgcgacggctcggcgtcatcggcatcattgaaatcggcggaatcacgcgcaggctggacaggctcaagcttcggttcctcaaacaagggggctttggcatgctcctcgaccttcagctccaaagacgcgcccgcggcacctacgccacgcaccacgcggcgacctccacgacggcggcgcggagccggatcggcagacacagaacccgcactgcttgccgcattattggttgaattatcggatgacacaacagcctcgacctgatcgaggccctcattggtagtaggcacaacgctcctcggcaacgcgctgcaatcgcatcgccttcactcaagccccaacggttctcacaccacgctctcaccgtggccgcgcatcatggcgcccgtaggaagcaacttccgtcaaaagtcttcatcatgcgacggcggacacctgcgctcgcgactcacagaacattcacgcgaggggatcaacgccatcggatgcgtcggcggtcttgcagaaccaccgtctataagtatgacacaaaaaacaacggagcgtgacaggacgggaaatttattccccctacacgctccgttttccaatgattcgcgttgacacgccgtgaatgaacgtgcgccggcatagtggttcagcagcggttcaacggtggaccaatagtggttctgcggcaagcccgcggcagcgaattaccggcgattcaacggcagctcagcaacgactcaacggcgattcaacgcagccagtcctccagcaggtcggccatgagcagcagatcggtctccggcagctgctcgtcctgcttgtgagccagcagcgggctacccgcgccgagattcacggccggaatgcccagaatcgcgaaacgcgccacatccgtccaacccagcttggcaagcgggtcacgaccggtacgttccttgacaagcgataccagcgattgggcaagcggcgaattgaggcccggacgcgcgctcggcgattcgtccttcatctcgatgccgaagccttcgaacacgccaccagtggcctgatgctcgccgttgccaagtttcgcgcccgcatccgcgccgatcatcagcgccttcgcctcggcgagcgacttgtccggcgcgaaccggtagttgacgtgcacacggcactcgtcgggaatcacattggtacccttgccgccggaaatcagcgtggcgttcagaccctcctgataggtcaggccatctacttcgatggcgcggttctcatgtgcgttcaaacggttcagaatctcggccgccgcgtggatcgcgttcttgcccatccaggcgcgggccgaatgcgcggcaacgccgtgcgtgatcacgtcgaatcgcatcgtgccgttgcagccgccctcgatgccgcaaccggtcggctcgccgatgatcgcgaaatcgccggtgatccaatccggatgcgactcgaccaccttgcgcaggccgttcttctcggccgcgacttcctcatggtcgtaaaacacgtacgtcagatcgtatttcgcgtccgtcagcgtggccgccagatacagcatgaccgcgtcggaacccttcatatcggtggcgccacgaccccagatcacacgctcatgctcatgaccgaccgccacgtcctcgcgaatcagcgaatcgcccggctgaagccatttcggcgggaaattgtcgatcaccggcaccgtgtcgagatggccggcaagaatcacgcggcgctcgcgaccgaaatcggtggatgccaccaatgtgtcgccgtgcctgcgcaccgtcagatgcggctgttttttcaaaaacacctcgacggcgtccgtcagcgggccctcgtcgtcgctgacggagtaggcgcccatgatctgttccatcagctcgttgagctgttcctgcttggtggcggaagcggaaaatccaatcgtaagttcgttcatgccgtccattatccggcaaaagccggtgacaatcgcatttcgggcgtgcttttgagacggtcggccatgctgtcgtgcgcttggtgacacactaggtagcggtccgaggcaacggccgcagcgaaaaggagagtgcaatgccgggtctattgagcgcgatggaaggtttctgcgtcatcggcatcgtcatcgccaccggctatgtggccgcgcgcatgcgcatcggcgggccgaccgcgcagatggtgctcaacaggttcagcttcttcgtgtcgagcccgtgcctgatgttcgccatcctgtccaaggagaagatcttcgagatcttccactcctccatcgtcgtggcgttcttctcggccgtgctggtgggtgtggtctttctgattctcaatcggctgttcttccatatgaaggccgcggacgccaccatcggcgcgctgaattcgctgtatctgaactcgaacaacatcggtctgccgatcgccacgtacattctgggcaatccggcgctcgtcgcgccgatcctggtcatgcagcaggcggtgttcacgccgatcggcctgaccgtgctcgacgtgaccaccaaaggcaaggtctccgcgaaggagattctgaaacagccgttgcaccagccgctgctcatcggctcgcttctaggcattgtggtgtccgcgatttccgcgaaggtcggctatttcgtgattccgagcttcatctacgacccgatcgatatgatcggcgattccgcagtaccgatgattctgatggcgttcggcatgtccttgcacggcacgaagccgctgcaggacaagtcgaacgttccggcggtgttcacagtggccgtgctgaagaacattgtgatgccgatcatcgcgttcctgctgtcgtatttcgtgatgggcttccgtggcgccacgctgtacgcgtgcgtggtgctcgccgcattgccgaccgggcagaacgtctacaattacgcggcgcgatacaacgtgggtctgtcgttcgcacgcgacggcattctgttctcgacgttgtcgtcgccgattttcatcgcgatcatcgcggtgctcctcggctgacctcgccagtcctcgccgcggtatccacgaccgccgcggcgaggccatcaatcgtccatacggtagccggcataaccgagcccgtgcgccgcatgattcgcggcacaccctccgagcaccatcagcgcataacacaagccgattcccgcggccaacgtaagcaacgaagccggattgagcaacgacgttgccagaatcggaaacagcaacaacaccgagcaccccaatgaaacggccatcaccgtgttgagcggggtgatcacttccatcatgcgtgccttgtcgagcgtcgcctcatccgtgccttccaacgcaagcatgcggtactcgtcggcctggtcgtagacgttgcccgtctgcatcacgccggaactgacggcggcgagcaccgcggcaaaggcgagcgtcaggaaaccacccatcgctatatcgcgcatgtacagcatagatgggtcgaacgggtcgtggttgcctccgattccggtggcaagcaatccgcacaccgacgtcatccccgcgatgaacacagcgagcgccacaccggacacgttgcgccaagcacgcttgggattgtcgaggatacggcgcatggcaatcatagtggccgcgtccttcgggtgtttcgcacgcgatctggcgcgcatcgccaccacccaggtaccgacgacgttcaccatggcgaaaccgaggaagaagacgccgaagatgatggcgtagaccaccatctgacccaagtgcgcgaatgcggagacgctgttgagcagcaggtagcctacggccaacacggcaaggaaaatcagtgcgcgccatgcggatggcatgggttgtccggtacgttgcgtcacgccaagcggggtgatggccacgcggcgtagggcgaccagcgcggagaccaaggcaagcagcgtgactccgacggtcacggccgccagagcaggcagtcccacccacaactgttcgaaggtgaaatgctggttttggaagtcgagcagcatgatcgccggtatcagcgcgaagtagccggccatgccgaccagcgcgccaagcagagcctggccacccgcatcgagcgcggtgagtttcgtgacctgcgcggtggtggcgcccgcaagtcgcagtgcggcgagacgtgcgtccctgcgggaggccgcgagacgggccgccgagccggcgagcgccacgaacggcacgatgagtagcagactggcgaatgcggcgagcagcacatagccgtcggaataggtgttcatgacggctgtggcctggtcggccgtccaatggccgtcgccgaccgtggcgacgagcttgtcggcgtgcgccagggttttggaccatgtttcgtatgtaccgggcgcgcacctgttggaattgatcatgcaaccgaacgtgtggtcggcggaggcccgccagatgaagccatgcaggcctccgagcacggttaggaagacggcggtggcggatgcgaaggcaacgatggccagcgcagaggtgcggctggatatgccgcgggtgccggagcggtggaacaatcgccataatcggaacatgttcatcgtgcgcctccggcggtaggttgggattgctgcggcgagctcagcctgccgtcacgcatggtaacggtggcatcgcagaatgcggccacgttcgaatcgtgcgtcaccacgaccacggccgcgccggtctgtcgtgcggtccgcatgagaatgctcatgatttcgtggccggtggtctggtcgagcgcgccggtcggttcatcggcgaagatgactgccggctgcgcggcgagcgcacgtgcgatggcgatgcgctgcatctggccgccgctcatttcgccgggacgttgttgcgcgagctggcgcaatcccaatcgttccagccatagcatggccgtgtcggtggcctgctggtagcttgcgccgcccagcatcatcggcaacgcgatgttttcgatggccggcagttccggcagcagctgtccggattggaagacgaaaccgaaggcgctgcggcgcagtttggtgcggtcagcgtcgctcaaccgcgccaggttggcaccgcgaaacatcacattgccggctgtcggggtgatgatgccggcgagtgcgtgcagtaacgtcgatttgccggaaccggacggtcccatgaccgcgatgctttcgcctgcctggatgccgaaatccacgtgattgagcgccagcatgtgtgtggcgttcggtgtagcctgttgggtcgaataatccatgaccagatcggtcgcgtgaagtatgtgttccatgtttcctacggtacggaaacggattggtcccggccatcagacggcgggatgaacttacaggtttccttccggcatgcatcatccgcaaggattagcgtaatcgcggactgcggatgagatgccgtatgtcagacgagatgccaggagaggcggtgcaggtcgctgggcccgaattcagcgatggcgtcacggtgtgcggccgaaccgtaacccttgttgtgggcccattcatagggttcatattggggttgcgctcccagttcgaccatgagccggtctcgcgtgactttggcgatgacggctgcggtggccacggtggcgcagtacctgtcgcccttcactttggtagagacttccgcaggaaccggcacgtcaggcgcgtcgaaggtgttcagcgctttggtgatgtagtcgttcggtccgtcgaggatcgcaccgaccttcaccggcttgccgtcaagcatgccatcgccgtcgatgccgagtttctcttccgcttggccgagtgcgcgcaatgcggcgatgccaagcgcataggagatgccccaatcgtcgatttccgtgttgctggccgagccgaccgcccaggacgcgcaccacgatttaagctcttcgaatatggcttcgcggcggtgttccgtcagcattttggaatcggccacgccgtcgggcacttgcagcggcgacggaccggacagatcgcacgtgcggattgcggcggcgccgaccatgacgggaccggcgagcgagccgcggccgacctcgtcgaagccgacgatcacgtcgtagccggaggccgcggtcgcccgttccatatccaatgtaggcactatggaaacggacatcagtcggcagatccttccggcacgtccctgaacacgtcgtgatgcgcgtccagcgtgctgatgtggttcagcggccaatacttgaccagaccgacgccgaccacgtcggaaaccggcacgaggccgtgcgaggaatcgtcctgatggtagcgggaatcagcggaattggcgcgattgtcacccatgacgaacacatgtcccgcagtcactttttcactgaacgcgaaggagctggggtccacgccggagcggatgtacgaagtttcgtcgatggccacgccgttgaccgtgaccggcttgccgggcccctcgcaggccacggtgtcaccgggcaggccgataagtcgtttgatgaggtagtcgccgccgaatcggccgctgttctcctgctgcagccaatggtcggggtccttgaagaccaccacgtcgccgcgctggagcttgaagactttgggggtgagtttgctggtgatgacccggtcgcccggttcgatggtgttcagcatggagccggacggaatcacgtagaagccgaacaggaacatgcgcaccagcagcacgatgacgatgggtatgccgcaccagatcagggtgtctcgtaagccgaagctttcctcgctttcgactctttttctggcatgcttcatgggattccttaccgtccggtttcacgcactggcccctatcatagcggcccaatatagaaaatcggctcctcgacgggttgccgaagagccgatttcacgctttattcgcgattcgaactcacttctcggagttgtcgcggcgctcgacgatacgagcggccttaccgcgcaggttgcgcaggtagtacagcttggcgcgacgcacgcggcccttgcggaccaccttgatggaatcgatggccggggagtgcagcgggaagcggcgctcgacaccggtgccgaagctgatcttgcggaccacgaaggtctcacgaacgccgccgccctgacgagcgatcaccacgccggtgaaagcctgcagacgggagttgttgccttccttgatcttcacgttgacttcaacggtgtcaccgggacggaaagccgggatttcctcggccggcttcaggtgcttggcgtcaaatgcttcaatagcgttaaccattgtgtttcctcgagtcgccgccgcatatcggcgcacaggtaagggcttcgtacggcgttcttgcgattgccgtctcggcctgttcttccgctccgcaggtctgcctgcgaagggttgccgatccgccggaaatattgcgataaagcacggccggagttacctgcgaccgttccggctggacccacagaaaagcgggattatgcggcgtcccgcctttcggcacagcaataatcaaaaataccccatccgcaagacacggatggggcatctcgttcagccacacgtcacgcggctttatgcgcgccgatcgtgagtcagaactctcgattcgcgcggtagaacttgatcagggactgggtggacggatcctgggcggccagggcgtcgtcatccttggagatggccggggtgatctgcttggcaagctgcttgccgagctcgacgccccactggtcgtaggagtccagaccccacacggtgccctcgacgaaggtgatgtgctcgtacagggcgatgagctcgccgagcgcgaacggggtcagagccacgccgaagatggaggtggtcggacggttgccggtgaacacgcgggccgggacgatctcttccggggtgccctcagcgcgcacttcgtcggcggtcttgccgaaggccagggccttggtctgggcgaagtagttgcccaggaacagctcgtgcacgtcctggtcgccgtccttggtcgggttcggggtgttcacgaacgcgatgaagtcggccgggatgagctgggtgccctggtggatcagctggtagaaggcgtgctggccgttggtgcccggctcgccccagaagatctcgccggtctcggaggtgaccggggtgccgtcccaacgcacggacttgccgttggactccatggtcagctgctgcaggtaggccgggaagcggtgcaggtactggtcgtacggcagcacggcgtgggaggcgaccttgaagaagttgcggtaccacacgttcagcatgccgagcagcacgacgacgttcttctcgaacggggtgttggcgaagtattcgtcgatctcgtggaagccgtgcaggaactcctcgaagcgggccgggccgaagaccacggcgagggaggtgccgacggcggaatcgacggagtaacggccgccgacccagttccagaagccgaacgcgttgttcgggtcgatgccgaactcggcgaccttctccaggttggtggagacggcgacgaagtgcttcttgatggcttcggcgttcttggcgtcggaaccgtcgatggcgcccttggccttgagctcttcgagcagccaggtgcgggcctcacgggcgttggtcagggtttccagggtggtgaaggtcttggaaacgatgatgaacagggtggtctccggatcgaggcccttggtcttctcggccaggtcgttcgggtcgatgttggagatgtagcgggcggagatgccggcgtcggcgtacggcttcagagcctcgtacaccatgacgggacccaggtcggaaccaccgatgccgatgttgaccacggtctcgatcttcttgccggtcacgccggtccactcgccggagcggaccttgtcggcgaacgcgtagatgcggtcgagcacctcacgcacgtccttgacggtgtcctggccgtcgacgatgtacttgccctcgtcctcgaccgggcggcgcagcgcggtgtgcagcacggcgcggtcctcggtgttgttgacgtgcacgccggtgtacatggccttggtgcgctcgtcgagcttgacggccttggccaggtcggcgaacagctgcagggtctccggcttgatcaggttcttggacagatcgaagtgcaggtcgcctgcatcgaagctcagcttctcgacgcgctcggcgtcatcggcgaaccactgcttgaggctgatgccctcggactgcagctcgtcgtagtgcttctgcagcgcggcccactccggggtcttggtggcgtcaacgggaggattgatggccatgttgataggtcctttcatcatcactgtgaagcggaacgtgacggtggaatctcgttcgattttccacggcacgagccgttttcttcacctcacaagatactcacaaaagccgacagaacaacacaaaaatgtttcccgagttaacacattcggtcggaagcgcgatataccgcggttccgaccacttttcagcggcgacatgccagataaacgacgattactgaaatcgtatgcaacgttcagcggaaaagcttcaacgcacgtgaaaacggctgtcgtatgcaacgatcgcattacgattacgtacgcaacttacgcacgaccacgcacgcggcttacgcaagtcaggcgatggcggcgagcaggaagtgcgcgccggtcatcatgaccaggccgatgatcgcggacacggacagcgagaagccggcgagtttcgcattgccgagcacttcgtcggtgaacagggtggagaacacggcgattggcgcgaggcagcacatcaccacggcttcgcgcacattggcgccgaacggcagcacgaaccatgcgcagacggcgaacagcaggccgaatggcagtcgcagttcgatgatcttcagcagcttcatcacatcgtcacggccggcgggcaggtccatcagcatgccgaccatcagcatggcgacgaacgagttggcgttggcgagcggctcaacgaacgtggccacgacggcggggatcttcacattggcaagcatgagcacgatcatgaccaggtaggtgtcgaacgggatggagccgaagaagcctttcgccacgttgcgtagcagcgcgtggcgggcgagcctgcgggcgtccttgtccttgggcttcacgtacggcagcaccggagcgttcccctggtactgctcgcccagcgtcttgcctggctggatgtgcagtagggtctgcgtcatgacgttcgtgccggccgccaccatcacgcagttgccgatgtcgaacatggccgctggcacgatcgccgcggtgccgagaaacgcctgtaccacggggaagcagaagcagccgatgttgaagccggaaccgttgagcatggtgaacgcgcgatcctgcacaggcgtgtgacgtgtggtgaggaagatgagcacgggcgggatgaacgcgaccacgaagccgaagacggagatccacagcatgctggaatcatgcgggttcgtggcgaacgagtagatgatggcgcagggcagaaccaggttgaacagggcgacctgcatgatgcggtagtcgcggtttttgaatttgccggcgcgtttgaacaggtagccggtgaggatgatggccagcagcgcgattggctgaattaacgtggacatgtgcgcgagatgggacttgaacccacacgtcaaagacacaggaacctaaatcctgcgcgtctaccaattccgccactcgcgcaatcaccatccgcgcacggcgaaaaccgatacgcacggatgcacatatgcaaaaccctagatgctcggaaaacctccgaacatctagggcagtggagccacttgacagaatcgaactgtcgacctgctcattacgagtgagccgctctaccgactgagctaaagtggcgcaatgcccggtaagcatacgctagccgcgcacaagaaacaaagcatagcggaaaaaccggacgagcacaaatcgcacgcacgccatccagtgtcgtgcgccacggcaagcgcccgtcgcggccgtcatccgatgttatttgaccagcgcttcgatcgatgcgaccagcgcgcgcagcgccttgcctcgatgggagaccgcgttcttctcggccggctccatttcggcggacgtgagcttttcgccggcatcgaccgcacgctgcggctgatcgttcggcacaaacagcggatcgtagccgaaaccgttggcaccgcgcggggcacgcagcagcacgcccggcatttcgccgacttcgacggtttcgctggcgatcgtgtacggcttatcatcatccgcaccgtccgctttgcgctctcccggcacgaccagcgcggcggcgcagcggaaccgtgcggtgcgcttgctgtcggggatgtcggccagctgcttgagcagcagcgcgttgttggccttgtcgttgccgtgctcgccggcccagcgtgcggacaggatgcccggcgcgttgcccatgacgtccacgatcaggccggaatcgtccgcgactgccgggcagccggtgcgttcggccacgtcgcgtgccttgatgagcgcgttctcctggaaggtcacgccgtcctcgaccggatcgggcaatcccaaggagcctgcggagacgagctcgatgtcggcggcgtccgcgccgagacgttcctcgagaatgcggcggatttccgccagtttgcctccgttatgcgtggcgacgatgatcttcatgccttacggttccttccgtcgttttcctacttatatctgttttgcgttgttctatgcgccgagtcgccggcatcggaccgtcaacgtcctacattcagcgcatgccgtgccgtcgatcggctcagtcgagcgcgagcgcggcgcgttgggcggcctgcagctccctgttgcctttttcggcgaggtcgagcagggtgttgagttcggcgcggttgaacggacgatgctcggcggtgccctggatctcgatgaaatcgccggaaccggtcatggccacgttcatgtcggtcatggcctggctgtcttcgatgtacggcaggtccagcatcggcttgccgttgatcacgccgacggagacggcggagacccagtccttgagcacacggtcggcggacttgacgtgcttgtgttcctcggcccaatgcatcgcgtcgacgagcgccacgtacgcgccggtgatcgaagcggtgcgggtgccgccgtcggcctgcagcacgtcgcagtcgatctgcacctggttttcgccgagcgccttcatatcgacgacgccacgcaggcagcggccgatcagacggctgatctcgtgcgtacggccgccgatcttgccgcgcacggactcgcggtcggtgcggtcggcggtggcgcgcggcagcatcgcgtattccgcggtgacccagcccaggccggagtccttgcgccagcgcggcacgccggccgtgaacgtggcggtacacatcacgcgcgtgttgccgcattcgatgagcacggagccttccggaacgtccgtgaaatgccgggtgatgcgcaccgggcgcagttcgtccaccttgcgtccgtccgcacgcaccacggtctggtcgcccaacatatccttaatcgctaccattgctgttctgcacttcgctttccgctgatttcggcttttgccgccgtccgattactcgtcttttcagcattcgaccctatcaccagccaagcacgccgcgcctcgagacccctcctgcacgtatgatgggatgcaaccaaagattggccaccgtgggtcctacacttatggtcagtttcaccaaaagtcaagaaaggctttggaaatgctggattattcacccgcactcatgaccgacatgtacgaatacaccatgcttgacgcttgcctgaaggacggcaccgccaaccgcaagtgcgtattcgagatcttcacccggcatctgccgttgggccgccactacggcgtggccgccggacagggacgcatcctcgacgcgctcgagaagttccacctcgacgacaacgacctgaaattcctcgccgaccgcaaggtggtaagcccggaaaccatcaaatggctggagaacttccacttctccggctccatcaagggctaccgcgaaggcgagatgttcttcccgaactcgccgatcctgcaggttgaaggcacgttcggcgaatgcacgctgctggaaacgctgctgctgagcattctgaattacgattccgccgtcgcctccgccgcgtcccgcatggccaccgccgcgaaggaccgtccgtgcatggatatgggcggacgccgcacgaacgaatgggccgcggtcgccgccgcacgcgccgccgtggtgggcggattcaagggcaccgccaacctgctggccgcgcaaatgtacggtctgaaggccatcggcaccgccgcgcactgcttcaccctggtgcatgacgacgagaaaagcgccttcgaatcgcagatcgcggcgctcggcaagaacaccacgctgctggtcgacacctacaacatcgaagaagccgtgaaaaccgccgtcgaagtggccggaccggaactgggcggcgtgcgcatcgattcgggcgacctcgcgtccctcgcgcagcgcgtacgcaaccagctggacgcgctcggcgccaccaacacgaagatcaccgtcaccaacgacctcgacgaatacgcgctggccgcactgcagaccgcaccggtcgactcctacggcgtgggcaccatgctcgtcaccggctcgggcgccccgacctgcgcgatggtctacaagctcaccgaacgcgagaactccgccggcgaaatgcagccggtcgccaagaagtcgaaggacaaggccaccgttccgggccgcaagctcgccttccgctcctacgaatactcgctggccgactgcgaacacgtcatctccggctccgaagacaagctcgccgcataccagccggaagacggctggaaggacctgctcgtcgactacgtcaccaatggcgagaaccacagcgaataccagggccacgacgcgatcgtcaacgcgcacaactaccgcgcgcaggcgctcgccgaactgccgatcggcgcacagagcctgatgaagggcgatccggtcatcccgaccgaagtcaccgtgttgtgacgtccgtcatggcgtgaaccgccctgtacagcgcaaaagacataacaaaaaccgacgcccggtgaatcaccggcgtcggtttttgcataacatacgacgttgcgccgcactcggtcgccgcacccagccgccatattcaatcgccacgttcagccaccgcaaccggcggcatgaatcggcaacatggtcgaacggcaatcagaacgagctgttcatcatctcgtcatagatgcgcttgcaatccgggcacaccgggtaatgcgtggggtcacgcttcggcacccacaccttgccgcacaacgccacaaccggacgacccgtcatcttcgattcagcgatacggtcacgcgacacataatgcgcgaaacggtcggcatcgccattgccaccgtcatcaagcttcgtttcctcttcaggacgttccagaacggcggtaccggtacccgcatccgggttggacagcggcgaaaccggatcgtcggatccgaacaggccatcgaaaatcgcaaatgccataattaagactcctcacacaagccgcgatcgcggccccactgccttccatcatagccgagccgcattgcgccgccacccgtatgcacgaaccgcgccaacacgggcatacgccgatgttgcgcacgttctcaaccaatcgcggtacgcttaaggttatgacaattgcagtttgccccgggtcgtacgacccagtgaccgccggccacctggacgtcatcgagcgctgcgcgcgctttttcgacgaagtgcatgtggtggtggccgtaaacgcggcgaagacgccgatgttctccgaagaaacccgtgttgagatcatccgccaggcgctcgccaagcgcggttgcaccaatgtgaaggtggcgtcgaccaccggcctgatcaccgactattgcacgaaaatcggtgcgacggtcatcgtcaaaggacttcggcagaacggcgattacgaggctgagctgggcatggcattggtcaaccgcaaactcgccggagtggagacgctgtttctgcctgcggccccggacctggagcacatctccagctccatcgtcaaggacgtggcacggcacggaggcgatgtgacgggcatggtgcccgattgcgtgattccgctgcttggcgaggcgctcaagaacgaaaagagagcatgatgagtgaagagaccaacgatttcaagccgcttgctgacgccgatgacgccacgtcgcagcagccggtcacggcggcggccgattatccggccaccggcgctgttgccggtaccgcagcgaccaacaactccgcaaccggcaatgccgccgatcgtgctacggatgagccggcaaagcccgcgaaatcgtcgaaaccgtcgatttccatgtcggacctgcccgaccttcgcgccacgttcgaccccaacgcaccactcgacgacagttcggatcgcagccgcgacgaattcaccaccgtctacgacatcatcgacagcatcgaagaggaattggacgaggccaagccgattctgttcgcgccgagctcggtgcgcgtggaccgcgaatcgttcaccggcaagctcgacaaactcaagaagatgctgccagtgcagctggaacgcgcctccgcgctgatgcgcgaatcggaacgccgtctggaaagcgcgcaaacgcaagccaacgcgatcatcgcatccgcgcagtcgcgtgccgccgacaccgtacgcgaagccaacgagcaggcgcagttccttgccgggcaggagaacgtgacggaactcgccaggcagaaggcgcgcggcattctcgaccaggcgcaagccaaggccgacaagctcacgcagaacgccgacaaatactgcatcaccatgatggaatcgttgcaacagcaggtcgacaagatcggcaccggcgtgcaggcgggcctgaacgtgctgtacgatcgtcaacgcgaagccggcgcgcatctggaccatctcgacgcggacgattatccggaaaactgaacaagacgcgtaacacgcgtggaacgcatagcaagaaagagcgaaagactgaactatggcacgtactgaagattccccgtgggccgtttccgtggcgcaggtggcctcgcgtccggggcaaagcaaggagatcgacgccactttccccgcgccgagcggcatcggcgatgaaatcgtgggcgtggacgaaggcgcggatgtgagcgtggtcggctcgttcgattcgatcgtcgacggtctgattctgaacgcgcgtatcagcgctcccgtgcatgccgaatgcacgcgctgcctgaagccgatccagcgcgattggacggtgaacgtcacctccttcttcccgtatgaagacaagtccgccgccggcaagggcggaaaggccggcaagaacggcaaggaagaggaagtggacatcatcgccggcgaggacgaggcggaagacacgtacccgctgctcgacggcggcgcatgggccgacctcgaggcgctgctgcgcgacacgctggtcgaggaactgccgctgcagccgttgtgcaagccggattgcaagggcctgtgctcgcagtgcggcatcgacctcaacgagaaccccgaccatcagcatgacatgaccgacattcgtttcgccgcgctggaagggctgaaagccaagctggaaggcaaggaataagccgttcggatgggatggtccatcgtttgtacggagctcacgttaagatactgaacgcttaagctcaatcgttcgaacgaaatagaggaaacacaatggcactgcctaagtacaagacctcgcgcgcgaatacccattctcgccgcgcaaactggaaggccaaggccgcccagaccgttacctgcccgaactgcggcgctccgacgctgccgcacatggcatgcccgagctgcggttccttccgcggccgcgtgtaccgcgaggctgtccgctccatccacaccaagtgagtggttgccggataacggtataaagcatcgaaaccctgccatcgacgggtggcagggtttcttttattattatcaagtgatacggcgattgcattgcgatttatttccgcgtgcgatcggcgtacgacacacgttgcttgcgtagcaaaaccgccagatcagctggcgtcttgccatgtgcgcaacggccacaaccacagaccgcggcgggttacggcccaccgcatgaacggtaaggaacatccatggccaaagagaccaatcaggacaacgcacagaacaacacccaaaccgaaaacggcaacaataccaacgccggccgcatcggcacctccatcacccccgaaggcgagatgaccgccaatgtgttgctcgaggcgctcggcaccacaatcgaaccggacctgctcgtcgaagcgctcacccaccgctcgttctcacacgagcatgagggggccaagaactacgaacgcctcgaattcctcggtgatgcggtgctcgaactggtctccacggaaacgctgtacaaggtgcatcccgacatgaacgaaggccagctggccaaaatgcgtgcgaaggcggtttccgaggaatccctgagcaaaatcgcccgtgaaaaactgcacgtcggcccgtacattctgctcggccacggcgaagcggaacagggcggcgcggacaaaagctcgattctgtgcgacatcgtcgaatcgctgatcggcgcgacgttcatccagcacggcatcaacgaggcgcgccgcgtggtgcatcatctcgtcgacgatacgctggcggaggtcgccaccgaaggtccggcgctcgattggaagacgtcgctgaccgtcaaggcgcatgagatgggtctgcccgacccgcactaccagacgtcggtcgccggaccggaatacgcactggagttcaccgcgcgcgcgattctcggcgatggcggcgaagtcatcggcgtcggtaccggcagcagcaaacgcaaggcgcagctggcggccgcggaaatgggctggaaggcgcttgacagtcgcaagggcgaaatgggcggcaagcagaacgggaagacgcataagtcgcaccacaggtcacaccgcaagtccaacggtggcacgcaggatgcagcgcagggcaagtaaccgcgcaaacggtaacgcaagcggcggcacggccggcgtcacgaaacagcattacaaggcagcgtcgcaatcgcaaaaaatatggtccatatcacaatggcgcgtaacgcgccagaatatgggcctttccggcgaaccaagctgtcagccgttagcatagactcattatcagagaggaatgcggctgcaatccgccacaagcggttgcatagcattccgtttaaggggtaaaacggcgcatgaacgacgcgaccgcggccccttacgaggaaattttccacgaacgagcatgagagggaacatggtgttacctacgcctctgcaggcattcagcggcatgccaaaggcatccgctaccactgaaaagcagaccattgtcgacggcgaaaagatgaccggcgccgaagcgctggttcgttcgctggaggatctgggcgtcaaggacgtcttcggcgttccgggcggtgcgattctgcccgtctacgattccatcaaggacgatacgaagttccgcttcgtgctgatgcgtcacgagcaggccgccggacatgcggcagaaggctacgcgctgaccaccggacaggtgggcgtgtgcatcgtcacttccggtccgggcgcgacgaacatgatcaccccgatcgccgacgcgaacatggattccattcctatggtcgtcatcaccggccaggtcggcgtgaacgccatcggcacggacgctttccaggaagccgatatcgtcggcgccacctatccggtggtcaagcattcgtacctcgtcacccgcgcgcaggacattccgcgcgtgctgaccgaggcgcactacatcgcacgctccggccgtccgggaccggtggtggtggacgtcaccaagaccgcgcagaccggcgagatgtattattcctggccgcagcgcatgatcctgccgggatacaacccgactaccaaggcgcacggtcgcgtgctgtccgacgcggcgaagctgttcgagcagtcgtaccgtccggtgctgtacgtcggcggcggcgcggcgcgttccaacgcgggcgagctggtcaaggagctggcggaagtgaccggcgctccgatcgtcaccacccttccggcgcgcggcattgtgcccgattccgatccgaaggtgcttggcatgctcggcatgcatggcacgatcgcggcgaccggcgccgtgcagcgctgcgacctgctggtcgcgatcggcgcacgtttcgacgaccgcgtcactggcaagctcgacgcgttcgctccgggtgcgcgtgtgatccatatcgacatcgaccctgcggaaatcggcaagaaccgtcagccggacgtgccgatcgtcggcgatgtggccaccgtgctcaaggacctcatcccggagatcaagcgcgagcaggccgtgcacggcaagcccgacaccagccactggtgggacgtcatcaacaagtgggtcgaggattatccgattacatgggacgaaccgaccgacggcagcctcgccccgcagtgggtcgtcaagcagctgtccgacatggccgatccggacaccatctgggtttccggcgtgggccagcatcagatgtgggccacccagatcatcgaattcaacaagccccactcctggctgtcttccggcggcctgggcacgatgggcttcggcctgccggcggccatcggcgcccgcgtcggctccgcccgcgaattcgacaacaagaagccggtgtggctcatcgacggcgacggctccttccagatgacttccgaagagctggcggccgcgttcctcgaccacgcgccggtgaagatcgcactgctcaacaactccgtgtacggcatggtccgtcagtggcagaccctgttctacgatcaccactattccgcgacgaacctgctggacggcgagaacacgccggacatcgtggacgtgccggacttcgtgaagctcgccgaagcgtacggctgcgtcggcatgcgcgcgttcaccaaggacgaggccatcgaatgcatcaagaaggccaacgaaatcaacgaccgtccggtgctgatcgatttccgcgtgtggaaggacgccatggtgtggcctatggtcgcagccggcgattccaacgacaacgtcacgtacaagccgggcgtgaagcctttgcagcgcgccggcgagaacgactgaacgagtagcgtaaggaaggaaatttcgatcatggcaaattatcctgcatcccagccgggttccaagcgtcatacgctatccgtgctcgtcgagaaccgtccgggcgtgctggcgcgcatctccggcctgttcgcccgtcgtgcgttcaacatcaactcgctgtccgtctcccccaccgagcgtccggacatttcccgcgtcaccgtcaccgcggaagtggaggaggtgccgcttgagcagatcatcaagcagctcaacaagctgctgcacgtgctgaagatcgtggacctcgatccggagaccaccgtggagcgcgagttggtgctcatcaaggtggcggccgacgagtccgtccgttccgacgtgctggagatcgtgcgtctgttccgcgtgcgcgtggtggacgtgaatccggaatcgctgaccatcgaggccaccggcgccgaaggcaagatcgacgcgctgctcggcctgctggagcattacggcatcatcgagctggtccgctccggcgcggtggccgtgacccgcggtccgaaggcgctgagcgagaaggtgctcggctccgaaatcaccggtcgctgaacgggctgagcggcattgcctacggcaaagcgccgccccacgattcgtttcgtggggcggcgctttttatttcgattcaccgcaacatcgtatgttcccattgcgccgccttgggaatgctacgaatggaacgggaacatatcaccagcacggcgcttgcctcgagaacggcgaagaacaccagcatcgtgccatggaacccgagaaccggaagcaacatgccggccacggcgctgcagaacatcgaaagcacctgggccggaaccgtcaatgtgacggtgatacgcccctgcatgctcgtaggcgacttggcgaagatgaaaccgaggagcatcgcgttaatcaacgggaacggcaggccaaccaacgaattggcaaccagcatgacccaatagttgtcggtcaacgccatcggcaatacgcataagcagatgaacaggtaggcgaggcacacggttggtccaaccggaaccttatcgctgaatttgccggcaagcaacgatcccacaagcatcatcagcgatatgccgccactgatgaatccgatggaggtcgcattggtcccgcacgacaccaaatgcagctggatggcatattggatgccattgacgccgaaattgaccaatgccgccacgatgagcacgatcaccagcgttttcctgtgcaacgaccatgaccagccttccaggaaatcgcggaagaaaccgcctttcactgcatcgccatccgtttccccgatacgcccgccatccgcgccatgttcgcggatgccggtggcggcgacgccggccacggcatacatgcatgccgacgcaaggaacggcagccatggagcaatgctgtacagaaaacctccgatggggcttcccgccatggcgatggttgcgtcacgcccctcgttgaggctccgcgccttgggataatagcggatatcgataatcgagcgaagcatcgcatccgtagcgctcccaagaaatccgttgatgccggatgcgagcaccgcgatcaacagcaacacggggaacgacaatgcgccgcacagcagcagcaccgcaactgcgccccaagccagaacgccgacgacggcgttcgccacgataagccgtttgcggtcatgcctgtcgacgaaggtacctccgaatacgctcgcaacctgttgcgcgatcatcgacgacgttccgagccacccggcggcgatggtggaaccggacaccgcatatccaagcaaactgatcgccagtgcgcgcagcgccgcaccgaccgccggcgccgtatcagcggtaaaccaagaaacgtaccctgcggattgccagaatgatttcgctgttccgtccatgtcttgtttcacttgttttccctgttccgtccacgctgttcagatcgcctatgggtccatatgcaaagcccgccgactccttacgaaaaccacctgaaagcctgtagaatcagcgccacgggttcggcgcccggctcatcgtcgccatgcatgccggccttgatttgccagcgacgtacgacctcattgagttcctcaatcattaaacacatttcctcggcggtcaggttcagaacatgatcgtcgctggtgcatgaatcggcccattcccgaggcaattccggcagcctgtccagaaaacgctcgtaggccatctcgtaggaaagtgccgccgaacgccgaaacagatccatggcctttgccttgtctgcactgttcttttcttcggagttccccagacgaacggcggtttggcaagccttccaccagctttttcttcggtcgccatcaggagacctcaccttctccaccagtcccacccgtgcaagctgccccaagtgatagctgatggcccccggagcctcgccaagctgctcgctgatgcttcccacggtctgctcgccattcacccgcaacgttccaaggattctcatacgaatcggactcgccatggcccgaagagtatcggcattggtcacggtcactgcggcatcttcgggcatccgcgcttcgttaggggtcacgtcagtcattgcaaaggtcccctttccaccgcctcccattatatacaaattttttgtacaaaatatttgcttttgaatgggttcgcaacatgtgtctcaccggtaacgccgcgatctattgcagctgcgaaaaatgtctattctggaacgagaaacaaaccacgggggaatttatatgcgcacgattgtcaatgattcgactctagggattgtggataatgatccactggtcgcgagcgcaattcaaagcttattggtcgagacatgcgcaccaatacagattctgtggactgtcacctctgcagaacaagcacttgaggccatgagggactctgcacaaaggccacaagccgtgcttaccgatatcgcaatgcctgggatgaacggctcggaattagcgcatcatatcaaggaacaacatccagatattgccgtcattggtatcagcgcctttttggatgacgaaaacgaaaaaagatacggagcacaatggtccgatgcgttttatgcgattattccaaaagaaattcccacgattcaactggttcgaatcatcggaaaagccactggaaatgacgaggttgcgtcgtgggcggggaagagcataaactccatgcggctttccggcaaggaattacagatcattgccaactatgcgagaggattcaccacttccactattgcacaccaactgaatatcagcgaagcatcggtaaagacatatgcacgacgagctttcgagaagctccatgctcatagtcgtgccgaagctgttgcgatgtgcgtaagaaacggttggatataacgatgaggctgccccaacaaataatgtcattggcaaaggccgtgcgcaagccttacttagcgggatccattatctgtatctgctttttcctgctcgagctgaccgcttggccaaatatgtcaccttggtcatggctatatttggctccgtactgcatcgctctgttgctactgacttggttccccgtaccggcaagcatggcgattcttgtaacacacatagcatgtgcaataatcccggcaatatgcgatggcccttcgacgttatatggcacatggcttgtatgtggaatagttgcttttgaaatcaaacgatttgaatttgccatcatgggaccgctgctttgcgcactagcacttcctttgggctattggacaggcggcatcgactacaatccaagcatccctgtgcttgcgtgctcctacattggagcattcttcgttggctttgccatacggtggaagatacagacagagcaacggaaaaccgacctggcgattgcacaagaacaagttcgacgccagcagaaaagactcaaagaaattcacatactgcacgattccatcgcaggagctatgacatatgcgattctgctgtgtcgcaagaaagagccctcagagagcagcgacactttgccacagattgaacaagtcctcatgcaggcattacatgagcttcgcactcaaattatcagcccgatgaccgatgagcttaaaacagacaaagaggaagacgcggacgagctctttcaacaacatatagaagctcaatgcaaaagactgagaatactgggttttaccgggacaccaataatccgcgggaatctaaacgcaatggacaagtcactactaccatcgttgcaaacggtttgtaccgaaattctcaataacattgccaaacacgggaaacccggggcttttgcttttatcctctctgtaggaccagatgcggttcgcatcttcgcatcaaatctatataacgccgcaataaatagtgctccagaaaatcactacgggacagccctcatacaagattttgcgcaacaacataatgggacaatgaccataaattcagaaaatgaagaatggtcattgtccctgacaattccactagcccatcaagttaagctaatgttttcccccacagaaaaactctagaaatggagggcaaggcacaatttgttctctggtgttgccgcgatgttttctggaaacatcaattgtgatataaccatggctggtttgtcggcatctttgcatgcttatatttttgattgacgacattacacggagaaacgacgtcataccgtgtgtaatcgaattcgtatccagctgcaccaagttgaacccattttgtggtatttgatgtgtttgtccaactccatccctgactttcagagacagtctgtgaggttgatagactcgattgcacatgtgccttaacatatgaggaaaattcagcatccactccgcctgtaacactcccagtgaccgttgtagttttggcttttgttacagtgtatgtcccaccaggcgaaagccaatttttaggtagagaacctgccatgaatatgcggcctttgttagagacagactgatgatgtccaatttcgggacaagacataggcgcaacgtcagtattttgctcagcctgcgcaggaatcgagagagatgccatagaggcagccaacaaaatactagtaattactgcaactactttatttcgcttattcatgatggttttcctttacttcatatacggaaacaacaagatccgtattgccgatattgataatggacaatgaggtggcgctagggaaattcttcgccggaagagagactgtttccactccattagaagtacaggattccctagtggttacagtgtgcggctgtccatctttgtagaggacaagtgagtaaggagcctgctccttctgtttgcacatggaaacgacataatacatattgttttcgtcgacttttttggcaaatggaatagcatcatcgccgtgcacggatttcgcgcccagcttgtttactagaaccagtttgtctgagttattgagatcgtcggcggcaatacggtccaaagcgtccacagtaaacgctttatacgcttgctccgctgcatcatcgttcttactgctgctctgggcagcgtctccttcagagatttcgtgtacggaatttgcacaaccgacgcatgagcacagcaacaaagccgacaacaaacaacaggcacttcttcgcatcacttcattcatgagacacctccattggtttctccagcgaaaacagctaagaacttctatgcgaacagaatatggcactgatgcataaaacgccacgcatcgttgtcgcacgaatggctatcgttcattgcacgcattagactaatgcatgggctagtggaagagactctatgcggagttggggaatgtgacgagatgacgattgattccatccatgcgattgcggcgctatgcgtcggcatcgtgcttattgcactgccttggctgcttccacgggattcaggggaatatgtacggtgcacgcaatgcctcaaataccatcaggcatgcagccatatctgccccgcatgccttacgcccgattccaccgcatccagcgcgccgcaatatgcatacatcctcactacgcgcacacgaggcatgcatattcagcttctgcttgcagtcggcgaattcctcatctgcgtggcgcaatgcgcattaccttgtctgatcatcaaaaacatcgtcgtcaatgccggtctgccaacggcttatggcattaatcaacacatcaaaatcgcgtttgttcttttgctcgttccaactgtcgcctgctggtatgcgttccttggttccggactacgaggggaacaaagctactcgcccgcacgcccgatggtattccgccgtggaacgccatccgtcgtcaaggagctgctttccggtctcggcttcgctcttacgcaatcggccttgctatggctcgtgattcgccccatgctggccgtcaacggcgcatcggcattcatgctggaagatggcaggcccctgctcgcatatggcatcgggaccgtctgctgcgttgtcgcattcgcgatttcctgctgcgtggcgccttgcacgttcggcacattccggcacgtacctcgtggaggatacgccatcgaccaggcaaccaacgccgtgaaagtctcacatgaaccttccggattcagtattgccagcgtattggaaatagcacaaacgctgttcgacgattgccttcgctaggaaactggctcgcaatgccgctaaccaactgtcagccttggatgaaatcactttccttgataaaatgtacgtgcaatatctagcttttgtacatacaagtggatgaggtttctgatgagtgcatcaacgttgaccatacggatggatgacgaactcaagcgttcggccgccgacgtggccgaatattatggcttggatctctcgtcagtggtgcgcgccgtattcaagcaaatggtgaataccgggcgcatcccattgacgttcgcccccgaggagcctaatggcgaaagcctgaacgccgctgccgaagcggacagcttcatggcatcgggcaagacggggcgttttaccaacggacacgacctgctcgaagcggcgatgcgctgatgggccggttgaccgccgacttcgcgaaggccttcagccgcgatctgaaaaagaacgccaaacggcgtaactggaacctgaccgagcttgaaaaagtcatcgatctggtagtggagaacaccccggaaacgctggaggagctgcaccgccgccacaacatgcacaccctgtccggcaattggcgtggacggtacgaatgccatgtcgccaatgccggggactggctggtgatctggtcatcgaacgattcggtcgcgtttttcgaacgtaccggcagccacgacgaattattccggtaaaccgacgctgagcgaatcgccagcgtcggttttgtgcattccgtaccgccaaaccgacacctacaagcctctcaccatcagtttgcccgactgggactactcgagctgttcggagagctccatccattccatttcgagggattcggactcgtccatgacggcctgcaactgctcgttgagcttgcccagcccctcgtaatcgcttgggtcgtgcgcggccatctgcgcttccaaatcggccttctgctcctccagcttggccagcttgcgttcaatcgcagcaacgcgcttggatgcctcgtggaacgccttgccggtaagcttcggcgcggccgcagccgagtcgccatcggcagacacggatgaggaatcaccgacaacgctcgcggacgcggcgtcattaccgcccttgctagccttgccggcctttccggacttctcgtcggcgaacggatccttgccgttcttgatggcctcggtcatgtcgaggtaatcctgcacgccgccgggcagatggcggatcttgccaccgatcagcgcgaactgctggtcggtgacgcgttcgagcaggtagcggtcgtgggagacgacgatcagcgtgcccggccaggtgtcgagcaggtcctccatcacggcgagcatgtcggtgtcaagatcgttgcccggctcgtccatgatgagcacgttcggctcgtcgagcaggatgagcagcagctgcatgcggcgcttctgcccgcctgacaggtccttgatcggtgtcatgagctgtgcggattcgaagccgaggcgttccatcatctgccccggcgtggtctccttgccgtccacgatataactcggcttgtagcggctcagcacttccttgatcttgtacttgcccagcttctccagctcgtcgagacgctgcgaaagcaccgcgaacttcacggtcttgccgatgttcacatggccggcggtcggggtgatcgtgccgtcgaggatcttcagcagggtcgatttgccggcaccgttcgcgccgacgatgccgaagcggtcgcccgggccgatcagccacgtcacgtcgtcgaggatcttacggccggtcacggtgaccttccgcgccgcggacgtgacctccggcgtggactcgtcggcgtcgccacccgactcgtgcgactcctcctcggcctgccgggcggcctgcgccgcctgtcgcgcctcgggcacgccggcgtccaccaaccgcggatcggtcagatcgtcgacggcgacctccacgctgccgtgcgcctgcggctcggcatacatggccggcaccacgtccacgcgcgaggccgaagcctccatttccgccacatccggatcgatatcggcctcgccctgcgcatgttcgaagatctgcgtcacgtcgatgagatcgaccacctgtttgccgagacgcgacgtggccatctgcttcagctccaacgtgttgcgcaccggcggcacgtcggcgatgagctcgcgcgccgccttgacatggaacttctgcttggtggaacgggcgcgggcgccacgggtcagccaggcaagctccttgcgcgccaggttgcggcgcttcgtctcgcgcacgtcggcctggcggtcgcgctccacgcgctgcagcatatacgcggaatatccgccttcgaacgggtcgatcacgccgtcgtggacctcccacatcgactcgcacacctcgtcgaggaaccaacggtcgtgggtgacgagcagcagcgcgccctggccggacggccaacggttcttcaagtgttcggcgagccagtggatggtcaccacgtccaaatggttcgtgggctcgtcaagcgcgagaatgtcccagtccttgagcagcaggcgagcaaggtcggcgcggcggcgctgaccgccggacagggagccgatcttcgcgtccagactgatgccgccgagcagcgcttcgacgatctcgcgcgatttggtttccgcggcccactcgtaatcttctcgcccttccaacgcggcttcgcgcaccgtggcgttgtcgtcgagcgggtcacgctggtcgagcatgccgaacgtcagtccattgcgcatggtcacgcgaccggaatccggctcctgcgtgcctttgaacaaatgcagcaatgtcgatttgccgtcgccgtttttgccgacgatgccgatgcggtcgccttcgaaaacgccctgcgtcacatcggtgaaaatattcttggtcgcgaaagcgagcgaaacgtgttcaagtcccaaatcataagtcggcataactcaccaatgtagcgcgtcggcggaacaccgcctcccgcacacgtatttggggcttgctcaccagctgcatgatgcgaaacgtagacaggagaccttggaatgtaggcaacgaaaacgccctagaagattccgtaggtggttttccgcttccgtaggtggttgtcttcggataccgcacgaagaaaagccttaaattcagcctttccgaaacactggcccatcacccaaccacctacggaactcaggaaccacctacggaaggcactcagctggcgattcagtggggcgtgtagcgggcagaacgcttatcagcgctccagcgttgcggcataggtgctgcaccgggccgcgaatccggagaaaacctgatcggccatcggctgcagctgcggattgtattcggcgaaggcgtcacgtagctgcgatttcgaaccgccggcggccttcaaatccttcaccatgcacggctcgtccagccactcgtccaacaacgtgggggtgacctccaggtggaattgcaggccaagcgccgaaccgaaccggaacgcctggttcttcgtcttcgcgcttttggccaacggctgtgcgccttccggcagggtcaccacgtcgttgtgccagtgcagcacgtccaacgtcttgttccacatggagaagtagtcgtgcttgtcgatgcgtttaatcggcgcgaatccgatttccggctcgctgcccttcttgagtttcgcgcccagcgcggtggcaatgatctgatgtccgaggcacacgcccagcaacggtttgccgacgctgacggcggcgcgtacgagtttggattccgctttgagaccgggatacttgtcggtgtcgagcgcgcccatggggccgcccataatcacgatgccggagacgtcactgaaatcgggaagatcgggctttttctctttggcgatgttcatcacttcatacgacatgcccaagtcgtcgagactatccaaaatgcgccccggtttctcccacgggacgtgttgaagaatcagcacatgcgattgcgtcatgccactatttttacatcatctgcgtaaatgacgctcgcgattcggctctgtgtctgcatacgttcgcaatacgatgccgtgcatatgccgggaaaaccaagcgtcatgtccgattctggcaatattctcatgactatgacaaacacgcaggaaccgcagaataccaacacttccggcgctcttgcggtggcgaaggccgccgcggggctgaagctgtacgacaccgcatcgcacgccgtgtcgtccttcacgccgatcaaaccaggtcaggtcggtatctacgtgtgtggcgccaccgtgcaaagctcaccgcatatcggccacatccgcgccgccgtcgcgttcgacgtggtgcgccgctggttcgagcgactgggctacaatgtgacgttcgtgcgcaatgtcaccgacatcgacgacaagatcctcgacaaggccgccgccgcgggccagcagtggtgggagcgcgcgtatatctacgaacgcgagttcaccgaggcgtacagcaagcttggcgtggagccgccgacgtacgagccgcgcgccaccggccacatgatcgacatgatcgacctcatcaagaagatcatcgacaacggccacggctatgtggtgcgtgacgcggacggcaacccgaccggcaacgtctacttcgacgtggcgagctggccgcattacggcgagctgacgcaccagaagcagaccgcggtttccgacgcggcttccgaagtgaccgacgcgatgggaccgtccgtggacaacgcgggcaacgacaagtacaatccggtcgaccctgccgacatgtcccccgacaagcatgatccgcgcgatttcgcgctgtggaaggcgccgaaggattccgatccgctcgacgcgcgctggaataccccgttcggcacgggccgtccgggctggcatatcgaatgctccgcgatgagccaccgctatctgaaggacatgttcgacattcacggcggcggtcttgatctgcgattcccgcaccacgagaacgagatggcgcagacgcgcgccgccggttacgattcggccgcgcgctggatgcattccgcctgggtcaccgcgaagggcgagaagatgtcgaagtcgctcggcaacggcctgtccgtgccggcggtgctggccgagcattccgcttgggtggtgcgttacgccctcggttccgtgcagtaccgttccatgctggaatggtccgaccagacgcttgccgaggcgcagtccgcgtacgaccgcgtggcgaacttcatcgagcgcgcgggcgctgccgtcggcgaacagccgtcacgagaagagattatggcgatttccgccgacgcgcttcccgccgatttcgttgccgcgatgaacgacgacatcaacgtttcgggcgcttccgccgcgattttcacggcgatccgttccggcaacacgttgctgtcgaagctggccgaccgcgccgattcggacgtggcgaaggccgaggttcgcgaggcgctggtgaacgtgcgtgcgatgctcgacacgttgggcttggatccgctggcggagccgtgggtttccgacggtgccgcaggtggtgcggctggtgccggagccgattccgccgagcatgacgcgctcgacaagctggtttccgaacagcttgcggaacgtgccgaagcgcgcaaggccaaggatttcgcacgtgccgacgcgatccgtgacgcgctgggcgcggccggcatcgccatcgaggacggtccgcaaggctccacttggtcgctgaagtaggcaatcgcacccatttcatccgctatccgcgtgaaacgctagactgaggaacattatggcagcatttagttctttgacagaccggctctcgaatgcgttcaagcatctgaagagcaagggcaagctttccgaggctgatatcgacggtaccatccgcgagatccgccgcgcgctgctcgacgccgatgtggcgctcgacgtggtgcgttccttcaccagccgcatccgcgaacgcgcgctcggcaccgaggtttccgaagcgctcaacccggcgcagcaagtggtgaagatcgtcaacgaggaactcaccgcggtgcttggcgccggtgtggaccgcccgttgaacttcgcaaagaatccgccgacgatcatcatgctcgccggccttcagggcgccggtaagacgacgctcgccggcaagctgggttactggctgaaggattccggccacaccccgctgctcgtggcggccgatctgcagcgtccgaacgcggtgacgcagctgcaggtggtcggcgaacgcgccggcgtgccggtgtacgcgccggagaagggcgtgcagtccgatggcggcgaagcggtcgtctcccccggccagaccaccggcgacccggtgaaggtggcccgtgacgccgtggagctcgccaagcagaagctgtacgacacggtgatcatcgataccgcaggccgtctcggcgtggatgaggagctgatgaagcaggctcgcgacatccgcgatgccgtgcagccgaacgagattctgttcgtcatcgacgcgatgatcggccaggatgccgtgcagacggccaaggcgttcgacgagggcgtggatttcaccggcgtggtgctgtccaagctcgatggcgacgcccgtggtggcgccgcgctgtccgtggcatccgtgaccggcaagccgatcctgttcgcctccaccggcgagggattgaaggatttcgaggtcttccacccggatcgtatggcgtcccgcatcctcgacatgggcgatattctcaccctgatcgagcaggcgcagaagcagttcgacgaggaagaggcccgcaaggccgccgtcaagatctccgacggttccttcggccttgacgatttcctcgaccaacttcagcaggtgcgcaaactcggcccgatgaagaacctgcttggcatgattccgggcatggccgcgcatcgtaaggaacttgagcagttcgacgagagggaaatcgaccgcaccgaggccatcatccgttcgatgactccggccgagcgtcgcgatccctcgatcatcgacggttcccgccgcgcccgcatcgcctacggttccggcgtgacggtttcgcaggtcaacgcgctgctgcagcgcttcgaccaggccgcgaagatgatgcgccgcatgagcaacaaggtcggcgccggcgtgcccggcttcggaggccccgcgatgggcggcggcaaaggcaagggcaaaggcaagaagaacaagaagaagtcgggcaagtccggcaatccgatgaagcgtgaggccgaggagaaggcattgcgcgacaagctcgccggcaaggcttccggcggtgcttcgtcgggtggctccgcgttcgccaagaagccgcagaatccggcgcttcctgccggattgcaggatatgctgggcgattccggcgagctgccgccgaacttaggtggcggtctgtccggtctgctgcactaagcgtctgctgcactaagcgtctgctgcactaagccgcgatatgtgcgattgccggcgattacgacaaccggcaatcgcaatacggcatatataacgaaactgccgacgttggaacattttccagcgtcggcagtttcgttatgccagcttattttcggcttatttcaacgtcagcgtggcggccagagcaagatgatcggtaccgttgaccgtgaaggagcgcacgtcggatgcggtcagaccggcggtgaacaagatgtggtcgaggatgagacgcggccacggcagccacgatgggaacgtggcgcggcggcccttcgcctcggtcaacgcggcgtcctggaagccggcgtcaagcagcttgcggaagctcggatggtcggtaccggagttgaggtcgcccaatacgacggtgatatcgccctgcttctgcgatgtggccagctcacccaagccgatgatgccggcggaccagtcgcggcagccgcgcatcggcgatttcggatgggcggaaacgaaagtgatgccgcgcatcgcatcaatcgggaagcacacgccaggcacgtcggcggcgggaatcacggcggtgatcggcgacgtgtcgcttggctcgatgcgaatccaaataccgttgaagccgccgttatccgtttccttgctctcccctaactggcggtacggcagcaggtcggacaggccggcctcgtccaaggccgcgaccagatcgtccgtcaattcctgcagcgcgagcacggcgacgtcgtgttccttgacggcgctgacgattgcggccgcattggcacgaccgtaccggcagttgagcgtcatcacgcggaaacggccgtgtttcgcggcttccgcggcagtcgacgtatgtgttccacaggatgtttcacgcttttttgcgatgttgtcggccaccatctgcgccgtgttgatggacgtgagattgttgttccaatacgcgattttgcgcagcagcgaagcgatgcacgcgatcgccgcgacgatggcgagggcggtgtcatgccgtacgacaccggcaatcgcaatcgccaatgttggaatccacaacagcggtgtcagcgcaatcagatacggcaacggcaagtggccgtcccaaccggccggcatttcgctcagagcgatccacaacacgcataccagcagtacgatccacaacgcaacactcatgcaaatccccttgaaatggccataatcaggcgcacgaaaaccgccaatgaacatatccagcatagcgagttcgtccgattcgggtgatccggacgcccgagaccgccacaacacctcaccaatgtccgattctggagaaacggccattcagaatgcgcaaaacgcaagccgagcgtccgagtcaacagaaacggacgctcgggaacgcatacgggaacgcgtccataccccacggttataattgctcagttattcgcgcgcgcgaggccctctaccaatcgcgtgacgtgaggaacacgtgggtttcggattccgtgccccacacagaacacgaaacacacacccctagttacaaggagagccattttggcaaccaagattcgtctgaagcgcatgggtaagaagttctacgcgttctaccgcgtggtgatcatggattcccgtaccaagcgtgatggccgcgccatcgaagagatcggtacctacaacccgaacacccagccttcgaccatcaacatcaactctgagcgcgctcagtactggctcggcgttggcgctcagccgaccgagcaggtgctgaacctgctgaagatcaccggtgactggcagaagttcaagggtcttgacggtgctgaaggcaccctgaagaccgttgaggctggcccggatgccgccgctcgcgtcgaggctgtcgaagcccaggcccagaagctgaaggccgccaagtccgaagctgacgccaaagccaaggctgaggccgaagccgccgccaccgaggaagctccggctgaagagccggctgcggaagccgagtgatcatgctcgcccaggctgtggaacatctgatcaagaacatcgtcgattttcccgatgatgtctcggtgaagtcccatgagaatccgcgcggtgaactcattcgcgtgcgcgtgaaccctgaggatatcggtcgcgtcattggacgcagcggacgcacggcaaatgcgattcgcaccgtggtgcaggcactgtccgaccacaaggtgcgcgtcgacatcatggacgtgcgcaggtgagatcctagcgtggtgcgtgatatgcattccgacgaccctcaacagcttgagctgctgagggtctgtcgtatcgggcgtgcgcaggggctcaagggcgaggtcaccgtgcagatctttacggacgaaccggaataccggttcgctcccggtgctgtgttgtatacgaaggacggcgaggaagagtacgtggtggaaagctcccgtaccttcaaaaaccgttggatcatcaaattcgaaggcatcgacgaccgtgatgcgtccgaagccgccaatggcgtggtgctgtatggcgaagcggacgatccggaggagatgcttgaagcggacgagtggtacccgaaggacctgatcagtcttgaggcgcgccttgccgagggcaatacgctggggcttgcgcccggcactgtggtaggcaaggtggtggatgtgattgaagtggcccagtggctgctcaagatccgtctggccaatcccgtcaaggacgccgatggcgtggtggtcgagaacagcgcgctcgtgccgttcgtggacgagctcgtgccggacatcgacctcgagggcggatatctgaccctcgacccgccgggcggactcattccggggctctgatccgctgcttttccaacaaggcgctggcgattatgccggcgcctttttcgtacgcgccgcgcttggcaggcgtaccggtattgtggagcattatgaagatcgatatcgtgtccgtattcccggaatatttcgaagtgctcaacctgagcctgctcggcaaggcgcaggagaagggcctggtcgaagtcaccgcgcacaacctgcgcgactggacgcacgacgtgcaccattccgtggatgatactcccgtcggcggcggcgcgggcatggtgatgaagccggaggtgtggagcgaatgcctcgacgagctgctgcatcttgagccgaccacggttacttgcgattccacggcagacgcagacgacacggcttccgcagacgcggccgaaccggcggaatcggcgacagaaatcgccgcaaatgccgataccgttccggcgaccgaccgtccggtgctgatcttcccgaatccgtccgctcccctgttcacccagcaggacgcgacggagctgagccacgccaaccatctgctgttcggctgcggccgttacgaaggctacgacgcgcgtattccgcagtattaccgtgcgcagggcgtcgacgtgcgtgaatattcgatcggcgattatgtgctgaacggcggcgaggtggccgtgtcggtcatgttggaggccatcacccgtctgctgcccggtttcatgggcaatgcggcctcgatcgtggaggaatcgtatacgggagagaacgccctgctggagcaccgccagtatacgaagccggccgattggcgcggtatcaaggttccggacgtcctgttgtccggcgaccacgcgaaggtcgaccgtttccgccgcgatgaggcgctggcgaagaccaacgagctgcgtccggatctcatcgaggcgttggattgttccaagcttgacaaggccgatcgcaaaacgctgatggcgttgggctgggaggtttccggcgcgcacccacggcagcgctgattacgcacgattgttcacgtcgacggagggcatgcaggtccaccgtcgacgtttttagttggaaagcccggacgtcagtccgcggattcaaccggctctgccggctcggcggattcggcaggttcgatgtaatacacggcggtttcgccgtaatcacgccggtcggtgatatcccagccttcgggcgcggtcggctcgtcggaacgagtggagcgttccagcacgatcaccgtgccctcgccagtcagttcgccggactcacggcccgccaaatcggccagcagctggttgcacgcctcggtttcgaacgcgtacggcgggtcgatgaagatcacgtcgaacggcgcgaccgccgatgcggccgccgcgtacttttccgcacgcgccttgaccacgcgggcgctcatgcccggctcccaggaacggttgtgcttcaacgccgtcaacgtctttgcgatcagcgcggcggccggtgcggccgattccaccgccaccagttcgcgcgcgccacggctcagcgcttcgatgcccaacgcgccggttccggcgaacaggtcgagcacacgtgcgtcatccagcacgccccacgaatcgaggtgcgagaaaatcgcttccttggtacggtcggtggttggcctggtgcccggtttcggcgtggtcaatgccatgcctttgaatcgtcctgaaattacgcgcatagctatcgagcctagttgctggtcaggaacgtctcgttgccgcgcgtgaagtcgagcaccgcgccggcaagctgcacgtacccttgcaacgtggggtcttcggccaccagtttcgcggcttccgctctggcttcctcgatgatcttcacgtctttgaccacgcgcagcagtttcagtccggatttgccgccggattgcgcgtcgcccagcacgtcgcccgcgccgcggaattcaaggtcggcctgcgcgatttcggcaccgtccaacgtgccggcaatcacgtcaaggcgtttggcagcatcgctgccttccggcgcacgtgaaataaggaacgcgcccgattcggtgccgccacggcccacgcgtccacgcagctggtgcaactgggacaggccgtaccggtcggcatcgaaaatcaccatgcagctggcctgcgccacgtccacgcccacttcgatgacggtggtggccaccagaatcggcgtcacgcccgcttcgaaatcggccataatctgcgatttcgtttcgtcatcgtcgcgaccggtcagcgtggcgatacggatgccggcgaattgcggcagcgatcgcaagcgttccgcgatttccgcgacggaatgcaacggcggccgctgttcgcgctgttcgtcatcctcgcccaaatcgtatgtggcgtcgaatgcggaaccgacttccgcatcgcctgaaccgcccgcatcgtcggcatccttcgcgtcggcgtcgatgcgcgggcagaccacgtaggcacgttcccccgcgtcgatacgcttgcgaatcagaccgaacatttccgccatcagcgggccgttcgcttcgggcacgacgaatgtgcggatcggcttgcggccgccgggcagttcggtgagccaggagatgtcgaggtcgccgaaccaggtcatggcagcggtgcgcgggatcggcgtggccgtcatgaccagcaagtgcggtgccgtggagcctttggcattcaacgattcgcgctgttccacgccgaaacggtgctgttcgtcgatgaccgccagcgcgaggttgggcgcttggaaggttttggagaacgcggcgtgcgtggccaccacgatgcatggtttgccggaggccgcttgcgcgaggacgcgtcggcgggcggcgagtttcatgccgccggtgagcagcagtacgggaatgtccggcaggctgttcgattggccgtccagcagtttctccacctggccgccatccgattgtccaccgttttgcggttccggcgcgtttcccgacgtgacttgtccactttcatccacaaccgcatggtgcgttgattttgtctgcgattcccctgatttcgcggtttcggcagcctcttcgccggtaccacacatccgatccaccatgccgcggatgctgctgtaatgttgttccgccaacacttgcgtcggcgcgacgagcaccgcttgtttgccggagccgacggcctgcatcatagccgccaccgcgaccacggttttgccggagccgacctcgccctgcagcaggcgttgcatggggtaatcacgtgccatatcgtcggaaatatcggcgatcacctgctgttgcccgtccgtcagcgagaacggcagcgactcgacgaaatcgtctttcagccgcgtgtcggcgcaggctgtggccgtggccttacgcgacgaatcgcgagactgcaccagcgcggtttggcagatgagcgcttcctcgtagcgcagtgtacgcaacgccttgttgaaaccgtcgcggttttgcggatcgtgaatcgccatgaacgcttcggctcggtgcatcagcccatgttccatacgaaacgcttccggcatgatgtcgggaatggcggcggcaagcgcttccgtccgtgcctgccggtcggcttgcggcgcgtcgaattccccatgttgcgcgtcgctggcatcggcgccatgcaatgcacgggctgcctgtgccgcagcgtattcgtcaccgcacagccggtccatgcatttttcgatcgactcgtggatgtgttcgctggagatgcgcgagttcgcgtggtagacgggacgtgggcggcatacgtggcgcatcgcctccggtacggaagccgcatcgtatttgagattcggcatggtcggcgattgcgggactgccgccggttgttccgtgccgaagccgtcatcccattcggcggcttcctcagatgagcggctgcgcaattgctcgccggctggatcgaccgtcagtatgtcgggatgggtgaattgcagacggtcgttgtatacgcttggctcgcccgcgaccaccagcaacgcgccttcgtgcagtttgcgctggatccaatcgacgtacgacttgcgataggagaagaacacgagagacgccatggaagcgtccatgtgccggctgcgtgcgaaatcgccgtcatcaacgtcggcgatcagccggaatccgcgacgggccatcggaaagacgcgcacgccacgcacgtgcgcggcgaaggccatgttctcccctattttcgcttcgcgcagggcgcgtgccggaaccgggtcggtgacgcggaacggatagtaggtcagcgcgtcgcccacggacaccacgcccagcgatttcagcgcgccgactctgcggcggttcgtttcgaacgaggaaatcggggtttgccatgtggtgctcataacactccattgtgtcacgaccggatgattgtgcggcgggctgaattccccattattcgtggcggcgccattcgccgcaacacggcttgtggacggtcagataaagcaaaaccccggcggccattcggcttaccggggtttcaagctgttatttcgcgattcacgcttcaacgcgctggaccttgccagccttgatgcacttcacgcaaacgcgaacgcgaacgttctcgccgtcgatggtggtgcgaaccggctgcaggttcgggcggaaggtgcgcttattgcgaatatgtgagtgcgaaacggtgaaaccggtctgcggtcccttgccgcacactgcgcaacgagctgccataatggactccctataattactattgacttgcaagtctgcgcgttcgacaccacacaacgaagtgcatggcagaacacacaacttctcaactatacaaccagccccggccaatcgcaaacttgtggacgaaaatcggcttgcattccccatattccgccgtttttgccatgtctcgacagcacgcgtatgcggcccgtacgggcagaacatgcttgttcatgcgctgttcatgtcgaatggtctgttaccacccgccacgcccgtacgatgaagtaatggaataagatgagccataagattgacatttagccgaaaagagtcaacattgaccgacacagccgagccgcagacccaaccgtcccagcagaacgcgcaggcccagcagccgcagcaatccagccagcaatccaagcatatgatgacgccacgcgagaagaagtggatcgtctacgacgtcggcaattccgcgttcgtgctgctgtccaccgccgtcgtgccgatctacgcgaattcgctgctcaaggcggccggcgagacgaacatcgtgtcgacgtggggctacgcgcagaccatcgcatcgctcgtcatcgccgtgcttatgccgctgctcggctccatcgccgacgtgcagggcatgaagatccgcttcttcaccggcttcttcctgacgggcgtggtcatgtgctgcgcgatggcgatgccgcttggttggctcgcgttcctcatcgtgtacgtgctggccaccatcggccttaatggttcgcttacgttctacgactccatgctggtggacacgacttcgagcgaacggatggaccgcatttcctcacacggctacgcatggggctatatcggttcgaccgtgccgttcatcgtctgcatcgcgctgattttcggaggccccgcgctgttcggctggtcgaccacagcctgcacgcgcgcctcgttcgtcatcaccgcgctgtggtgggtggcgttcaccattccgctgctcaccagctataagcaggtacattaccgcgccaccgcggggcaggcaggcgaggccatccgcggcacgttcgccgagctcggctccacgttccgcgccatccgcaagaacaagccgctgtggatgttcatgatcgcgttcttcttctacatcgacgccgtcaacaccgtcatttccatgagcacgtcgtatggcacgcagctgggcatcgactccacgcagctggtcgtggcgctgctcgtcacgcagttcgtggcgttcccctgctccatcatctacggcaagctggccggccggttcggctcgaaaaccatgatcaccgcggccgtggtggcgtacatgtgcatcgtcttcttcgccgcgttcttcctgcgcgccgcacttgaattctggattctggcgattctggtcggcatgttccagggtggtatccaggcgctgtcccgttcgtattacggcaagatcattccgaaggaccatgccaacgagtactacggcttctacgatattttcggcaagacggcgtcgattatcggcacgttcctcgtcgctaccacgacgtcgctgactggcaacgcgtcgatcggcgtgctgtcgatagccattctgctggccgtcgcgctcgtcttcctgcttctgcagaaggatccgaccaagggttcgacggaagccgcaaccgtcgactgacagctgccgtccgacagcgttccgctcgacagcaatcgctcgatagcattccgcctgacaatcgtcgttcggcggaatgcgctgtgccggcctgcgggaaaccgcgtaggccggcacaacttcgacagttaccatctggtatgttatactggcatcgtttgcacaccgtggcgcaacgtagcgccgctccagcaatgacgcagagagaggtaaacgatgtcattggcaaatgaactagtcgaagcagtgtccgcatggccggaagtcgaggccatcacgttgggtgggtcacgcgccaccggcgataacgatgaaaaatccgattacgacgtctacgtgtacgtcaccgcacccgtatcagccgaacgccgccgcaggctgctgcgcaactattgcagccatatggaaatcgacaacgatttttgggagaccgaagacgactgcacgctgaacgacggcaccaatatcgacgtgctgtaccgcgatctggaccagttcgcagccaatgtcgccgacgtggtggaacggttccaggccagcaacggctatacgacgtgcatgtggcacaacatgctcaccagcaaggtgctgttcgaccgcgacggccagtacgccgcgacccgacagcggttcgacgtgccgttccccgaggaactgcgccgcaacatcatcaatcgcaacatgcgcctgcttaccggcaacctgccgtcgtacgacgcacagatccgcaaggccgcgagccgaggcgacaaaatcgcggtcaaccatcgcatggccgcgttcatggaatcgtatttcgatgtgctgttcgcgctgaaccgccgcacacaccccggcgagaagcgtctcgacaagctcgccgaacgcgactgcgccattctgccgaaggatttccgcaaaaacatcgatacgctgttcgattcgatgtacgccgatcaggcggtgttcagcgagactttgggcgaaatcgttgacgacctgcgtcagacggtcgacgcgaacctgtgatttgaccgcgaatccggcggttcgacgccggtagcgattggttttagaagaagttgagcgcgcgggccacttcgtcgacgatgtcgaacatggccttgcgcgcacgttccggatcgcccttcgctatcgcgtcggcgaccgcatcgtgcgcgtcgagcgcggccggcttcggcttcatcgggtatttgccgagttccacacggccgcgcagcacggtggcgatggtgtcggcaagcgcggcgaacagctcgttgccgctttcacgcagtatcaaagtatggaattccacgtccagatcgtggaatttggtcaggccagcagccccctcttcgtttgattcggcgatttggcgcatctgcgccgcgtagacggggaatttcgccttgacgtcgatggaggcgaggcgtgccgccgaggccgccgcagccggttcgaccgccaatcgcaattcggtcaatgacgacagctgccgctcgcgctgcgtggagtggagtcgccattcgatgacctgatggttgagcgcctgccagtcggagaacggccgcgccaccaatccgacgcgtcggcgcaccgtcaccgcacccatggattccaacgttttggcgacttcgcgcgccacggtacgggagatgccgaaacggttctgcacgtcttccaacgtcaagctttcaccggccggccatttgccgtccagcatttcgatggccagcgtgcggcacactgcatcctgcagcagttcgccgccgttttcgtttcctgccatccacaattcctctcgttgtgcgtgcaaatcttttttcaggtttttgcgacacgccgtatacgattgccgttcgcgtgacgtccgaataattacccccgcacgattcgcgcgatttgccgccgatttgtactacctacagcatagcaagtcgcatgattatttttattcgtagtacttttaacttgactagtactacctttcatagctatattgatgtcatcgccgatgcgaagtggcactggcaatacagcagagttcaaggaggacaacatgagcattcacgtagtggtgatgggtgttgcaggatgcggcaaatccaccgtggcagaagccattcacgaacgtctcggatacgtgtacgcggagggcgacgacttccatccgcaggccaacatcgacaagatgagcgcaggcattccgctgacagacgaggaccgttggccgtggctcaaggtcatcaacacctggatggtggctcgcgaggcgctggacgagaacaccgtggtctccagctccgccctgaagcgcagctaccgtgaggtgctcgcccagaacgttcccaccttcttcgtgcatctgaccggctcgcaggaactcatccagcagcgtctcaacgagcgcaagggccacttcatgccgccggcactgctgccgagccagttcgccattcttgagccgctccagccagacgagaacggcgtggaggtctccatcgaaggcagcgtcgaggaaatggtcgaacgtgccgtcgccgcagtgaacgagtacgcggcgaaggtggccgcgcaatcgcagcaagccgagtgaacggcgcaagccgcaacacagcgcaaaataatcgcacataactaaaaatcgaaagagaaattcaacgagtcaaggaggattcatgaatctcatcgcagcggcgatcatcggcatcgccgtcatcgttcttctcatcgcggcatgcaaggtgcatccgttcctgtccctgctcgccggctcattcgtcatggccgtgtgcgcgggcgtgccgttcgacaaggcgttcgatagcttcacttccggcgtcggcggcacgatttccaacgtgggcctgcttatcgcgttcggctcgatcatcggcaccatcctgttcaagtcgggcggtgcggacaccatcgtcgacaccatcatggccaagacaccgttgcagcgtctgccgtgggccatggcactgatcgcgttcatcgtgggcatcccgatgttcttcgaggtcggcgtggtcatcctcatcccggtggtgctgttcgccgcccgtcgttccaagtcccctgtggtgctgctcggcatcccggccctcgccggcctgtccacgctgcacgccttcgtgccgccgcaccccggtccgctgaccgccatcggcgcgctgaacgcgaacctcggcatcaccctggccctcggcctgatcgtggccatcccgaccgtcatcatctccggcccgctgttcggcaggctcgccgccaagtgggttccgatcgcagctccggagaacgaggctgaggccgaagctccgaagtccgcggagaatcgcccgtccttcggcaccgccctgtccgtgatcctgctgccggtcgtgctgatgctcgccgcgtccatcgtggatctgaccggtcagaacaccaccgcctggggccgtgtgatcgcgttcctcggcaccccgctcgtggcactgctcatcaccaccgtcttcgccatggtcgcccttggctacatgcagaagttctcccgcgacgccgtcaacggcatggtcggacagtccttcggctccgtggccggcatcatcctgatcgtcgccgcaggcggcggcttcaagcagacgctggtcgactccggcatcggcgacgtgatcgccaactccatcaccgaatccgccatgaacccgctgatcgcaggctggctggtggccgtgctcatccgtctcgccaccggttcggcaaccgtggcgaccgtcaccgcctccggcatcatggtgccgctcgccgccggcatgagcccgacccatctggcactgctggtgctggccatcggcgcaggctccgtgttcttctcccacctcaacgacgccggcttctggctggtcaaggaatacttcggcatgagcgtgggccagacgctgaagacctggtcgctgatggaaaccattctgtcggtggtcggcctgggctgcgtgatgctgctctcgctggtgctttgacgcactgaacgcagcaatcgcaaccacactcacataacccaaaacataaccaaaacttgccgcccgcaaagcttgccgcaaccttcttttctgcgttgcggaaggcgcgggaagccaacgggcggcatcaatccttattcaaaatcgcaaaaacttttcaaccatttttagagaaagaagcacatcatgcagttgggaatgatcggcctgggacgtatgggcggcaacatggcgaagcgcatcgcggcggcggggcatgaggtggtcggctacgaccgctcccccgagtcggaccgcaccgtggcaagcctgaaggaactggtggccgcgctgaaggccccgcgtctggtgtgggtcatggtgccggccggtgaagcgaccgacagcaccatcaacgagcttgccgagcttcttcagccgggcgatatgatcatcgacggcggcaactcccgttacaccgacgacgcacgccacgcggccgaactggagccgaagggcatccatttcatggattgcggcgtctccggcggcgtgtggggcatcgaccgcggctacgcgcttatggttggcggcagccagggggacttcgagagcgcgcgcccgattttcgaggcacttaagccggaaggcgattccggactggtgctggccggcccggtgggcggcggccacttcgccaagatggtgcacaacggcatcgaatacggcatgatgcaggccttcggcgaaggcttcgccaccatggtgaagtccgatctcgttgaggatccggcggccgtgatgagctcctggagggacggttccgtggtgcagtcctggctgctcgacctgctggccatcgccttcaagtccgacccgacgctcaagtccatgccaccggtcgccaacgagtccggcgaggcgaagtggatgatcgaggcggctctcgaactcggcgtgccgaccccggccaccgcggccgcactgtacgcacgtcagacctcgcgcggcggcgccgacgacattctgcgcgtcgtgtccaccatgcgcgcccagttcggcggccacgtcaccaagatcgacgagatcgccacccactgacggattcacgcattaaccgattcagattccttccttccccataacagacttcgcccggagctggaccccaccagctccgggcgaacctgtatatcaacgcacacggtcccgtcagacagtcggcttgccgccccacaatcctgcactatctcgcttatagatggcggattttccaaatcgccccacggtatctcgcttatagatggcggggtcctacagcaaaaagccggttagggggcaatatccataccctccaaccggcttttcccccgcatcatccgccatccataagcgagatggcatcaggcacgagagcgaatccgccatctataagcggaatataggcgaaatacgcgagcggctcagcggccgtacacctcgtgcacgaatttctcaagcgccgcgatggaacgctccaccttctccgtgtcgatgcagtaggccatgcggaagtagccgggcacgccgaagctgtcggacggcacgagaatcaggtcgtaatccttggccttcatgcagaacgcgttcgcgtcctcctccagcgccttcgggaagatgtagaacgtgccgccggggcgcaccacgtcgaaacccagacgggtcagcgcgtcgtacagcaggttcatgttggtctcgtacacggacaggtcgctcgtctcgtccaccaccttggacacagccagctgcgcggtggaagacgggcaattgtggccggttccgcggctgatctgtccgcacatcggcacgatcagctcggcgtcggtggcacgcggattcacggccacgtagccgatgcgctcgcccggcagcgacagggacttcgaatacgaatagcaggacagcgtgttgtcgtagaacttgctcggatacggctgctcgccgccgtcgaacacgatctcgcggtacggctcgtcggcgatcaggaagatgtcgtggccgtattcagtctgcttggcgttgagcacctcggccaggcgggtcagcgtttcagcggaatagaccgcgccggacggattgttcggggtgttgatgagcaccgccgcggttccggggttgagcgccttctcgaacgcgtcgaagttgatctggaagttatcggtgtcggccggaacgacggtcaggtgcgcgccggtgccgttcacatacggctggtattccgggaagtacggggcgaaggtgatcacttcgtcgcccggcttggtcaccacgcgcagcgcatgcgccaacgcgccggccgcgcccgtggtcgggaagatgtagtcggcggtgtagtccatgtcgaagcggcggttgagactttcggcgatcgccttgcgcaccgacggaatgcccaaggacggagaatagccgtgcaacgccaccggttcggccgttttatacatgtcgatcacggcgtcggtatagtcctgcgggcacggcacgctcgggttacccagcgaatagtcgaacacgttctcgtagccgatttcggcgccacgcgcggtcgcgtattcgctcagctcgcggattacggattttccgccgagcatggccttgtaggcttcgttgatcatggaacaacctccctgtcgtgctgttgcatacgtctgacgcaccctgaaagagcgccgctacagacgtttctaccaccgaaaagtcacgacatgcggcgcatcgttcactgttcggctttctgttcggcttcgctctgcacgccctgccccgccacgaaaccgctgctgaagatgcgcttccaataacccagcatgtcggttttggacatggacatgaatatgcccgtggccagcaccgccacatcctcgttgaacacggcgtccatcggcagctgctcatggagcttcggccagcggcgcagcaccgccaacatgcctccgacggtgaagtcgagcatcaggtcagttttgaggtcaagatggtcggcgtcaagccccagcacggagatcaacgtgagcctgccgaagtcctgcagggattcaacgagttccggcgagctgtgcggcccggcaagcagcgcgagccggtcaagacgctgacgctgctcggactcgcgtagcagcgcggtgacatgcttgcgccattcgttgtcgggattgaaattcgcgttgggcgcgctgggaagcggcgtgttttccacggcgtgcagaatggcggaatcggcaagttccggcagtcccgtgaaatgatagtagaaggaattgcgattcacgtccgccgtgcgcacgatgtcggtgacggtgattttgcgatactcgcgttcggaaagcagttcccagaatgcgttttcgagccgttctttggctggcagaatctccgaatcccggcgtggacgtggcatggctccccctattttgtaccttcgatttaaaagcgcaacgcgaattactatacaagttgtctagaacaaactgcacagcatgtcgcattaatagcgattgccatccaccgcaacgcctcacctcacaccactgcgtcacgacctccgcgctacgtctacttgcgccgcactttcggattgcgggcaagagcggcctgcaacataatcgccagcgcctggttgagattgcgtcgatcctcaccgctcaacccaacgtacgtgccaagcatttcgggaatgactttcggcccggccgccatcatggcggaaatactgcccgcaccggacgcttcgagcacggcaaacaacgcgtccaccgcacgctcgcgctgctccttggacaggttggcaagccacttgttcagcgctttgttgaaggtcaccgaactgctggccacatcctcgactttgtcgaattcaccgccgtgcatctgccaggagaacacgaaatgctgcattattccttccacgtcggatttcaccacgatgcagcgttcgggagttcccagcaccatgcccactaccgatgagtccggcacgattttgacgattcgatcgctcacgctcgcatattcgaagctattcaccaccgcctcagggaagcccggcccatccaacgaatagatgcgttcgatgcggtccttcaccccgtcctcagcgttcatcgccgcataaacggccagattgccgcctttggaatggccggtgagcacgatcggaacatccttccacaactcggccaccctggcgagatagtcggcggcggtcacctgcgccggcaccgggtattggaaggccatgttgaagtcctccttccaacccacgagcgaatcgtcggtaccgcggaacgccacaaccagcatgccggacggcaggcgataggtcacggcggcgaactgcgtctgctcatcgccgtcgaactgctcgagaaacgcccccatttcaatgtcggaaaaacgcggattcgcggcgatggcatggtagaaatcgtgcgtcacctgcggatcaaccaagcccacgttctcgacattatggtcgggcaccgcgcttccatggtgcagctcgtcgtcggcgcgcgcgatcgtcacaccgtcgaatggaggtttccgcagcatccgcacggagcgtatgggatggcgcgggtcgaattgcttcacacggtcatgcaacgtgccgtatcgcgattcgatgtcgtcaagccgcggcacgcattccggcacgtcgtcgtacgaaagctgcgcgagcacgagcgcgtcggcctcacggaagggaagctcgccgaaatcgcgcgtctccgtacgcgcgtaatcgatgatgttgcccattgcacacccctttcgcagccgtcgacattccgcattccattatgcttccacaattatgcgtccgcaccgcaccatcctacgtcagcgaacggagatgcatccggatcatcagcgccccgatgccctccattgcccttcttatgtgtcacttgcgcggcactcgtgtgtcacttgtgcggcacttatgtgtcacaattccatttttcacgccttttcgaggatcgtgacacatgaatcggccgaaatgcggctcggcaaccatcccgaccagccgttgcatccgcccatagccccgcctcggcacgcgcttcagcccgcctcggcactcaacccgcttcagccctcgcgcaccgccttcgccgcgctgaccggaatcgccttgatcaccgccctgatgagtccgcgcgtctcccgatcggtattgcgcgccgcctccacaatcttcggcagcgaatccgtccaatgctccaccaaatcggcgatattgccgtatcccgccgccgcgaagatcccgtagatctggtcgatggcgcgctcgcgctgctcctggcttacggtgtcaagccacccgtcgagggttcgtttgatgagctgcgcgccggccgtcagctcgtccacctgttcgaaatcgccattttccgccacttgccagctgtttcccatatgctgcatgatgccgatggcatccgctttgacgatgcgcactggcgcattcgattgcagcagcatgcccacgacggacgattcgggcacggttttgcggatacgcgattcgattgcacggtacgcctgaccgcgcaccgtcgatttcggaaggcccggcccgtcatgggaaaagatgcgggagatccgtctgttgcgaccccgcactggcccacccaatgagggcagcaatccgagccgccgcgcgcgctcgccagccacttcgatgtcatcgtgcgcgatacgcatggccgcatacacggccatattgccgcctttcgaatgcccgccgagcatgaccgcgggcgaatcgcccgacgaaaggaaaccttccgacctgtccagaatcgagttcacataccgatacgcggattcctgggacggcaccgggcaacgcaccgccatattgaaatcctccttccatccgacaagcgtgccatcggtgccacggaaggctacatacagcgaatcgacgggtccgcaacccacgtcgaacgtcatcgcggcgaactgctgctgttcgcgctcgctcagacgctccgcgtactcgccgacacgcaacgcgcggaaacgcggcgattcgcagacggcacgcagcaacgcgagccgatactcgttcatatcggaggaattcgaaacgaacatgtcgtcatagctttccgcacgcagcagctctcgaatcggcaccgtcgccaccgacctcgcctcgccgaacgccggaaccaagccggaaagccgcatatatgagagctcagccagcaccagcgaatcaacatcgccgaacggcagctccgcgaatccatgaaactcgcgccgcacataatccacgacattgcccatgtcgcaccccttttcgctggccaacgcatcctacggaatccattatgctccgctgcggccagccggcggatcaggaatcatccagtcaatcgcaagcgttgtgcaacgtcccctgtgtagactaggcagccatggatccagttgaaattctcatgcactggcttgccaaaaactacagcaagctcatcctgctcgccgtcgtgctcatcgtcgccgcgcttatcgacaaggcgctcaccaaggtggtgcgccgcatgctcgacaaatcgcaggtgccgaacgcatccatcttcgtcaacatcctgcgcgtggtggtgtgggtgttcgccatcggcacgctgctgcaaccggtgttcggcatcaatccgaccaccctgttcacggcgcttggcatcggcggtcttgcggtttcgctgggtttgaaggatacgatcgccaatgtgatcggcggcttcgggcttatgcttggccgcgtcatccagccgggcgattacgtcaaggtggccggcatcaccggcaccgtcaaggacatcaattggcgtcagaccatcgtgcgcgagcgcaacggcaacgagatggtcattccgaattccattctgaacaccgcctcgctggagaagcttgacccgtcgaacgagtgcctggtgtcggtgccgttcaccgcgaaggcgggcgtggatgtggagcgtatgaaggccgacatcgtcagcaccgtggaacatgcgaccgtggggcttgccaacccgcaatacaagccggtggtgaagctcaacggcttcaccccgtacggcatcgacggcacgatctacgcgttcgcgaaaaacgacctgctgctgtccacgatggcggatgcggtggcgcagtcgatcgcgcatgccgattatcttgagcaccgcgcggtcggcagcggcgaatagcggcagcggcgtgcgcaacgcaacgcacgcaacacaagctatgcaggcaacagaaaggccgaccgggaacgtatccccggccggccttcataatccgcgcgactgcggctataggaacagactgatcgccgtcagcagcaccgtgagcacgatgaacgtgatcatgccgacgttgccgtacacggttctggcgccggtcccacgcggcagctcctccggcgcgatgtagaattcggctttcctgaagttacggatcagcagcacgaatccggcgagaatcacggcaccgtacagcaggaaatagacgagcatgatcgccagcccggtggcgttctgcgacgcccactgttccatcgccgccacattgccgttttccgcggcctgagacaccttgtccagctggtccaggtcgacgcgcgtcagaatccacggcgcgagcacgccgccgttgaagttgatgatcatgtgcatggccgtcgaatagcgcagtttgctggtgcgcatgtagatgtagccgaacatgactcccagcaggaacgcatagaagaactggaacaggttcatgtggaacagtccgaacgcaaggccggacagcagaatcgccgttttctctccgtatttgcgagtgtggtcgatgagctgcttgcggaacatccattcttcgaaaatcgggccaagaatcaccaagaacacgacattccagatgttcgtctgcatggcaagatcggctacgcggttcgtggcttcaccgtcggaaagcgccagcgacagcatactgccgaccatgctgccgacccacatcatcggcaggcacatgagcagcagcttgaagaacatgcccggtttcatgttgaatttgcgggtttcgatgacggtcgatttgcccatgagcgccaccgcgaccggcatggcgatcagatacagcggcacgtcggaaatgaggaacgtcatccaattcggcatatcgccgccggcgcctacaccgcccgcgaccgcgcgcaccacgcctttgagcaggaagacgcccgcgtaccagatgatcaccatcaggcacaggcttgcgccgatgcgcgaaaagtcgcgtcgcgcctgcttcaaccattcgaagaatggattgcgattggcgatcggcggctgcggatattgaggcatgggctgcatcggatactgcgattgcggaccattcggctgatattgcggagccggcccctgcggttgtccttgcggttgctgcggatattgaggctgctgcggaaacgtcatagtcaccttacgaaacttcggaaaacaaaaaagctgatattcagcactgtactaccagtccgctgaatatcagcttgagatctcaccgtaggtgggtgtcgatcagcgcagcacgccttcgatgagcatggtgatcaggtcggtgtagcgcacgccggtggcctcccatgccttggggtacatggagatggacgtgaagcccggcatggtgttgatttcgttgaccatcaccttgccgtccttggtcacgaaggtgtccacgcggctcagaccggcaccgtccacggcgacgaacgccttcttggcggtttcgcgtacgaggttcagcgtctcttccggcaggttggcgggcacttccacgtggcttgcggcggcgtccatgtacttgctgtcgaagtcgtagaactggtcgtcgccttcggcgcgcttgtcgagcacgatttcgcccggccagctggcctgcggcgcttcgccggccttcgggcacaataccgcgcattcgatttcgcgcgcgtcgatgccctgttccacgaggatgcgccaatcgtggtgggacgcctcgtacacggcggccgcgagttcggctgcatcgccctcatgctccaccttggtcacgccgaagctggagccggcgcgggacggcttgacgaacagcggatactgcaagccggcttcgctaacctgcgccatgatcgcatcggcgtcggtcttgaattcggaagccttgtcgaaggaacgcgcgtcgagcgtgatgccgggcgcgacgggaatgccggcggccgcaagcagcaccttcgtgtaatgcttgtccatgcaggccgcggaggcgagcacgccgcaccccacgtacggcacgcccatcatttcgaacagaccctggatggtgccgtcctcgccgtacggcccgtgcagcacggggaacaccgcgtccacatggccgaacggggtcagcgtaccgtcatcctcgcgggcgaagaagccgtcctgtccgagagccacttcaagcaccacgtccttggcgcctggggttttctccacggtcggcaggccttcgtccaggctccatccgagcggattctcaccgttgacgatccacttgccgtccttggtgatgcccaccggaatggcttcgaacttgtccgtgtccagcgcgcgcagcgcactcgcagcggagatgcaggagatcgaatgctcgtcggccttgccgccgtacatcaccacaatgcgcttttttgccatatctatagcctttattccttaacttttatgacttttcaggatttttgccaagcatccagcatacaagccggctgctactcctcggtgatgccttcgccgaacagttcggacagcatctgcgcgcaggagatgccgtcgtccagcacgtggctcatggccgtggcgagcggggtcggcacaccgtactgcttgcccaacgccaccaccgcgtcggtggtcggcacgccttcggccacgccgttgctcaccttggtggcctcttccacgctcaggcccttgccaaggttggaaccgaacgtgtagttgcggctcagcggggaaccgcaggtggcgatgaggtcgcccacgccggcaagtccggcgaaggtcttcggatcggctccggccgcctcgcccagcgcggtcagttcggcaaggccacgggtttcgatcatggccgcggtgttctcgccgtagcctgcgccacgggccatgcccacggcgagcgccaccacattcttcagcgatccgcacatttccaagccgatcacgtcgcgcgtcacgaacgcacggaagtagtcggtggtgcaggcggtggcgattttgcgcgcgttgtcgatgtccgcgcagccaaccacggtcgcggccggctcgcggtcggcgatctgcctgctcaggttcggtccggaaatggcggcgaaacgttccgccggaaggtcgagcgtttccatgacgacttcgtccatgcgcttgccggtggtgcgttcgatgcccttcatcagggatgccacgagcgcggtttcggggatgagtcccttgaattcggccagtgcgacgcgtgcgaactgcgcggcgatggccacgatgacgatgtcggcgttggccacggcttcggcgcggtctccggtggcggtcatgttgctgggcagcgtttccacgctgggcaggcgcacaccgttgtggtgatggtcacgaataccttccacgatttccggttcgatggcccacatggtcacgttgttgcccgcgtcggcaagcacttgaccgaaggccgttccccaagcgccagcgcccagtaccgtcacattcgccatgaattttgctccttggattatttgggttgctttttgcggccgagcgtatgccacatcggccgccgctttcaatcgacgttgtcttatgctaccgccggctacgcacaccggccgcgtgttccggtcgcacgcgtattttgttcgccgccggaacgggtgtgtgtggggaaaatcagtctttcacgcgactcatggtgcggtagtcccagtagccgtcaggtgcctgttcgccgcggatttcggccatgatttcggtcatgcgcacgcggatgcggcgggtcagttcgtcggcgcggtcggtcggcacgtccttgccccaggaatcgcagccgtcaagcaggtccgcgtagtcgagcgcttcgtcgtagcacatcaccacgttcttgcgcggccacggccaccagtggttgatgctggccgcgccccaggtcacggcacagtacagcggcacctggtagccgagtcggcgtgaggattcgagggcgatcacacccacgccgtttttcatgctcatcggccatttttgcgggtcgcgcgtcacggtgccttccggccatacggtcagcgggcggccggaggtgaggatttccacggacgtttcctcgatggctttggccttgcccgcgcggcgctgcaccggctgcatgccgaccagctggaaccatttgccgatcagcggccatttggccatttccgccttggccatgtagcgcgggcggcggccctgatggaacagcgagaccatcggcacgaacacgtcgtacatggtcacgtgtgtggcggcggtgatgaacgggccggtttccggcacgtgttccaagccccaggccttcactttgctgtgattgcgcagcaccacgtcgcagccggtcagcaggcgatgcgtggctttggggttctgcgcttcgatttccgcggtgttggctttgcgcggaccggtcgggaaatcgtgggtcgggtctacaagatgatgcttccgcgcgagttttgcgacttgctcgtcgctcagcggcttcactgcggagcgcggcgacggttttcctttggatgccatggcttccattgtgccaccggccgccgatacgttcgacggcgccgctttccacgacattttgcttttactacctcataccatcgttttctgcatcatttggccgtcaaatgatgcagaaaagacgggcgatgaggcagtaaaaggaatatgcggaagatgtggaaggtatggaaagcaggtttgcgattgcggcagcggcaatcgcggataaaacaaaaccggcacccgcgcaaggcgagtgtcggtgaaaggtggtatgcgttcagcgcgactggtcaatcgcaataaatcagccgcagccgattcatcgaaccaatcgcagcgaatcagtcgaagtcggctccgagggcttccaacttgccgcggaagtcggcgtagccacggtcgatcagggagatgccctgcacgttggacgggcccttggctgcgagcgccgcaatcaggtggctgaagccgccgcgcagatccggcacgtcgatgtcacgtccggtcagcggggtcggtccgaagatgaccgcggaatgcttgtagttgcgctgttggaagcggcatggcagggaaccgaggcattcgcggtacagctgaatcgtggcgcccatctgcaccagcggcttggtgaaaccgaaacggttctcatacaccgtctcatgcacgatggaaaggccgttggcctgggtcagcgccacgacgagcggctgctgccagtcggtcatgaagcccgggtgcacgtcggtctcgatggctaccggcttcaggtctccgcccggatgccagaaacggatacccttgtcggtgatgtcgaattcgccgccgattttgcggaacacgttcaggaaagtcatcatttccggctgggtggcacctttgacgaagatgtcgccatgtgtggcgagcgcggcggacgcccaggaggcggcctcgatgcggtcggtcaacgacgtgtgcgtgtagcccttgagctccttgacgccttcgatacggaaagtacgatccacgtccacggagatgatggcacccatcttctgcagcacgctcaccaaatccatgatctcaggttcgatggcggcgccggaaagctcggtcttgccttcggcgagcacggcggcgagcagcgtctgctcggtggcgcccacggacgggtacggcaggtggatcttcgcgccatgcagaccgttcggagcggtgatgtgaatgccgtccttgtgttccttgtccacgttcgcgccgagcttgcgcagggtttccagatggaagtcaatcggacgaccgccgatgttgcagccgccgagcgccggaatgaacgcctcgcccagacggtgcagcagcgggccggagaacagaatcggaatgcgggacgagccggacagcgtgtccacgtcggccacgtcggcgagttgcacgttggtggcgtcgatcgtcaccacgccgttcgcgccgtccacggtcacgtccacgccgtgcaggcgcagcaggtcggacaccacgtgcacgtcgcggatttccggaacgttcttcagcacggatgtgcccggggccagcaatgcggcgaccatggccttgcttacgaagttcttcgcgccgcgcaccttgatggtgccgttcagcggcttgccgccttcgacgtgcagaatgtcgttcttattgtcagacacgctcaacctctttcgattcccttttggatcaagctcaaaaaaacactgctgcttagtttgccataaggcatgtagcatgttcgcgaaaaacggaattcagcgcagtgtctccttaatttcgcgcgcgagattcgcatcccacatggctccggtggcgctcatcacggcgttcgcgccagcctcacggtacgccttgtagtcgtcaggacggatcacgccgcccacgcccacgatggcgaagtcgaagccgagtttttcacggatggcggcgagcctgccgaccatgtcgagaccggcgccacgaatggcgttgccgcacacgccggaacggtcacgtccgactcccggcagcgcctggttgccgttcgcgtccaccaggcgcgcggaaatcgtgttgatggtggagaagccttgcacggtgccatgtccgacggtttccctgaccatggtttccaggtcggtgtcgttgggaatgtaggcgagtttcacgatgagcgggcgatcgccgatttcgtttttcacggcttccgtgatttcccccaccagatgcgggtcgtggcacagcaggcgattgtgaccttcgttggggcagctggtgttcatttccatcagtccggctccggtttccgtaaccagatgcgcggtggtgacatggtcggcgatgtacgccttgcggtccatgccgtccacgcgggagccttggaagctgggcacgagcagctgcccgtcgccggcggcggcgatcgccttcttcatgtccggctgccattcgtcggggtcacgcgacggcacgccgaaactgttggagatcgaaatcggaagctcatatcgggtgtcggcaagcacgccttcatccagttcggcgctgccgggaaccagcgacccgtctgcgttcttcggatgcacggcgagcacgttcgggaaggcgttgcaaccccacgcgcgggagcggaccgtcttgtacaccgccaaatcgaaacccatgcggaaggcggcggtggtgaaccgctcgttcagcagcggaccggcgggaatgccaaacggcaggttcacgcggaagccgaggaattcctcggcctggtcggacgactgcgactgggtggtctgtgcagactgcgcggaggcgccggcagcggaatcgcccttcatcacttcggcgaacgcaccgaacggcccctgcagatagttgtcttcatacgtgcgattgacgtcgtaaaacggcgcgaaaccctggctcatactgctccccgaaattgttctcgtgtcatgttttggatatgcgatgcgaacacatgaaatgtcatgtccactgtaacgcgacacacgtcccgcctgcacgccccgtctcaccttggaaacctccttggctaggacttccccagacgagtttgggctctcgatccaggtcaagtccagagaaccggaacgccgtcatgagccggtatgctcggcaagacggtacttgcgtccgcgtccgacgcctattggttcaataacaccgtctttcaccagtgaggccaatatctcccgggtacgggtgaggccaagccccagcaccacagccagatacgaggtgggttgcggtccgccgaccgtcaacgcataggtgattttctccaactggctttgcggcctgatcgcattgccgaaatcggcaggtagggccacgttcttgccgaatgtgccgaccatgtcgttcaaacggtcagccccgcgagcgccaatcctatggaccgtaccagtgccatactccgaattccgcattgtcggcgactccgcaccaacagggcccccgccatctgcagagactccgggaacagcagaagctccggcgatcatggaatctccggcgatcttgcgcggatacaacgtaagctgcacacgccacggatcgtcgagcacttccaattccggcgcggcggttcctgcgaacaggcagccttcacgcatcacgtcaaaaccactgcccgccttttctccgatgccaatcagattgaacattttcatcaacgtgggattccgcgtatccgaaatgccgccttgcatcacctcttcggaggaaagacgcaggctgccgggattcgacaatacgattctgtcgtaatactggatgatcaccgtgccccggcgaatgaagtaatcggcatgaacgagcgtgttggtgacagcttcacgaacggccttatccatcggattgtcatcaatcctatgcaaatcggcatcaagctggaacggatgggcaacagccgaccgcagacgattgaccaccttgccccaaaaatcgtacaagttgcccgaccacgtgtcatcgtccgaagtgaatcggtcgttccaccgctcctggtcgtccatgacctcgcgatagtccaggaaatagtaggggaattcggacgtgattcgccacgcctcaccgaacatcagcaatccggctcgtgtgggacgcacctgagaaccatcaagccgcaacgcttcgatgcgaagcaggaaatcctcatcagacaatccgacccatggatggccgggccgtccgttcttgaactgccgacgatatgatgcgacgctatccgcgttgagcgcgtcagcacccatgccttcaacaatcgttctgtccaagggaagcaggtcactgtcccgaagcatggcacgaaccgtttcctcatcgcacagataatcgccatcgccattacgccggtatgagcccgtcatcggattctggcccacgtacacgggaatacagtccctcgccgcacgaggaatgtcgatggaaataacatctccctgcgaggtatggcgaatcaccacgtcgttgtcgctcagcacaacggcactgaccttcgatggatcatgcaccatgttccaaaaatcctgcgccatgttccgcgcatcatctactccggtgatatacaaagaatgatcttcatgctcggacacgcccagcagaatcagcccaccttcggtattggcgaaggagctgtacgtctcccataaactgtggggcaggccgcccttggcacgtttcgcttccaaacggttgccttcacgcatccgaggaacctcccgggaccaccaggcatcatcgtgctcgctaccgtccattggccatcaccgccttacctaccacgcgttttacgctcgttttgccgccgctttgccgtcgtattatgattttaccaccgctttgcgcgcgctttgccaccgctttgtggaatttgctgttggcggaaaggtgatggaaggtaaacaaaaagcccggcttgggtgccgggcttgggaaaagttagatgtggttgcggtcagccaatgatgaaatgggctaccgtcgcgatcagccaacgggcctatctgcaattacggactgcgctgcgcgcaggctcattgctgccctcgtttcggactcgggcaaggccctgtcggcagtgcactgcactgccgaccagccatcgcgtcagatgatgccgcgatcggccaacgggccttgccaatcagggtattcaccctcacgggcggattcgatcggctgttccggctcgcgcttgaccggcagggtcttcggcttgaacgggaacttttcggcgcgcatcttctcgtatgcgatgatgtcgtcttcgtgctgcagcgtcaggtcgatgtcgtcgtagccgttcatcagacgccagcgggtgtagtcgttcacttcgaacggcaacgtcacatcgccgcaggtgacggtacggtcttccaggctgacggtcatttcgcggcccggctcctcgtccagcagcttccacagcagctcaatggattcctgcggcataattgcggccagcacgccgttcttggcggtgttgccgtagaaaatgtcggcgaaacgggaggaaatcaccacgcggaaaccgtaatcgtgcagcgcccacacggcgtgctcgcgggaggaaccaatgccgaaatccgggccggccacaaggatcttgccctgcttgtattccggcttgttcagcacgaattccgggtcgcggcgccacgcgtagaacagggcgtcgtcgaagccgcttttcttcacgcgcttcaggaacacggccgggatgatctggtcggtatcaacgttggaacggcgaagcggcacggccacgccggtaagggtagtcagtttttccatgtcaacaaatccttcgattgcctatcgatattcgatttcgatatttcgattacttacgattgcgttcgcagcttccgctcgcagcaggctcacaggtcggccggcgagcagatggtgccgcggatggcggtcgcggcggcaacggccggcgacgccagatgcgtgcgcgaacccttgccctgacggccttcgaagttgcggttcgaggtggagatggaacgttcgcgggctaccatcttgtccgggttcatgcccaggcacatggagcagccggcgttacgccattcggcgccgaagtccttgaagatcttgtcgaggccttccttttccgcctgcagacgcacgcgggaggatgccggcaccacgagcacacggtggatgttgtcggccttgtggtggcccttcatgatggaggcggccacgcgcaggtcctcaagacggccgttggtgcaggagccgatgaacacggtgtccacggcgatgtccttgatgcgcatgcccggcttcagtcccatgtaggcgatggcacgctcggcggcggaacgctcggtctcgtcgttgaaggaggccggatccggcaccacgccggagatcttcacgccctggcccgggttggtgccccacgtgacgtacggctcgaggtcttcggcgttgatggtcacttccttgtcgaacacggcatcgtcatcggtcttcagcgtcttccaatattcgacggccttgtcccacatctcaccttccggcgcgtgcggacggcccttcaggtattcgaaagtcacctcgtccggggcgatcatgcctgcgcgggcgccggcttcgatggacatgttgcagatggtcatgcgggcatccatcgacagcttcttgatggcttcgccacggtattcgatgacgtggccctggccgccgccggtgccgatcttcgcgatgatggccagaataatatccttggcggtgacgcccttcggcagctcaccctcgatgttcacggccatggtcttgaacggcttcaggctcagggtctgcgtggccatgacgtgctccacttcggaggtgccgatgccgatggccatagcgccgaacgcgccgtgggtggaggtgtgcgagtcgccgcacacgatggtcatgcccggctgggtcagacccagcaccggagcgaacgcgtggaccacgccctggtcagcgtcgccgagcgggcacagacgcacgccgaaatccttgcagttcttttccagcgtgctcagctggagcgccgaagtctcgtccggattcggacggtcgatgtcgacggtcggcgtgttgtggtcttccgtggcaatcagctggtcgacgtgacgcggcttgcgtcccgccagacgcagaccttcgaacgcctgcgggctggtcacttcgtgcatgagcatcaggtcgatgtacagcaggtcgggagccccatcgctacccttgcgtaccaaatgatcggcccagaccttctcggccaatgtagttcccattgtgggacctcctcagatttttcctcactaatttcctcgcggctattgccttgccgcattcttcgtgctataagcctatgggcttgaaacgggttcgaggtccttcatgccggtatatgagatatgaacgagggacgagcgcggcaaacgcggaaaagttacttcccgtcttcttacggcatatgcgcaatcgttgaaatttcagcattttcccggcttcaccagccggtggaagcaaggtaaataatctgctttaccccagtcgcgaaccacatacattttgcatttcaatatgtgagatggcataattcagcgtatgacttcttcttcgaatacgagcaacgccatgcccaaaacgcaggccatgaacgccacgaacgaggcaaacggcaattacgcagccaccccgcaaagcaacgaaattcattccggggtcggcgtgctcgacaagacagtcaagattctcgacgctcttgaatccggcccagccacactcggacagctggtttccgcgaccggtctggctcgtccgaccgcgcatcgtcttgcgatcgcgctggaacgtcaccgtttcgttttgcgcgaccagcacggtcgtttcgtgctcggatcgcgattcgcggaacttgcggccgcagccggcgaggaccgcctgttgaccgccgccgcgccgattctgcagaccctgctcgaccgcaccggcgaatccgcgcagatctaccgccgtcagggcgatcagcgcgtctgcatcgcagccgtggagcgcgcgtccggcctgcgagattccattccggttggtgcgatgctgtccatggaagccggttccgcagcccagattctgctggcttgggaggattccgaacgcctgcatcagggtcttcgccacgccaagttcactgcggccaagctcaccgccgtccgcaagcgcggctgggccgagtcgatcaatgaacgcgatgagggcgtgtgttcgatttccgcgccgattcgcaacgcgtccggccaggtgatcgccgccatttcgatttccggcccgaatggccgtatgggcgccaaccccggccgccgttacgcgccgctggtcatggccgccggcaagtatctgaccgacgcgctgatcaaggcgtcttccggccgctgacaggtccgcgaccagtcgcatacgtaacgtaaaagctgacgatggaaagttcccatcgtcagcttttttgtattcatttcaaagctaaaagtcgggaaaaggaatagtcaccgccggaaaggctaccggcggaacgactagtcaacaaacagctaccggcgaaacagcgagaccagcttgttccacgtcttgctccaccacgtcggcctgtggagcaggtccatgccttccgaatcgggcttcgattcgctggtcatgccgtaggcgtaggccttgcccgcgctgggtttgcccaccagctcgtcgtattccaacagctgcgtgcgcggctcgtacgggtggcggatgtcgaattcgaacagtcgagcggcacgcttggccggcaccgggccgtatgagccaaaaccgctggtcggcgaggcgaccatcatcatctgccggtcaccgtcggttccgaccggcacggaaccgacgaaggcgttgcggtggtcgtgcccggcggaaatcgcaaaatatcccgccttgtcaaggattgcgaattcgccgctgtcggcatccgggcagctgacgccctcccccagatagcttccgggttgcgttttgtcttcgttgagcacgaaatgccgccccgcgaagttgcggtatccttcaatcgcgcgcgcagcggtggccgcgaccggcttgagcaggcgataatactgttcgatcgggaaatgctggaacaccatgcatggcagcgtggacggcgtcttgcgcggttcgcgcggcgagtcctgttcatcttgccggtcttgttgcagctgctgcgattgcgtcgccatcagccccggcgcatccgccaggaagcgcagcgcggcttccgacgggctcccgtagccgccggaacgcgcgtaatcgcccgaatccagcaagaccaagcccaacacgtcatacgtgcgatcgacgtccgtcaccgacaacgcgaatgtgccgggcgcgcacgcgatcacgggctgttccggcaatccgaagtcctgttccatatcgccaacatcatgtttcacaccatgtttcacggcgatgcccgtcgtgccgtcggcagcgcgttccggattgatacaccctgggaattcgcggcagatgctttcgatttcgtcattgtcgagcccgcactggaagtcatggttgccgaacgtcacagcccacggcacgccgcggtcggcaagcgggtggaccagttgttcgatggtggctcgcaccaattcgcgggtgtgttccaatgcggccgcatagcgttccccggacgcttcggacgatgcggatgccggacgcgcgtcccagcgacgcttgcgggaggtcagcgcgtatgcggaatcatatccggcgatctggttgccgttgaaaataacaagatcggggcgtgtggcgtcaagcgaggcctcgatgaggctgatggtgtctttgctgactttcggcccgtcttggatgtcggcgaattgcaatacgcggaatttgccggactggtggaattgcaggcggccaagccgtgcggatacggaaagcggtcgacggtccccctcttccgctggttggatgcgcgggcgcgtggctttggcggcatgctgcaattcggtcatacttctagggtaatgcaacattgggcgattacatgtgcgattcacgcagggcgtcagcagattgcgctgccacatcgcatccggcaaaatccatcaacccaccgcccaaagcgacgtgaacagacaggtgcgaaaaacaaaaaaccctcgcatctgcgagggctcattggctgggatgcctggactcgaaccaagaatggctgaaccagaatcagctgtgttgccaattacaccacatcccaatttggcaggcgtggcaacttcgaaaagttgtccgtcgtacccccgaccggatttgaaccggtgttggcgccgtgagagggcgtagtcctagaccgctagacgacgggggcttgagttatcgctgtgattctcagctaggctgtgaaccgcaacgagtgataaatatacgcgaaacagcacagtcgcgcaacttacggcgtgtcgcgctattttccgccattccgcaccagccttccgcataaacgaaaacccgccgaatcactccggcgggtttccatcattcagctaacagtcagcagctcaacggctcacaggtgctcgcgcaggcccttgagtcgagccatggcaacgtccttgccgacgatttccatggattcgaacagcggcggggacacgcggcggccgctcatggccacgcgcaccgggccgaaagccagacgcggcttgtagccgccgtcttcgaccagcgccttgttcagcgtctcgtgcaggaagtcggtcttccaatcaccctcagcaacggcgtccagcgccgcgatcgcagcgtcgagcacggccggagcggaatccttcagctgcttcttggcgtcggcgtccggctcgatgtagccttcggtggacagcagggagccgaccatgccggccacttcgcccagcaggcgcacgcgcggctgcacgagcggagcagcggcggtgaggacctcgcgctcacggtcggtcagcgcgtcccaggaatcggcggacaccacgccgtcacgcttgaggtacggcacggaacggttcaggaagtcctgcggttcgagcatgcggatgtgctcggcgttgatggagatggccttgtcgatgtcgaagcgggccgggttggccttgacgtcacgcacgtcgaacttctcgatcatctcgtccatggagaacacgtcgcggtcgggggcgatggaccagcccagcagcgccaggtagttcagcaggccctcacggatgaagccgttgtcacggtgcaggaacaggttggattccggatcgcgcttggacagcttcttgttgccctggcccatgacgtacggcatgtggccgaacagcggcatttccttggccacgcccagctcgatcaggtaacggtacagcacgatctgacgcggggtggagctcagcagatcctcgccgcgcagcaccacgttgatgcgcatcatggcgtcgtcgaccgggttggtcagcgtgtacagcgggtcgccgttcggacgcacgatcacgtaatccggcacggaaccggccttgaattcgatgcgaccgcggataaggtcgtcgaacgcgacgtcctcgtcgggcatgcggatacgcagggccggcttgcggccttccgcgcggaacgcggccttctgctcttcggtgaggttgcgatcgtagccgtcatagccgaaagccttcggacggccggcggccacgttgcgggcctcgatctcctcaggagtggagaaggattcgtaggcgtagccggcttcgagcagcttggctgcgacgtccttatagatgtcgccacgctcggactggcggtacgggccgtccgggccacccacgttgatgccttcatcccagtcgatgcccagccaattcagggcctcgatgatctggttgtagctttcctcggagtcgcgctgggcgtccgtatcctcgatacggaacacgaacgtgcccttggtgtggcgggcctcagcccagttgaacagtgcggtgcggaccatgccgacgtgcggaatgccggtcggggacgggcagaaacgcacacgaacgttttcaggaagttccggtttggtattttcaacttcagtcataggctccattgtgccgcgcaaaccggacgtgccacgacccaatcgccgtttttcttccgcagcgttccatactgcaatatttttccctatcttcacatcggcaaaggagtaatgtatgaggcgactttctttattctttagtcaccgttttgtgaaagggcactctaatgacggaccccaaccaatacaatccgcaggtgccgcagccggcagcgcagtacggccagactcctgcccccgactacgggcagccggcaccgcagtacggcacaccggattacgggcaggcgcaggcaccccagtacgccaccccggactacaaccaggcacctcagtatggtcaggctccgcagtacggccaagcaccgcaaccgcaatacaaccaggctccgcagtacgctcaggcccctcaatatggacaggcccctcagtacggccaggctccagccgcgaattacgggcagccggcaccgcaaccgcagtcgggcaatagcttcttcgcattgaccgcgccgcttgacatgcccgcatatggctgcaacctgggcgaggcgatcgtccgtttcttcaagaagtacgcggtgttcaagggccgcgcctcgcgtagcgagttctggtggtggttcctcacctataccgtcgtcactttcgtgttgagactcgtgttccgcacgttgaggaacctcaccgattccggcgtgatcgccaccgtcggagactcgttctcctccatttggggactcgtcgtgcttgtgccgaccatcgcgcttggcgtacgtcgtctgcatgacatcaacatgcgtggcaccgtgctggccatcatctacgcggtacaggcggccgccggaatcttcttcgccatcggtctgatcctcatcatcggcagcagtctttcgttcaggtcgttggaggcgggcaacagcgtcagcatcggcggcgttgtcctgctgatcctcggcgtgctggccttcattgccagcggtgtgttctactttgtgctgatggcccgcgattccaatccggaaggcgcgcgtttcgacgctcctacggcttccaacgcatgggctcccgccacgggcgaggctccggcagacccgtatgcggcgcaggccacctcgtacggcaacgtcccgctgccgaccaatccggcggctgcggcaccggccacgccgtacacggcaccagcgactccggccgattcgtacacagctccggcaccgcagtatgacgccgcgcagcagcacgccgcgccgcaatacgccgcacctcagcagaatccgctggcggaggctccgtccgtaccgtctatgcctccgatgccggctgttccgaccatgcctccgacaccgtccattccaccgatgccggaagtgccggcccagttccagcatccgcacgagcagccgaataccgacgctccggcggattcggacgctccggcagtaccgaatgatccggcgaacggcaccgatcagcagctctgatttcgctctgatccccgccttatcgccacacaaaacgtggcacaccataacgaataacgaataatcccggtatcctgtgcaatcgcaggataccgggattattcgtttcagatcattcgttacgggtagtgacgtcgttgcggatgtaacgcgtgggataggcgacggccacgcgcaattcgagcgcaagcacaagcgcacgcaacgcaagtacacgcaaagccttcaccgtcagacgtcacacgaccgcccgcaacacttattcctcggtcggctccgaaccggcctcttccgacgagtccgaatcctcagacaaattcgagtctgcagacgaatccaaatccgcgtcggaagccgcgttatcgccatcgctcgtcaaattgtatttctttgcgagcgcttccctgcttttgcgctcgtcctcgtctttggcgtcctgttcggcctgcttcgggtcccactccaggaacctcatatgccgcagccattcctgccccgcgaagaaagcgaggtacttgacggtggtggagaacgtcagcgggttgaacgagctgtcgaacaccgactggggccgtccgaactggcgggcggtgtcacgcagaccaaacaggttgatgagctgttcggcgttgatgaaagtgggcggaatcgacagctggttgcgcatggcgttgacgaacagcagcaccggcagcacgcggatggcctgctcctgcgaatcgtcggtgccatagcacatgaggtttatcagcgcgtcgagaaccgtcatcgaggcgaggtagcgtcttgcgaattcgttgcggtccaccgtggccgactggcagatgccgacgttttccgccacgtcatcgtcgacttcgaatccggaggcgctgcgcatagtgcgtgagaggttctccatgaggtcttggatttccttttcgattcgggtctccacgtcgatgccgagtattctggcggtttccatgaacagttcgatgccgtcgaccccgtggtaggaggccatcacgtcataggcgcggttggcgtccatcagcgtgcggatgatttccggatcgacgccgggaagcacatccatgccttcgtatacggcttccgcaaccgactggtcgacttcttcggagcgtttcagcagcacctgcgtcatcatgccggagaacatcacctgcaggttctccgcatatttgacgtcgttttccagttcctggttcgtttgcaacggccacatcttgaccagatcgacaccgtagtcaactgccatggagaccacgtgcgagccgtacatcgagtcgacgaccttctggtcgtatacaaaagacatactttctccttgtatatcgtgcggccggcccgaaccgcagtcatccccgaccgcgattgagccaccgcatgttttggttcacattattcgacgtccgccgccggatcggcgtacgtaatggacattattttcccggtattgcaatcgtaagtgatggaggtgatagaagcgagcgcggtgtggcgcaacagcatgttgtgttcggggtgccccgtttccagcatgtgccggtagctccaaatcggcgattcgtggctgaccaccacgatctgtttgccggggtattccgccactttctccagggcgaagtcctgcatgcgatgcgcgatcgactggtagctttcgccccagctcggcttccacaggttgcgtaccagcttccagttgccgttcttccacagcgcgccttcgccgaagccgatacgcttgccgcgaaattcgttgcgcgcttcgatgaggcgttcgtccgtctgcagctccagcggttcctcgccgcgcagtccacgtaccgaattcagcgattcgaggatctcccccgccgtttcgcgcgtgcgttccagcggcgacgagtagacggcggatacggtgttcagctgcgggctgaccgcgatgtaatgcgcggtggcctgcgccatgcgcacgcccacgtcggacaggtggaaaccgggcagccgctcgtacagcaggtgcccggggttctccactttgccgtggcgcacgaaatggatggttgtcgccggcatattggccgcctttcttgcgtttcggacctgccggccacgtgctggctcagcacgtttcgccggtcgccggccctgtgaaaaaattcgtcgattcgaatattggttcctgccctaatgtaccgcgtgtcacgacggtacctgcgcataaagttgccttggtcaacaaagacacacaaacaacacgcaccatcccacctttctccccgtgtgcggcatgtcaaacatgtcaatcgattgacgtgttcggacggctggggcagcgagctggtatcggaagcggttaaccaataattcaggggaaccaccaccatcagtccgcacgcgacgcaaagctgcggacgtcacgagcgaaaccgtgagcggaaaggagcggcaagcatgaccaacaatgtcctcgtcggcgtcaaagacatcggccaacgtcttttcggagggtatgcggagctgcttcgcataccgcacaccgcgcgattctccgtcggatcggtaatcgcctgcatgccgttcccaatggtcggcatgacgatcacgatttccgtgcagcattactacggcaactattcgctggcgggcgcgctgacggccgtgcaggcgatcgcgctggccgtggcgagcccggtgctcggcaagctggtcgacaaattcggtcaacggcaggtgtcgattcccacaatcatcgtgtggatggtggcggcgatcgcgctggtctcctgcatcaccgcacgcgtgccgtcgtggatcctgttctgcatagtgccgttcatggccgcgattccgccgtggggcgcgatgagccgtcaacgttggacgacgctgctcaagggcgatgcggagaagacgaaccgtgcgctgtcgctgtccggcgtattcgacgagtgcatgtgggttatcggcaatccgctggcgtccacattggccgtgatctccggactgctggcgttctcgttcaccggcatgtgcgtggtgatcggcgcgctgatgttcctcacggaactttctaccgaaccgaaatcgcagacgcagttggctcgtgaagccggcatgacacgtaaagaataccgagagcgcgaggctgctcgttccaaggctttgcaaaccgaagcggcggtagaatacgcgcgcgacaaggctcgtgcggaaggcaagacggccgctgaggtgaaggccgcgatgcagaaggccgccacggatattgcggcaggccgcaaggaatcgatttgggggccaggcctgatcgccgtgtgtgtgacgtggttcggcctgggggcattccagtcagctgccagcatttcgattgttgcattcgccacggaagcgcatatgaagcagtacaccggtttcgtattcgcctgtttctcgctcagctctctgatcggcgcacttgtgtacggcgcgaagaattggaagattccgctgtggaaacgtttctacttctgccttgcggtggtgaatctgggcatcggctcattcatgttcgctaagcatctatgggtgatcatgatcatctacctgtgcatcggcgtctgccaggctccgacgtgggtgaacggcaaccagctgatgctgcacctggttccgcccacgcgcttcacggaaggcatggcctggatgggcgcgatgaattcgatcggcggttcggtgggctccgcgatcgcgggacagttcatcgaccgcatgggctcgcatggcggcttcatcgtggtgacgactttggcattggcttcgctggtgatcgccctgttcggcttcaagcagatcaaggaatccacggagcagccgatgctcaccagcgtgagcgtgtgacggagcatgtgccggatgccgacgggtaaccggcaggcacggcagacaatccgcataacgaaaagcgcgtccgaatcgcaatggattcggacgcgcttttcgttaccccgttatttgggagttacttcggccagcccttgggcgtatgttccagcgaccacacgccgagcttgtgcgagaagctgttctcccacttggcctccagctcttcgggagtcaggcggttctcctgcttcttcaagcggttcatcgcattggtgtgcgtatcgtccagcagccacttgcgggtcaggaagttccacaccatcaccacggcggtggcgatgagcttgcccacgttggtgcggatcaggtattcggtgctctgcgacacgtaggcatcgtggttcatgccgtacgtggagatccagatgatggcgtcgttcataaacaggccgatcaccgcgccgaccacgaagatgacgatctccatccaacgcgccatgtcctcacgatgcttgaacaccatcttcatgctggcgacatagttgaagatcaacgagatgataaacgagatggtggcggcgagcacgttgtgcatgtggaaggcgccgacgagaatgtttagaataccccagtcgatgatgaaggcgatcacacccacaatgccgaatttcataagctgttcaatcagttttctcacacgggatatttaacactcgcgcgcagaccacctaaacttgggtaacgaagaacaatatatttcaacgattgcaaggagcagcaatgccagtcatccacacgcacgtttccgtatccaccacccctgggcagcgcgaggcgctgaaggccgcctacggcaaggccatcaccgcagttcccggcaagtctgaaggctggctgatgtgcccgttcgaagacaatatgccgatttatttcggcggtgacgattccaagccggccgcatacgtggaagtgaatgtgttcggccgttccgtgccgggttccgcctgggagaagctgacggagcagatcatggccgcgctgggcaaggagctgggcattccggccgaccgcacttacatccgctacaccgccacgactgactggggctggaacggtggaaacttctgacgaagttccaccgttccttcgaggtttgcccatattgcaaacctctcacctcacctacgggaagcacgtctaggaagctcgcctgactacggcagggaaatcgcaatatcagcacccccgaccgctcacaaaagcgagaaacgggccttttctacgggacgtgagcgaaaaggggtatgaaaaccggcaaaatcgtcagtaatcatacccccttttgctcataagagagaaaaatcgccccattccgcaactcgtgagcaaaagggggcgcacatgcaagcacgcccgcacccacaaacggacaacgtaaaggtatcacccacgaaaaaaaccgccggcccgaacgggaccagcggctttgtatttacgccgaatcaacgattagcgagcgccctcgacggtacgggacgtaccgccacgcggcgcaatcgcaagaaaatcagacgatcttcggcatcggggtggtcagcgacgtggtgaggttcacgtgcaccaggcccgcgccggaatgcacttcgaccttcttcagcgtgacggtgcgctcggcttccggagcgcggtcgttgtcggtcatggtggccggagacttcaccgcgaccagagcaagcgagccgaaatcgatgcccgcgctggcgcacagaccctcggcggcctgcaacgactcggcgaaaccgtccttcagaatcacacggtcggccggaacgccatacgcatgctcggcgacccaacgcacgttctccaccagagccatgcccttgtggctgtgcggttcggccggcatagaaccgttcgtcacggcatcgacgaacgcatcgagctgcggggcgagcgcgtcgccaccgtcgcggtacaggttgccgatgatcgggtcgcggaattccagttccttggcggtgtccttgagcgccggaatctgatcatcctcgccatcccacaggttgataagcgggaaggtaggaatatcaagaccttcgaggcgctggacgtggaacgggtagcgccatgccagatccggatcgtcgcgccacgtggaagcgcgggtcacgacgatggctgcggacggccactgcgcgtcgtattcgcggcaggcgatgtcgagccacttctgcgcaccagcgtcggtgccgtagccggcttcgacgatgaccacgtcatgcagcgcgcacgccatctccacggaaaccagcgtcggaatgccgatggacacgttggcgaacgggccgccgtgcacgtacaccggagagccgttcacggtctccgtcttggctggcttcacggcgtcgccgaggatgccggtgatacgccacaggtcaacgaattcgccgaaggtcacggccttgccatccttcgtgccggcgaccatcttggcaacgcgctcggagatctcatccatggaacgcgacagcacaacgatctgcatgagctcgcaggtcggggtgagcaccacacgctcagccacgtcgccctttccacggtccactgcgatctggcgcagggaacgggacggcacttcggagacgcgcggtacgaggatggtgtccagcttgccgtcgtcaacagccttctccgcaaaggagaccaacaggttctgggcggcctcgatggctcccatttcaccgcacagaccccagtcgatcagctccgggtgggtcagggaggccttgccgccaccggaggcgccacccttggaaccggctgcggtgatgcccatgctcggctggcgcagcacggctgccgcgtcgatgccacgttcgcgcaacgcgtcgatcagcgcgatcgtggtggtggtcttgccttcgccgcgggacgccttcagcggggtgtcggcggtgacgaggacgaccttgccatgcttgcgcggcgcatcaggattcttcttcaggtaatcgagatagccgaacgcatcaatcttctgcaccagaccgtattggctggtgaaatcctcaatgctggtcactgggttcctttcttgggaaagcattccgctgtatggcgcacaacgtacgcgacagacatcgcctatgcaacgcgcgccggcacgagcggaaaagcaaagacgatcgccattctaataagcacgcgccaccaaagaaaaccggctcccgcacagcggacgcgcgccgaccgtcatacggaactgtttgtggcgaacgctgtgcggaagccggttgctacgcgggttttcgtagaatttcttgcgattgcgcaatcgcagaaaatatcagaagtcggacatgtggaagccgttcttcatgttcatgctggtggtgtagagcacggagtcgagcagcttgtcggtttccgccttaagctgcgcggccatggtctcgttggcggcggcgagcacttcgcgggcttcgttgttgcggacggcttcgatgatttcgtccggttccatcggctgcacgtcgccgatctcgtcttcggcgtcgaattcgtcgaccacgccttccaccagtcggtcgatctgctcgtcggtggcggctaccatgcggtggcccatgccgccggtcttctcctggtagcgctccaccgcgttggcggtgtcggcgaagctggcgtcgcacagggccgcgatgatgcggttctcccagtagaagttctcggaggtgacgcgcgtggtggtgtcttcgaggtacttcggcgtggagtcgacgttcgggaagaacggcacgagcgtgttgaacgggttggaaccgtaggcaatccactgcacggcacggttgacctgcgggcggtacgggcgaatctgcatgacggacagctggctctgacggttgatgccgatcggacggaacatgtggcgcgaatgctggtcgccgagcttgccgtacggatcgtacggggtgccttggtagtgggagctcagcacgtacttcacgtcttcgatggtgatcttgcgatcgggctggcgagcccatggaatgtcgtccgcggtcggctggtggtcggcgtcctgaccgtcccactgctcgtcgtacgggttgaggaaacgctgcatgtaccaggcgcgcggggtgttgtagacgtggtcggaatcggagtgggagccgaacgcgtcgcgcgggttgaacggggtgacgttctccacggccaggtccagatggttgcgttcgatgaattcgccgaggtccgcggagcacatgtgctcttcctggtttccgagcgcgtcgtcgaggtcgaattcgtcgatgccgagctggttcggcatggtcacgtatgcctcgtccggcacacgcttggcgatccagtggtggccgccgacggtttcaagccaccagatctcatccacatcggagaaggcgacaccgttcatttcgtacgtgccgtactgttcgagcagcgcgccgagacgtgccacgccttcgcgggcggtcttgacgtacggcagtacgagggtgaggaagtcctcttcgccaatgccgccgggcacttccggctcgtagccgtcttcgccttccttgcccttggccggagtgagctccacgaacgggtcggcgccgagcacgcgctcgttggtggtgagggtttcggtggcgctcatggccacgttcgcctcgttgacgccggcttcgccccaaatgccttccttcagatccgcgttcggcacggccgtgtactgcagcggctcgcccggcaggtcgacttccacgtgggacagcacgctcttgtagtggcgcggctgctcgtccggcttgacgacgatgaagcgcttcgggcagaattcgccgttcgcgctgtcctcattgcgggcgatgatggtcgatccgtcatagcttgcgtccttgccgaccagaatcgtggtgcatgccatatatgtaggttcctttcgtttgttttgtttacgtttgcggtattctttggtattttcttgcgattacgcggtttgcgccttgccggctgttctcgccggtttcgccggtcacgccttgccggtcaggaagatagcgccttggtccgcgatcgcaccggaattacgcaacgcgcgttccatctcgttgagccagaagccttgattgagaccattgagaggcgcggtggtgccccatacgtgcaggtagtattcgtgatcccgatcaggcggatacggaccgttgtaacgcatggtgacggccggatcgccgctgcggcccttcagcagcggcgacgcggcggacgtgcggccctgcaccgtctcgggaatcatcgcggacaccgtgcgggagaagtcggcgggaatcgccagcgcgtgggaatcgttgaaatcgtacatcagcgcgtccacgggcagattggcgagcgaccaatggttccactggaagccgcacaccggaatggaatcgggatcgacgaattcccaatgcaggaactgcacggacgggtcgagctcgtcgatatagaaggggaaggaaacgatcggagtgccgtcgatgcagttctcaggcggcgccgccttggcgaacgcgtcgggaatgacggtgaaatctgcggaaatcttcatgcttccagtatcgcgcatgcgcgtgacgcgacgcggccgtatgacgcgtctacgccggtggcgcaatcgacgcaatcgcagcaatcgacacaacccgcaaccgaaacgaccccgtccgcgcggcgatcgcacgaaacggggtcattccgggaaacagggcccatcagaaccgaatcgctctcataggcacatttgcagtggcggaaccctgcggccgcgatgacgcagccgcaaagtccggaatagccgagcgaaagaaagaagggggaaaaatcactcggccggcttgtagaagtcgccgttgagggcggcggccgccttggccttggcctcttcgaaggtgacttcggcgagggaggcgcgcacatcgtccagcgccaccggggtcatggacagcgagttgacgccgagaccggccagcacgaccgccagatccggatcggccgcggcctcgccgcacacgcccaccggcatgcccttggcgttgcccgcgtcgcagatcatcttgatggcgcgcagcaccgccggatgccatgcggtctggtagttggccacggaaccgagggtacggtcggcggcaagggtgtactgggtcaggtcgttggtgccgatggacacgaagtcggccacgtcggccaccttgtcggccatcagggcgatcgacggcacttcggccatagcgcccacgaacttcagaccgaagctcttgccgagtttgacgaagtagtcggcctcatgctggtcggcgaccatcggggccatgacccacaggttcgcgtcggttgcggcgtcggcggcggcgagcgccttgagctggccttcgagcacgtccatgtgggcgcgcagggtacgcaggccacgcaggccgagggccggattcggctcgtcttccggagtcaggaacggcagcggcttgtcggcgccggcgtcgagcatgcggatcacgaccttcttgcccgggaactggctgagcagctcggtgtaggccttggtctgctcttcgacgctcggcggctcggagttgccgatgaacaggaattcggtacggaacaggccaacgccttcggcgccgtattccagcgccttcgcggcatcggacggcttaccgacgttggcgagcagcggaatcagatggccgtccttggtggcgcccggcttgccacgcagttccttggctgcggcggcacgggacttggcggcttcggcggcggcgatctcgtcttcgctcgggttcaccacgatctcacccttggctgcgttgacgatgacgttggtgccgttctcaagttcggcggcttcggcggcggagacgaccgcgacgatgccacgggcgcgcgccagaatggcggtgtgggaggtcggaccgccctgggaggtgacgatggccagggtcttgctcatgtcgagcgcggcggtgtcggccggggacaggtcttcggcgacgagcacgaacggggtttcgctgaccggcaggcctggggcgggagcgcccatgaggtcggcgatcacacgctggccgacgtcatgcaggtcggctgcgcgctcggcctggtagccgccgatggcgcggaacatgtcttcgaccgcgccgaagccttccagcacggcgcgctcggcggtcttgccctggttgatgaggtccttgatggactgtgcaagggacggatcggaggcgaacatggcgatggcctgcaggatcggggcggcctgcttggcgccttcgtcgccgttggcggcttcttcggcgcgacggttcaggtcggcgttgacgagggcgagcgacttttcgacgcgggcgatttcggtttccgcggagatgctttcggcgcgcggagcgtccgacggttccggcagcggagcggccatgcgaatgaccgggccgactgcgacgccacgaccgataccaacacccttaatgttcatgagaactccttttcctgtttccttgggaaaaaatatggatacgcaaacgattgcaggattatgcctgccttgcgtaggtgagttactgcaatgatccccaccgtctttgccggtaaatcattttcagcctgcgattagtatacacgaaattcccgcaaaacaaaaccggtaaacgttttctgtgtttcgtaaaaactgtgctatgataatcgcaagaaatgcagatgccggcaaaagccgcataatgcaatcgatatgcaaaaatcgatatacatcgacgtgtaaatatcgagacgacccaacgtaagcaaaccaaccaccaaccacaacaaaggagaccattatggcaacccgcaatctcgtcatcaacgatccggtcggcattcacgcccgtccggccgccatgttcgcgcaggccgtcaccgcttccggccagaccgtgaccatcgccaaggaaggcggcaacgccgttccggccggctccatcctgtccatcatgggtctgggcatcaagcagggcgacaccgtggtcatcaacgtcgaaggcgacaacgccgaggccgtggccgacaacctggccaacatcctcgtcaacgccgagtgacgcaccgcgcataacgcgctgacgcactgacgtacgaacgtttcgaccgcccgccatattcgacgggcggtcgttctattcttaataggttcttcgcggctcgaaccggttcatcagaccagacctttgaccgagaagcacacaggggttcagggcaccctctagggcattttgaaaaacacttagggagccggcaaacgcaagccggacacgacggaaaggacagcgcatggcaggcagaaccgacagcggcagctcaatcaccaacgtcgcggcgacggccggcgtgtccatcgccaccgtctcacgcgtgctgtccggcaaacgcggcaaggacgacgatatcgcccgccgcgtgcgcgaagccgccaaacagctcggctattccgtcaactacgcggcgagcgcgctgcgcagcgacgtgacgaaaaccatcggcctggtcattccgagcgccacggaaccgttctccgcgcaactgctcgacgagatcgagccgaccatcgacaccgaatcgcaacagctgctgctgggcatcggagccacgcaggaagcgcaggcggaacgcatcgaatcgctggccaaccgccatgtggacgggctgatcgtggtgcccgcggccggcgctgaccttgccggaacgttgaaccagtacgcgaacacgctgccgatcgtgcagatctgcggacggcagaccgcgccgcgcgtgtccgtggtaggcatcgacgagaacgccgcgatggaggcaatcgtcaaacatctggccgagcagggcatcgcgtccgccgcatacatggccggcaacgagctgtctttcgaatcggcggaactgttcgccacattccacacgcatatgcgcacttacgggcttgccaccagcgaaaactggaaccagttcggcgaacgtaccgtgcagcgcggtttcgattgcgccatgcggctgttcaacgggccgctcgtgcagccggaggccgtggtctgcgccgacgatgcgatcgcgttcggcgtgatggtggcgttcgacgcgttgggaatccgcgtgccggaggacgtgctggtggtcggctaccatgattccgccatagcgcgtaccaccatgccccgtctgacgtcggtgcgtgcgccgtttgagcgtattgtgtcggaatgcttgcgattgctggcttccggtcctgccggaggcgcggctgagacggctgctgcgccaggcggcagcgtgcgcgcgccccgtgtcatgctcgccccgcagcttattgtgcgggattcctcggtgttccgccggtgaatcgcgaatcgaatcgccggtaattactggaaattacgaaaatcatggaatcagcgcgcagaacagcgcttcgaacaccaaaaccggattgccgttgccattgagcctgcggcgcgcggtggcgatgtcctccagccggcgcacggcccccgtacggtcgagccgtaccgacaattccgtgatggcggaacggttttcgaggttgatgagtcccaccgcgtcctcggcgttgttctgcagcaccgccacgtcacggtagatgctggcggccgaattgagcgcacggtcgagcacgtcacgcgtgagtctggtggcgcgtcgtttgagctcgtcttttttggcgatcgcattgtatgcgccacgcagtttcgggggtatgcggtctttgggtccgagcccgttgatgcggcggaaatcggcttccgcttcggacgctttgacgttgacttccgcttcggcctgcgccttcgcgttgtcgatgaggttgccggccaatagcacggcatccgacgcgcgatgcaagccgagcacgccgacgatgagctcgtcgcggtccgtcatgatgcgttcgtccttggcatacaggctcgcgatgccgatgtgcccctccgacaatcgtgccgcacgcgccgcgatattcggctcgaaaccttgcgattccaagaatttcgccaccgcctggttggacggtacggccaagttgacgatgcgcgtgcgcgagcggatggtcggcagcacgtcttgggcgctgggcgcacacagcagccagatggcgtgcgggctcggctcttcgatttccttcaacagcacgttggtggtgcgttccatcatgcggtcgacgtcttcgatgatgatgatgcgccacggcgcggtgccgggcatctgctcggatgtggtgatgatgtcacgcacctcgtcgatgccgatggtcactttgttggtggccagcacgctcacgtcgggatgggtaccggcaagcacctgctcggtggttttggtcggctcatcgttcaggccatgatcggggctttcgagcgcggcggcgaacgcgcgggcaacgttggaacggcccgatccgggagggccgcaaatcagccacgactgcgcgatggccttcgggtcgccgctggcgatggccttcagctgttcgaccacctgcgcttggcctactatggagttccacacgctcatgcgatacccccgtcagcggtgctcacggtgtcgaaatcggctttgatacgcgcccacacgtcttcgatggactggcttgcgtcaatgacgtggaaccgttccggctcacgttcagccaagtcgaggaacgcgacgcgtgtgcgacgctggaagtcgttgccggccgcctccatgcggtcttcggcatgctgcagccgcgcatgcgattgcgccggatccatatccagcagatacgtgcgttccggcagcagaccgttcgtggcccacatgctcaggtttcggatttccgcggccgtcagctcgcggccgcccgcctggtacgccaaagaggaatcgagataccggtcggtgatgaccaccgcgccgcgttgcagagcgggcagaatcacttccgcgacgtgctgcgcgcggtcggcggcgaacaacagcgcctccgtacgcggggcgatgtcggcacaatcgttctcatcccccgtatccacgccgtgcaacagcattttgcgaatcgccacgcccaatgcggtgccgcccggctcgcgcgtgaccacgcattcgcggccctgagattcaacatatgcgcgcaaccgttcgacctgcgtggtcttgcccacgccgtcaacgccttcaaacgagataaaagtgccctgcatgcctttcactgtaccgtgcgcccctgccgtgcccggccattcggcccacagcttggtgtcgcacgatgccgattgtcttgcggaacatcagatcgtgcgacgtttccgcaccgcgtaacgtcagcgtgcgggaacgacttcaggacgcgcgtagccttcgttggcggtcagccagtcgacgtcagccttcacggtggacgcggtggaaccgatctccttcgctatacgcgtattcgcccaacccttgtcggccagttcacgcaccttggcacggcggtcggcacgcgcctgttcggtcgcgctcaccttcttcgcggatttcgctcctttggcagcgcccttcttggctcccttcgcagccgtcttgcggccacgacgcttcgacggcccctgcgcgcgcttctccgccagcaggcggaacgcctcggccggttcgatcgattcgggcgcatactgcttcggcagcgtacggtttgtctcgccgtcggtgatgtacgcgccgtagaagccgtccttgatggtcacgtgcttctgggtttccggatcggtgcccaagtcgcgcaacggcggcttggccgcgccacgtccacgaccgcgtccatacttcggctgcgcgaacagttccttggccttctccaagtcgacggtgaagatctcgtcttcggaagccagcgaacgcgtgtcggacttgccgtcggcaccggtcttggtcaggtacgggccgtaacggccattgttggccatgaccgtaaccgtttgcatttcgccggtttcggcgttcgcctcatcgtaggagccgacttcgcgcggcaggctcagcagtttcagcgcatcctccaacgtcagcgattcgggactcatcgtcttgaacagcgacgccatcttcggacggtcggaagccgccttcttaccgccggaacgcttcgtcttgcccgccttgcctgcggcggactcgacagcggtatcgccggcatcttccgcgctcggcatgaccaacgccacgtacgggccgaaccggccattgcgtacctcgacggtgccgccggacaccgggtccttgcccagttcacgcggcccaccggaatggttttcaatcagatcgtggccgacctcgacggtcagctcatccggagcgagcgtatccggcagcgaggcgcgcttcggattgccttccgcatccagatgcttcatgtcctcaagatacgggccataacggccgacacgcacgtgcaggccatcgccgatatcgatggtgttgatctcacgcgcatcaatctcgccaagctgcgccacctgctgctgcaggccctcatgcgcctcgtcggcggactgggccgcaccatcgccggaaccgaagtagaagcgggtcagccacgccttgccggtctcatggccaccagcaatctggtcgaggccggtttccatatcggcggtgaactcgtaatccacatacttcgggaacttcgtttcaagcagtttggtgacggagaacgccagccaggacggaatcagcgcacggccacgctcgtacacgtacccgcggtcgatgattgtggagatgatgctcgcatacgtggacggacggccgatttccttctgttccaacgttttgacgagcgacgcttcggtgtagcgcgctggcggctgggtctcgtggccgtccgcggcaacgtccacggcggcaagctcgtcgcccggctgcatcggcggcagggaaacgttgtcatcgatcttcttcgaagccttcgcactgccggtggtcttcgagtccaccttcacgcccgccgcttcggcgctcttcttcgcgtcggcaacgctacggcggccctcgccggtggccttcatgaagccggggaattcgatgacggtgccggacgcctggaacatggcctcgccgtcggattcggtcggcgcggacagacgcacggtggcggtggaaccggtcgcatcggccatctggcaggccagcgtgcgctgccagatcagggtgtacagcttgagctggtcggccggcactttggtggcgatttcagccggatcgcggaaatgcgcgcccgccggtcggatacattcatgggcttcctgcgcgcccgccgtcttcgtggcgtactgcttgggcgcatcggacaagtacttttcgccgaagtgccgcgacaccgcttcacgggcggccgcgatcgcctcctgcgacagcgtcaccgaatcggtacgcatgtacgtgatgaaaccgttttcgtacaggccctgcgcggcacgcatggtctggcgcgagctcatgccgaggcgattgccggccgtctgctgcagcgtggacgtggtgaacggcggcaccggacggcgacggtacggcttggtttccatcgacgagacggtgaacgtcgcatattccagcgatcgcgcgatcgcattcgcgtgcgtttcgtccagctgcacgacgttgtctttgatgccggcggcggtcagctggccatcatcgccgaaatccttggaaccggccaaacgacggccgccaagcgacaccatgcgagaatcgaacgcaacattgttgccgtcggcgtcgggcgcttccagcgtggcggcgacatcccaatagggggcacgcacgaacgccatgcgctcacgctcacgttccacgatcagacgggtggccacggactgcacgcggcccgcggacaggcccggaccgaccttgcgccacagcaccggggacagctcatagccgtacagacggtccagaatacgacgggtttcctgggcgtccaccatggcggcgtccacatcacgcgtgttgttcagcgacgccttgatcgcttccggcgtgatctcgtggaacaccatgcgcttgacgggcaccttcggcttcagcgtctgcacaagatgccatgcgatcgcctcaccttcgcgatcctcatcagtggcgaggtagagggtgtctgccttcttcagcgcgcttttcaggtcggcaacggttttcttcttgttgccgtccacgatgtaatacggcttgaacccgtcttcgatatccacgccgaacttgccgtatttggctttctcggccgccggcacctggctgggctgggcaaggtcgcggatatggccgaccgatgccatgaccgtgtatccggagcccaagtatccgccaatcttcttcgccttggtaggagactccacaataacgagcttgctgccggtagccatagccactccttattactagtgtttgcaacgcaataatactcactgaatacggagaaatggcaaaccgcccgtgtggcgcatggacggcagcatgcccggaaccggctgttttcagcgcttcggcggtgcgggcggcgctcccaccaaacccagtttcgtcaacggcgaggcggtcagctgacgcatggcgagcgttatgccaagcaccagcgcggaaacggcggccgtcagcagcgccgtggaaacgtacgcgccggcattcgtccattcggcgctcatggcgagtcccggctgaatctgccagatgatatacgcgccgtacaggatgcccaatacgccaatcgtcagcatcacactgccgacgatctgcacgcttgccgacgagacgcgcgtgcccggctcatccatgccgttggcgaacgtggtggcaagcgccagcaacgccagtccgccgacgatcagcagcgccataatcacgtcggtcggacgatgccattgcgccgcgatcaccgacaaaccgaccagcaccgtatacgcccagccaatcaccgccaccagcgcacgcagcacgcgcggcacggcgcacagcagcatcacgcttgccgcagcggcaaggatgacatgcccggaaggcgcggaattattaggattcgattccaaattaataagatacgggcgtggcagcagcggcttcaacagttcggccgcggcgaaacacaggcctccgaatacagcgagctgcgcgatcgacagccaccgtttgcgcacgatcagcacggcaaacgcgattgcccccatgatgacgctgacggtgatgaccactgcggaaatggcgaagacgtgcacgaccggcgccagccaacccggcaacgcggtatcgagtttcgaccagacgatatcctcatagctttggccgtccatggtacgcacgccaagccaccagacgccggcggaagcggcaagcatcagcagaccgaacaccacgcacagcacgatgctggacacgcgcggatggcgggtcagcggatccgcctgagccaagcctttgttgacatcctgcggagaaagcaccgcctcgacttcgcgcatatcagggaacgacaacgattccaacggttccgcaggcgttgctgccgtgggctgctgaagcatgttcacaggctgctgtggatctcggacaagtggcttgaattcgttggtcatagtcaccgagaatacggcatcgcccctactgtggggaacgaatcggagaagatatagaaaaacctccacgcacccggaagaggccacttacccttgctgcattcctgccctgggggagttgggtgacataccgccacgcggaggctcttgccatattacaccatgcccggacctcgccgcaccgactagacgcacgggtacacttgagaaggaatcgcacgccacccctgtgcgtttgcgtggctgcgataagcatcgataacgtttggaaggttgttttgttatgactgatgcggtggagtatcccgatctggtggtctaaacccgaaaaaaatacatgactaaacacgaaacaccgacttgacgaaatacagccgcccaaccaccgggattgggcgtccgcggccctgaaggcgatattcgccatggagtcccgcgaatccgccctcgccaaggccgggacggtcgccgcggagatggagtccaggaagctcaaggcggcggccggctgcctgcgcgagggcatcggggagacgaccgcctaccttttgccggaattcccgacggagcaccgcaggaggatccgcacgaacaacatgatcgaacggctgaaccgggagatccggcgtcgcacgcgcgtcgtcggcagtttcccggacggcaacagcgcgttgatgctcatctgcgccagaatcaggtacgtcaccgcgaacgaatggagcacgcgccgctacctcgacatgtcccggctcgatgacaacctgcaggaagcgaactgatcatcgtcccatggacgggcacgaccctaagtgcgcaaaccttcgggcactaccttccgggttactccttcatctgtatatatcgtggaatagagcatatagtcctggccgatccatccgtgtgagatgagtcggttcagcagagaattgtctccacctagtaaagcataaagttcttgattgtgacatggtttcgccgcttcatagtgggtaataaattcccagtctcctgaccgaagtttttcgatcgtcagtgatgtattattcttctcatctataagtttttttctttatcttttcgccagtcggtgtctagtgatttacccatgatctttttaaaagtctttattgtggagctgaaatcaaatgatggattatcatagtaactattgagaaaagtaattcgaatgttgattcgattggtttctttacagcgagaaatgtcgtcccagagtttcggatcgtcggcagcatatgtattttgactgttgcttggaatatttatattaattgattggcatctatctgcttgctgattattcaaatcggcaagcagatagataaggtccgttcgaagctcgctagcgtattcttcagcggctctgccatttgagatttcgttgattttatattttagatttttgtttttgtaatctaatgcggaaatatcttcctgtattatctctcttatttccttatagatgtggtcaagcctgctccggccgttctgtaactttatggcatcatcaaggtaacagttcttgtatataaggattgcgagcatcttgacaggggacagtccaagattggtccttttcgggttaagcagctgctctttataaacaatgaactcattgcgaatattgatccaggtgcgtttatcgggaactgcatctgcaacgagttcaagaaggttaatcatttgggggtcattcgcatcaagaacatcttccaatgtttctagtgcgatttggtatgagttacttgccgatacgaatggcaccactggaatgatgatgtcaaagaactttgcacgggagaaggaatgagccaaagattcttgattggctatttgtgcgtcagctgaaacatattgattactgaatatcgcatcgtgaatagcgtatacgaactgtataggtgtactggactgagaattcttttcttttgcggaatgagagaaatgcaatcgttgactgattttctggattgttgattctgtgtgttgcagctttggatcattattgaggatctgattcagctcgcgtagtgaatcaaagatttgagcatcttgaaaacggtcaagatcttcaaaaaatacagttcgaatgcctgtcttttcaaagatatatatgatctcatcaagatactgatcgaaataagagtccgagttctctcccagggtaatgcctgctgttccgacatctattttggctagatggatgcgggttccgaaataatgaaatagtgcgaactgatagcaggcaaattatgacgatttcagcaagaattttggtaatgcttgttgggattggtagccatgtcaacggtttttgaatatagctgtaaggccattgatagatattaagaatgaacagtaacagcatgccgaaagcaagagaggaaagtatctgctttcctaatccgatttcgttcatcttatggaaatgtgatgccggaatcttttcggggtctgttccatatagaagttgcttaatgatctctttttgaatgagattggttatggatgaattgttggaagactttgggggagcgccggatggttctttcgaagtggacttatccttatccgagacggaatcgtttttcttatcatcctgttccttaagctgtgcagctaaaggcgccagtgagattgtcctagttgtatgagggcgctcttcctcaaggtctttaacgactttctcaagaatgctgcttttcccggaaccgtagacgcctgatagagctatgttgtgtatcttcgtatcctcgccctgcaacgccttttcaagcctcttcacatagggtgagtggctcgattcgtcatattgggggtatagaggcttgagctctggtatttcactttcagctgctgcattgctcttctcggtcatgttgtaccagtgtagctatattaaatgatttactctcttctgccggtagatttgttcggcatccgcatttgttgcattaagctgcgatggggaggtaaggattcgggaagtgataatcgaaagatgtagatgattccaagtatcaatgcacgaaaacatacgtgtatctaacattcatgcgggaaagcagaaggtttcaacccctaatgacatacaatatatgcgaaaacattgggattgagagcatatggggagcacacggcaatgaggcatggcgcacattcggaacgagaactgctttctcccggcatgagagtgctgatccgcggccaggagtggcttgtcgataaagtcgagccgaacagtcttggcaaccatgccgtttcatgcaccggtatctccgctctggtgcgggacatgacggccacgttccttgatgatttggacacaattacgcctgtcgatccggtgaagacccgcttcattcccgacacctcggcaagagctgcgaagtcgcatctgttcatcgagagtctgttacgtgccactgcgccgaccgatgcgaggattcatgtcggcaacaaggctgccatggactccctgccgtaccagctcgttccggcgaagaaggcgctcgcccaacctcgtcagcgaattctcatcgctgacgccgtcggccttggcaagaccttggaagccggaatcctgatggcggagctcatcaaacgtcacaaaggtcgccgtattctcgtggtaacagcgaaaagcatgatggtccagttccagaaggagatgtgggaacggttcaccatcccgctgattagtctggattcctcgcgtatccagcagattcgttccgagattcccgcgaacgccaacccgttctcctactacgacaaggtgatcatctccattgatacgttgaaacgggacatccaatatggcgcggcgcttgatgcctcgtattgggacatcatcgtgattgatgaggcccagaatgtcgccgaccgtgccgtcaacggccgtagcgcgcaacgtgccaagcttgccaagcgacttgccttacgctctgacacgttgattatgctgtccgccacgcctcatgacggccgcgctcgtagtttcgcttcgttgatgaacatgctcgacccaaccactctgcccgatccggagcggtacgacaagaaggatgtcgaacacctgtacgtccgccgtttcaagaaggacgtgatggccgaggtgtcaggcagcttcccggagcgcaaggtgacgcaggagaaatgcatggccaccgcagccgaggaagaggcgttcgattacttgaccaatatgaaactcgtcatggatatgcatcagaagagaagcaattccttcctgttcaagacgatgcttgagaagagtctgttttcatcgccggcagcgtgcatcaagaccatcgacgagcgagtgaagcggcttgccaaaaaagatgcgtccgaccagaccggagacatcgacaggcttgaagggctcaaggccgctttagagaaaatcggtccgatgcagttctcccggtaccagagactgctgcagcttctgcgcagcgccgattacggttggcataacggcgaagacgccgatgaccgtatcgtgattttcacggaacgcatcgagacgaagaactatctcgaggagcacttgcggcaggatctcaaactaccgaagaaggccatcgtctccatggatggcggcatgagcgatgtggaacagcagaaaatcgtcgaggatttcggtacgaagtcctcgcctatacgcattcttgtggcctctgacgtggcctctgaaggtctgaatctgcactatctgagccacagactcatccatttcgacactccatggtcgttgatggtgttccagcagcgtaacggacgcatcgaccgttacgggcagcgcaaacagcctgatattcgtttcatgatgattaactcgcgtaacgcaaagattcaaggtgacacgcatattctcgagatcctgcagcagaaggaagaccaggcacgtaaggatatcggcgatccgtccttgctcatgggcaaattcgacgtcgatcaggaggaagattttacccgcgaagcgattgaatccggcgaatcagcggagaatttcgcagctagactttgtattcctgatgaggacatcgatcattcggacgaacgttccggagacgttgagactgtggcggatgacgatgttttcgatccattgagttttttcaacctcactacgccggatggttccgatactacgagcactgaggaaaacgagtccgcaggggagagcacggctgggagcgccgacgatggcggcatagccgattcctctacgctgatgtcggattacgagtatgtggatgaggggctctcctgcgaggagttccggcagtcggctggtcttaaatcgaaacgtcagttgcgtgatgctcatggattcgcggtggagttccaaggggatagcccgttgcacgcgtggctgcgcagacgtgtgccgaacacgcaggtgttgcgagacaacatcgctgaatggagtgatgacgcgaaatactgcgaagaccaagccaacggtctgctggcccgtatcaacgacgagtcatggagtcgggtccaatacctgtgggaattgaatccaatcacggaatgggtcgggttgaaggcttcctcactgctgtaccaacgtgacgaggccccgattattggcgtgaccaacggaaacctgcatgcggatgagacgattatgctgatgaacggcatggtcgccaacaggcatgcatccccggtgatcgatgaatggttcggtgtacggtatctcgatggcgaatgcatgggcatactgccacttgaggaagtgtggcgtatcaccggatatcgtgggaacttgattccgggaaccactgaacgtcgttatgtgaatcgagaggattccgcggccagctccgaacagatagatgcggcacaactgctgttggaggatgcggtatcgcgcggcaagagcatgctcagcgattgcggtgaacaatatcgtgcgcaggcagatgaagaagtgactcagcaaatggaccgcatcgagcattggtcccatacacgcaaggcactgttgcaatcccaaggcaaaaacaccaaggaaaacacaaaacaggttgatcggatgctcgaacaatatgccgactgggttcaggacacattggacgcttccggtgagccggtgatccgcattgcggccgcattcgtaggtaaggaatagagggggagaccatggcgaaggaactgaacgagacattcccgggcatcgaggcggtcaacgacttctacacgccgtactacatgaaggaatacttcccggatgaagtgaagaatgcctccgcaccttggaaacagcttcctcctgagaaacgcccagcgcgactgctgaaggacatgcgccagtcgttcaccgaagtcatcaacaacaacgagaacgatctgtttccagctgaacgggtacggattttcatcgacggcatgctcgccgcactcggctatacgcaggaggggaatcaagccaaagacgagggattgcccgaccggatttcagggaagtctgttcctgtctactatcaggtcaatgattccgatggggctccgcgcttgcaagttctgatgagcctgtccgataatgcggaggcaggcgttctggaaagccccatcgaagacggctctggcaaggacgacacctcctgtgaggaatatgcacgtatgctgcttgccgatttcgacgagccggcacggtggattcttctcatggggttgcatcagatagcgttgatcgaccgctgtaaatggaatgacaagaaatgcatgctgtttgacctggacgagatcttcagccggcatcaggatcatgtgtatacggcgatggctgtgctgttacgtcgtgatagtctctgcccgaacaaaggtgacagtctgcttgacacgtttgatgacacgtctgcgaagaacgcggttgaggtgtctgacaatctgcgttccgcgttacgtgaatgcgtggagatacttggcaacgaggtcatccacgactggacctgcaacaaggggcggagcatcgacgaaatcgacgcgggcgacctgacagtgcaggcgttgcgatacatgtaccgtctgctgttcctcctgttcattgaagcaaagccgtcgctcggctatgcgccgatgaaatccgacatctaccgtaccggctattcgctggacagcttgcgagatattgcggaacagatgcgtggccgcatggatgaggctggcgattccacctatctagcggacaccttgcgtcgactcgacgatctggtgttcaacggttacccgaagacggatgaggatttcaaggggttggctggcgaggaagccatcaatgcggtgtttatggttccgccgctcaaggcacacattttcgatccggagcggaccgcgctgattgaacatgccgcactccgcgacagcgtgatgctgcgcatcatagacctgatgagcgtcaccaagacgggtaaaggagtcaaacgcaggcagcgcatctcttacgcggcccttggcatcagccagatgggtgccgtgtatgaggcattgctgtcctaccgtggttttatcgccaaagagaggctctatgaggtcaaacgagccaaggattcctacgaccctttgaaagtcggctacttcgtgccggaacgcgaactcgtcaactattcggagagcgaacgcgttcgctacccggacaaaagcccgcatgccggcgagctgcgcacctacgagcccggtacgttcatctaccggcttgcaggccgggaacgtgaaacgtcggcctccttctatacgccggacagtcttgcgcaatgcctggtgaagtatgcgctcaaggagattgagccacgtatccatcaagccaccgatattctgagtctgaagatctgcgagccggctatgggctccgcgaccttcctgaacgagaccatcaaccagctggccaccatgtatctgaaccgcagggagaaggagcgggttgccgaggaaggacagaaggcggccattcccgcggaacgcaggcaagctgaactgcagaaggtcaagatgtacatcgccgaccacaacatctacggcatcgacctgaaccccgttgcagtggaattgggggaagtgtccctatggctcaacaccatttgcgaaggatccttcgtgccatggttcggaacccagctgcaatgcggcaattcgctgattggcggccgccgcgttggatacttggagtcggacttgtccagcaaaaccaagaaccgccactggtatgaggtcgagcccaagcatatcgggttcaaccagagttcgtcatctatcaagcgcatctaccagttcctgaccggagatccggacatgtgcaagtatgacgacaagaccatcaaaagcatagaatccgaacatctggaaaccatcaaggcctggaagaagagattcgccaagaagccctattcccaaacggagattggcctgatgagggcgttgtcaaagaccgtcgacgaactatggcgcggccagatcaaggcacgtcggcaattggaaaaggcgactcaagacgatctgattatctacgggtttgacgcgaacgcctccaagaagactgcgaaggctttggaaaaccagcagaaatatgggcagggctcgcttggcttcgaaagcgaatacttccgtggcaacaacctcaccatccgtgaaaaggatgagatgctccgcattgcctaccattcggaaaaggccgagaacgccagcgaatacgctcgcttgaaacttgccatggactactggtgctcgctgtggttctggcccatcgaccaagcggacctgcttcccacaagatcgcagtacctcacagaaatgtcgctgattcttaccggcgaggttccacaggaagagggattcacgctgatgtcgatggataacgatcagcccacgcttatggacaccatggatgatagtcatgaacgcgactacatgtatgaccataccgtggatctcgacgagctttgcagaggtgacggggaacctgcgcaaaggcttcgcttggtgaaggaagtcgccaagaagcagcggttcttccactgggagctcgaattcgccgacgtgttcaaagacggcggcttcgacttcatggttggtaatccgccgtgggtgaacgtgcagtggagtgagacggatgccgtttccgatgcgaatccttattttgcgattcataagcttacggcttccgatttgagtaagcgtatgggtgaacttctaaagaactcacgtatacgaactatgtatcttcgggagtatgtgaatattgccggtgctttggcattctatggttcagcggggaattacccgctactacagggacgaaccaatttgttccgctgtttcctgccgaatgcttggagctatacgcgtgcgcagaatggcgtaagcgcatttgtccatccagatgaggtttatgcggacacgaaggctccacttcttagaagagaaatgtatcgtaggatatgtagccatttccattttcagaatagacttaatttgtttgcgggcgtggatagcaatgcacagttcagtctcaatatctatagaaataaaattaattcaagcatttcatttgattcgatttggaatttgtatgcgccgtccactatcgatgaatgctatgcatctgatggtagtggggacgtaccgggaactaaagatgataattggaattgggaggtaaaaggccacaagaatcgtattatccacattgaggaatccgagcttaaaacttttgcattgttgctaagtgaacaggggacaagttcgtggagaaacaccccgcttgttgctgtgcatgcgcaagagctttttgatgcaatttgtaaaatggcaagtgtatctcgttgcttacgtgattatggggaagacataacttattcgagcatgtggaatgaaactaacgcacgtaaagacggtacgatatgtgacgaagttcattttcccagtgtcgatgaaaaaataatttattccagtccattccttggcgtcgccaaccccattatgcaaggtgcaaaaagaaattggaagacgaggaatgactatgatttgcttgatttgatggaggtaaatgattcgtttgagccgagaacgaaatacagacaagcttgtaccgattttgagtaccagcagagactcccgaaaatgtctgacggaagcaatttcgatgctgtttatcgcctcgcatgccgtcgtatggttaatttagttagtgaaaggacgctgcaagcgtcctgtgttcacccaggcgcagcctgggtgaacaccataacaggttatggtgtgcacccagagcgctacgcgttgctcgcgctcatgagcggccttgaagccgccctgccgtacgattttctcgtacgctctatcggcaaaatggatattcatagctcaacgctgcagcttttcccagttccggaaagcgtcctcgctcccgaaatccgtctccgaggtctactgctcaactgtctgaccaagccgtatgcggatttgtggcaatcctgttgggacgagtcatacacgtctatgagctgggcgaagaatgatcctcgacttaccaccgatacgttcacctcattgacaggcgaatgggaatggcatacgccattacgcacggactatgaacgccggcaggcattggtggaactggacgtgctggcatccatggcgctcggtattaccctgaacgagctcatcgacatctaccgcctgaccttcaccgtgctgagtggctacgaggatgacacttggtacgacgcgaatggtcgtatcgtgttctccaagaagaactatggtgatctgactttcaaacgtcctgatttcgagaagatcaagaatgcgcctgcgggcaaagtgttcacccgcaccatcatggacgacacccagccgggtgggccacgtgagcgaaccatcgaatacgtggcgccgttcgacaaatgcgatcgcgtagaggattacaaaaccgcgtggaagttcttcacgcagaagtacggagatgccaaatgattcccatggtgcttgcacggcatatccagtctggactcgccgattacgtggagactacgttccccatgaccaatatgccgttccgcggctccatccgcaaactcgcccatcaggagggcatgctttcccaggagccgttcgtatcggtcaaactgccgtttcgtgtggtcggcaaacatgcggaattcccgttcccatgcctgcaccccacgtaccggccatatgcgcaccagatgcgcgcattcgaacgcatctccgccggtgaatccacactggtggccaccggcaccggctcaggcaagaccgaatgcttcctgtacccaatcctcgactactgttatcggcagcgcaggctcggactcaagggcatcaaagccatcctcgtctatccgatgaacgccctcgccaccgaccaggcgaagcgactggcagaactcatccacaacagtccggaactgcgcaacaacgtgaccgcgggcatgtatgtgggccagatgagccaaggcggcagcgacaaggacaaccacgccatgaccgccaccaacatcgtgaccagccacgatgagctgctcaaaaacccgccggacatcctgctcaccaactacaagatgctcgactacctgctggtgcgccccaaagattcccggatttgggacagcaacgatccggacacgctcaaatacttcgtcgtggacgaattgcatactttcgacggcgcgcagggcaccgacttggcctgcctgctgcgcaggctcaccgacaggctgaacaccaccagcgacgatatgtgcttcgttggcacgtcggccaccatgggcaccgaagagacagtacgtgacgtctgtgagtatgccagccaaatcttcaacaccacgttcacgccggaatccgtggtgactgaggatcgtcttcgcgttgacgaattcttcgtcaccagcgactataacgacaccatgcctactgccgcgcaggccgatcggctcatcgaactcgaagaggacgtcgaccccggtaaataccttgcctatgcggcccaagcgtggcttgacgacgcccccacagagccggtctccgcggacaaggcacgcatccggctcgccgaatccctgcgtcattcaaggttcctggccagcctgtcctcgcttatctgcgacgaacctcagcgaatcgatcgcaaactgctggacaggctcgccatcatggatgcaaggttcaacgccttgcacccacgccagcagaaggcctgtgtagacgcgctgatagcgctcgtctcccgcgctcgcaacggttcggaggggcacacacgtccgttcctgaatgtacaggtgcaactatgggtcaaggaacttggccgcgtggttgccaacatcaccccgcaggaagggagcatcgactaccgtccggtcgtcgaactgtccaaagacgacctcaagacccgcatgccggtgattaactgccgtgattgcggagggaccgcatggattgggcttgccggcaaagacggcggtatcagcatgggtgacccacgaacgttctacaacgagtatttcgcctaccatgccgacaatgcgttggcgactttgcaaccctgcaccatggattatgttcttgacccgcatgccgacaacggagccatggtctggttctgcaatgcatgcatgaaggaacaggccgtagaacatttcgaatccacggaacgtgaatgcccggcctgtggagagcagcgcatacccatggtcgctaggggcatggagcttgtatccggcaaccgcaaacactatcagtgtccgttctgcggcagcgaacaggacattgccatggtcggtgtgagaaccaccacgcaggtcagtgtgatgctcacccaactttccggagactccttcaacgacgatagcaaggccatcgtgttctccgacagtgtgcaggacgcctcctaccgagccagcgtgttcaactcccgcacctggcgattcgccctgcgcaactccgccatggactacatgcgcgaggaacacaaggacggcgtttccctcgccgaatatctcaacagccagaacgactactaccatcgccgctatccggacgacaacgaatacatcgtgcgattcatcgcgccgaacatgacatggatgcgcgaatacgaagccgtattgcaaggcaatcccgcagggcccggccggcgtcagctgctcgattggatcgagcgcagactccgactggaatcgctgctggaattcggcatgcgctcccgtaccggacgtacgttggagaaatccggctgcgccgcaatagcattcgaccagattctcctgaaacgtgtggcacagaccgttgccgaacgttgccataacgagatcggattgcacgagaattccatcatggagactgactggctccgactgattatggcgttcctcgaccagctgcgcacgaaaggcgcgtttttcgacgtgacctatgaccagttcctgcaaaacgacggcaacaagttcctgctttccaacacgaacatcaaatggatgcccggcatgtacgcggatggtatgccctatttcctgtcggacaaggagccagtgcgcaaaggcgttttcaataccctgaattcgccggcataccgtcagatcgtcgaccggtacctcaccgacggcgcccttgaaggcgacatccaccacgagctgttgggaatcgtgctcgaagagtgcatagcagcaggattcatcacgcagcaacgttatccaagcatgaaaatggaacgcaccgtgtacgggctcaacgagtccggctgcatggtcagtggcaaggtaacgcagttgatctgcgacacgtgtggacggagctattcgtgcgctacgcagaaccttgacgcgtggaacggagcacgttgccgtatccgcaaatgcccgggcagactggtctccggcactcccgaagccgaagccctggaattgcgctactatggcaagctgtactgcggggagccagccgatcgcatccacgctgccgaacacacggggctgctcaatggcgatgaccgtgccaaggtcgaagaggaattcaagcgcaagaaccgcaagcccggcgacgtgaacgtgctcgcctgtacgccgaccctggagatgggcatcgatatcggagacctctccacagtgattctctcgtcaattccgcctacccaagcccagtacatccaacgtgccggtcgtgcagggcgacgtgacggcaactccttggtgctggcggtggccaataccaaggaacacgacacgtacttctaccagcgtccgaaagatatgcttggaggcgcggtgaacccgccgcacatcttcctcgacgcgaccgcagtgttggagcgtcagctcaccgcctacgcattggatcgttgggtgcatgccatgctggatgccggcagcgaaccggccgatgtggtacccgacaaattgaaaaactgtttggataatgtcaacggcagcggctccagcgggttcccggtgaatttcctgaactggacaggccaacattccggcgaactgctcgacggattcggaagaatgttctcattctccgaggaactccgaacgcagctcgacggattcgtacgcggtacggaagatggcagcaccatggccagacgcgtctacgatgtgttccaaaaaaccaacgataccgtcagaacgctggaatcgcagaagagcgctgcgaggcagctgctcgacgagctcaagaagaagccctccgactcatcgttcgaagagcagcagcgcgaatgcgaagatgagattcacaatcttggccgcatcgtcacaagcattctcaacaccaacacgttcaactacctttccgacgaaggcatcctgcccaattatgcgttcccggaaaccggtgtgaccctccacaccatcctcaaagaggacaaggaaccgtccgatgcggcacacggaatcgagcctgccgcgcaggacaagacgaaacgcagggggaaggccacgcgtgatttcgtgcgcccggcggccacggccatcacggaactggcgccgggaaacacgttcttcgcgggcggacgcaaatacaaaatcagccgcgtgctatgttcgaaaggcggtgccgacgacgaactggcaatgtggcgcctatgcccgaactgttcgcacgcggaacccgcctccagcaccgagaacctcgccagctgtccctcctgtgggtcaatgcagtgggccgataacggccagaaaaggccgatgctgcgcatcgacaccgtcatatccgatgagacctacagcgaaagcctgattgaggacacctccgacagcagacccaagactcagttcctgaagaatacgatggtggacatcgatccggcggacatccaatcgggatggcagttcaagggaatcacgaacttcggattcgattacacgccgcagggtacagtccgtgaaatcaacttcggacaggtttctgataggggagcctcggtggaaatcgccggtagcaaggagatacgtaacggtttcaacgtgtgcctgaaatgcggcgcgttgctcggcgagcgcgaatcacggcacgcctacttctgtccggaacgcaagaaggcgcaggaacagcagttggagcaatcggagcggaacggcacgtgcctgttcctataccgtgaggtcaaatcggaagtgctacgtatgctcgtgccagggcttgccgatgcccaaggtgcggacggtgctgcggagtcgttgaccgccgcagtgatgcttgggctgcgtgaacgcttcggcaacgtggaacatctacaggcgacactcatgaacgagccgttgccggataactccggactgcgcaaaacctatcttgctctatatgacacagtgcccggaggaactggctatcttaagcagctgtccgatccggatacgatgttcgaggtgttttccagggcaaaggaagtcatggagcattgcgaatgtgcaaagaacggcggcgacgggtgctacagatgcctgtatgcatacagacaaagccaggacctgaaacttatttcccgtaagaccgcgctggcgatgctcacgggcatcctcgacccggccaacaaacgcagtcgtgtgacaaccgtttcgaagatcaacacgaacaaactgttcgacagtggactcgaacagcagttcatcgaagctctccggtgcatgcatgcccatcccttcgcggaatccgacgatgccaagggacgtcgtgccatcgtcaaggacgaattcatcaatagcaaacctggatattccatcaccgtgaacggaagcgtgtggagcgtcgagccacaagtcgcgttggggccggccgatggggtcgcgattccctgcaagcctgatttcgtgctgacggtcagcaatatcgatgaatctggtgacgtggttgagcatgacggaaggaagccggttgccatcttcaccgatggcctgcaataccatgcaggcatcgtcgcccaggattccctgaagagggaagcgcttcgtcaggcaggctatcgcatatggtccttggattatgacgatgtgatcggatatgtgcagggcaaggatgtggcgcagctcgccgatccgatgctggcacccaagtccatgccgtctccggtggcttacaagagcacgatttgcaagaggactgacgaattcaaccccagcgaagtttcggcaatggccatgctggaatattatctcgcggaaccggatgccgaacggatattcgccatccaagcgctggcaatgagctatgctctgaatccgcgaaacaagaacgttgaacctcaggccgtggatatgctgcatcggaatgaagcgttgcacggcgagaacgaatcgacattcatgatttgctcgtcctggaatccttcgaactgcacgagactgaaattccaatccggtttgtgcattggagaggatatgcggaccaccgaaccccacgtcggcatggtgttctcggacattcaacgtgatgccgcgaaagcaaagaacgatgattataatccgttggatgctttggacgagaacgaggcagaggcgttcaaaacgcagtgggcagccttctggcattttgcgaacgtgatgcaattctcggaatacttccatgctatcggtgatgctgcgctacgtgacgaatccatgtacgagccgcttcgcaacggcctgcggaacgctcctgatctgcagaaagacaatgattccgaatggaacgatattctggcggatccgacctacgtgtattgcgcggatgaaaccaaggaggtcgtcaaacggtttattgagtctgacataccggcaccggatgcactcggatatgagctgctggacgagaacgaggaaatcattgcgcagtcagagctcgcatgggaggatgggaagatcgtgtttttcccgtcctacgacttgcaatccgaccgagagaacgccgacgaattcgtcaagcgcggctggactatcattacggaaaacaacgatgaccttgacaaggtgttcgcttcattgacggaaggcatggaacgctgatggcagatatacgtacgatgaacaaacccgtggtcgcactcggcagcgatctcatgcgcagcctgctcgagctgcctaagaaagcgcagaaacatgccacgacgtttctgacaaaattccaggcgaatcctcgatcatccggaatcaatctggaacgaatcgccaatgcggcggacgaaaaactgtattccgcgcgcatcgaccagcgatatcgcgccatcatcgctttccagaaaagcagcaacgtgtacgttttgctgtacgttggagaccacgatgacgcttacaaatgggcggaaacaaagcgaatcagcgtcaacccgaatacgagggccatccagctgtacgatatggctcctcaagaggaaatcgacgcagcgatgcatgaggattcccaaaacaaagttggatgggggagcgttgccgcaaacgcgccccaatcagattccgctgcgtcggaatctgttccccagcccacggaagaccatgccggcacgaatcacggaatagcttcagctattgcaacttcagctgtgacggacaagacgccgcagatgccacagcaagctcccgaacctcataccggtccgcttccagacacttatcgggcattgacagataatgacatgcgccggttcggcgtacctgacatgtatgtgccagtcatgtgcacgagaaagacgtgggaagcgtttgaacggtggggggccaggctcccaaaggatgctttcatgtaccttaccttcgttgctgaaggacttcccaagtccgaggtcttcggactgctcgatgaaaccgaaggcaagaccagcgacaggctggggctggagcagcagatgtctgcctcgtccatcgaatctggtgaagaggccgatccggaggacttccgtgccgccctgtcaagctatgcatcgcagcagtctttcgtggtcgtgcagggagaagcggatctcaaacgtattctggatgcgccgctggaacagtggcgtgtgttcctgcatccatcgcagcgtctttatgtggaacatgattaccatggtccgttccgcctgctcggcggtgccggtacgggaaagaccgtggtggccatgcatcgcgcgaaacgtctcgctgcaagactgctgagaagcggtagccgtcagaaagtgctgttcaccacatactcgcgtaatcttgccaccgatattgcatcgaacctgaaactcatctgcacgccagacgaattcaataccatcgacgtggtcaatctcgacaagctcgtaaaagatctgctgacggggcatggctattccggtgagatttggtatgacggtatctccgactatggcaacgatcttgacaccgcgtggcgtaaggctatcgcgtccatcggcgtgaacgatccgaaactcacggtttctttcttcaaaagtgagctcagccaagtgattgtgccgcagcaggtacggaatgctgccgattacatgcgcgtgctacgcaaggggcgtggcacgagactgaaccgagcccagaagcttgtcgtatggaaagttgtggaaacgtatcggcgcatcatgcaggcgaacgacgcatatgatgtggacacagccatgcagaacgtcgtgtcgttgcttacgcagggtgatgcgccgaggaaatatgcgcatgtggtggtcgatgaagggcaggatttctctgtgccggcataccgtgtgattcgtgctctggtggatgagggagacaacgatatctttatcgtcggcgacgcacagcagcgcatctacggtcatactgcggtgctgtcgaaatgcggcatccgtatccagggacgtgcccgcaaactgcggatcaattatcgcaccaccgaacagattcgtagcgccgccgactccattttccgtagttccggcgccgatgtcgcggattcggtgtttgcggctgttcgcggcatcggagatgcttcgccggccacaacgttcgatgacctggacggaggggagagcccgaccggcgacagccggtcgctgatgagcggtcccgttcctgaaacgcggcgattcgcctctcaagcggatgaaatggatgccgtcagggaatggatttatgaattatgtggtccggcggaagatacggtcggcgacgagtccgatggcgagcgtgtcgatccgcgtaacgtatgcgtggcggcgagaagccgctactgcatcgaccagtggtctaagacgcttgatgacggcttgccgtatggcgtgtaccagcttggtagggatgcagaaaacaggcaaaggcaaggaattcgcgtcgccaccatgcatcgagtcaaaggactggaattcgactatgtggtggtagtcgacgtgaacgatggtgtatgcccgccgaagcccgcgctgcaatctgccggtgccgatccggctgcgttgaacgaaatctacagggaggaacgaagcctcatttacgtagccatgacacgtgcaaaaaagggtgtgctgctaactggcgtctcggcgcatgtgaggtaagggaagaggagcaccatggacgctggcaagaaaatcctgctggatttatttaccggttcgcttcggttcgtggttccggtgtatcagcgcagatactcatggggcgaagcacagtgccagcaattgtgggccgacatcgtaacggctggcaggcatcctgagagaacccatttcaccgggtcgatcgtatggatgcaggaaggtggcatcggtccagatggtgtcagccgatgccagctcatcgacggccagcagcgccttacctccgtgacccttttgcttatcgcactggccgaatacgctcgcgaacaccctgagagcctacgattctccgcagacatgctcatcgaccgtggctatcttgtcgataagtacgcaactggtgaaggacgctacaagctgacgctttccggtgatgatagggaagtgctgcacagcatgtgcgaccatgtggtcgctcccgatcgcccgagccatgccgatacgggttcccggttggaagcgaaccttgatttattccgttcgctggtcgcggccatcgacgatgcgaacgtggtatggaacggtctgcagcgccttgaagtcgtgtccgtcactctggaccaagggcgtgacgaacctcagttggtattcgaatcgatgaattccaccgggcttgatcttgagacttccgacctggttcgcaactacatgctcatgggatgccccatggtcgagcagaacaccttgtatgccgattactggctgcctatggagcgtactctcggcaatctctcattcgatgcgttcctgcatgattggatggtcgtcacgctgaagaagcccgtgcccaaaggccgtgccatgtatacggaattcaaacgtttcgcagccgacagctccttgtctcgtatggagcgcgcgcacggccttctcgagaacatgctggaatatgccgggtattacgccgttatcaaaggcgttgcggccgccggcagcggtgacatgagtgtggatcgtcggctcgaatcgatccaaaatctggacagcacggttacggattcattggttatgtacatgttcgcagcatggaagagccatcgcacaaaccgcgacggattgctgcgcatgctcgcggatctggaatcgtatctgttccgcagaatggtctgctcggtatccagcaacggattgaacaaactcgtcccatctctgattgccaaactcgaatcagacgaacatgatttggccgaaaccttcgccgcactgctgctcaccgaaaccgccaaagccacacgcatgcccacagacgaacaattcaggcaggcgctgctcggcgaggatctgtaccgcccggctccgcgctgcaaacatctgctcgccggattggagaaccacaaccatcccaaggatccgcgatccttcaacgaatacaccatcgaacacatcatgccgcagaacgctatgacgcatgccgaatggcgcaatatgctcgccgaccccgaccgattcccactgctggtgaacagtctgggaaatctgacattgaccgcatacaactcggaactttccgacggaacgttcgagcagaagaaaaaccgcatgattggcggatatgacggcgaatacctgtccatctccgcggaactgcacgatgcttcgcaatgggatgagctggcgatcgcgcggcgcggcgcgcggcttgccgatcttgcattgcaggtgtgggcacgccccacagcgggggaagaggttatgcagactctgcgcaatcggaatgcgaaccagggggaacgcgaacagaatgccgttgatttcgctgatctatgcaaacggggcattcttgcagctggagccgcgctggaaagccggtatgccggcataaccgccacggcgaccgtaaccgaagaccaccgcatccgcctgtccaacggcgaaatattcggcagcccatccggcgcattccgccgcgccagaatgctcgaaaccggcgaggacaagcagatcaacggttggacagtgtggaaagtcgcggacggcagaaccctggacgaactgcggcaagtcagcggtaatatctcgttgcggcgcagcttctggaatggcctgtacgaatatgccgcaacacgagccgactttgttgctgtatacggctacccatccggtcgcaagacgaacagcgatacatggaccagcttcggagtgggatcgggtttctgccacccggatggggcgttgaatattcgaggcggctatattacggtcgacctgtatttcaccgacacgttccagtacgcgaaactctacgccatgagggattccgttgaacgaatactgtctgatcttggcgcggtgagctgggacgagccggacgcggacaagaagaaccgccaccttttggtgcagcatgatgtggatttctccggcgacatgacggacgcctaccaatggatgacagacggactgctcgccatgcgcagcgtatacgatctgctggtctgattacttgatctgcaacgtgttcagcactgtatagaatgagcataaccgttcgaaacgagaccgccatgaaatacggaatgagaaaacccagctggaagaagagcctgtccgcgcgtacgaaaggccgtgccacccgtgcggtcaagcgggcgctgatccccggctatggcaagaagggcatggggtggttgcatcccaagcgcaagctgtacaacaccatctacaagaagaccacgttcagcctgttcgacctgttcaagtagtcggtaatcgggtaatcgctagaacagatcatcatgtgacccggtccgtgtgagcacgagttgcagctcctgcttctccacacggtaaatgacgagccagtcaccctcgatgtggatttcgcggtatcccctccagcttccggtcagctgatggtcgcggtattttgtgctgagcaactgtttgtcttgggccatgagcgtgtcgatggcctgtctaagcttatcgggattgtaatgctttttaagcagagccttgaaatcctttttgaattgcgttgtacgaaagaccgatttaagcatccagcagatccttcatcaacgcatccgtgctggtgaaggattctccgtcatgggtttccgtctggcggcgtgcctcaatgctggacggattgtccctggtgatcttgaaaggcatgccgttttcacggattgactggcgcagaaagatgttgatcgccgtcgacagatccatgcccatgtcggcatacagttcccttgcctctcgtttgatcgctggatcagtgcggaaactaatcgtcgcagtgtcgctcatggttgctcctaatcatatgcaggtaacagctacaagcaattgtagtgcgaatgtcatgctgttgtctatacactagatcatgccatacgggagcacattccgtatagcggaatcttctacgttcgtaatatcgcatttatacttcgggaaagggtgatcaacgttttggaatccatgctggcaagcgttgcggtcattcctgcaacgtgaattggaagggaccgtccgccacggaaccgacgcgcatgcgggcgccgaaccggccctcacacacggggacatcgcccgactgcaacgcttcattgaaacgaatccatatcagattcgcatgctcatcatcggcatcatgagataccagctgcggcctgccgaccgcgggacgccgcagtatggtgagtggctgtggaatcgacagaatctcgccgtgcatctcctgaacagacagcgacagtctgccctgcggaccatcgaaacagcgtaacgtgagcacacgatgcgccatccgtgcaagcgttccctcatcatcatcgggctccacttcgacggtcaacaccaatccgggcccgatctgcaccatgtcgaatgtcggatccggtgtgcccaactcgttcaatacgatggcgctcgcttcggtcacgcgttgcagggaaactttcataacgaccaagtgtacggcagcggatcggacggccattgcacggaaaaaacggctggacgccggtagattggggtgttatctaccggcgtccagccgtttttccacgagtcggatggcgtcagctctttgcgtcgaacttctgcgcttccggcacggaacccagcgattcctcgttgttgttccactcggtggaccagccgtccacgaacgcgctctgcaccttgtcccacttgccggtgccctgtgcgtattcgaccagcgcggaggcgatgtcgtcttgccactgctgatccggaatggtgaagctgcgcacttcggtcttgccgtcattgctgtaggctcgggcggcctcggtcagaggattgtccggctggtagtcatcggtgaacgtggtgaatggcacggagaatcccatgtccttggacaggatcttcttggcttcgttgtcggtgatcatccacttgatgaagtcgagcgtggccttcttgtccttttcggaggcgttcttgttcaccgcccagctcgcgtcatacactcctacggggccgcaatcctcctcgcccttgatgcccatgtagtaggggagcatgcccaggtcctcatcggccacgtcattgcccttgatctgcgaatacgcccacacgccgttcgggtagaacgccacctggccgagcgcgaattcggaggtcacgtcatcgtaggtcttggagctcaccatgcttgcctcggttgggctggtcttgagctgcaggtcgaacatgtccttgtagttcttgagatacgtgcccttgatggtcttcgagaacgtggtgttcgcgtcccgatactcgtagtagagcggcagacgcgtcatatgcgcagcgaatcggtacgtgtcggaggcatccaagcccggggtggcgaacgcgccgtcgacgccgaggtcgtccttgtgctgctcgatggattccgccacctgcttcaaggtcttgtagtccttgatgtcatcggcggacttgatcaccgcataacttttggcgcaatagtccttgatgatcttcttgttgtagatgatgccgtaccattcggcggcgtacggcagggtgtacgaattgccgtcgatggtgtacgagtaagccttgccggtatcgttgagcagtttgaacacgtcggtgtcctgcagcggttcgacgtacttctggtacttggcgaactggtcgaagccggcgacgttgaacatggttggtgcgttgtccttggccaattcggatttcatggtggcgtcatacgtgccggcggctccggtctggatgtccacctgcacgccggtcttcttggtgtacatgctggccatttccttgtactggtccacgacctcggccttgttgttcatgaaatacacgtggcccttgctggaatcggcgctgctgccgccgcaggccgccagcgatgttcccatggcgagcgtcgccgcgatggcgacgattcgtgtgatgttgcggttcatgatgtgctcctttgcttggttgttgaatgcgaattgcggttgatggggtccggtcagccgagcgcgatccacgcggtggtgtcctgcggcagacgtccgtcgtcggtgaggggtccggagacgagcaggatatcgcctgccggcagttcggccggttccgcaccgaagttggtgacgctggcccagccgttggccctacggaaagcgatggtgccgccggtgtgcccctcggcgccgtccggcttgccggaggaccggtcgcagtcgagccaggtcagggtcgtgtcggccgtcatccattcgtgacgcagtccgagcgccttgcggtataggttgagcatggagccggagtccgtgtcctccctgtctacggcgtagtcgacgaaccattgcggttgcggaagatgcggcttctcgcacggatcgcccgcctggctcgcgtccacgccggcgccttcatgcttggtggcgggggagaagccgaaggtcggcgtcccggccttccaaggcagcgggacgcggcagccgtcgcggcccttttcgatctggtctcggacgcggttgaacgcggtcggatcctccaactcgtcccacgggatgtcggcgacctctggcaggccgagctcctcaccctggtagatataagcggaacctggtagcgcgagctccatcaggatggccgcacgcgcacgcttcgtgccgagctcgcgatcctcatggtaagaggtaccgttgcgcagcagccaatccttggcaagttggtggtgggctgcagccggcacctgcggcagcccatagcggctgacgtggcgggggatgtcgtggttgctcattacccatgtggaggtggagccggagcgttccgcagcggcgatgccttcttcgatggcgaggtgcatgtcgttgcgaatccagtctttcttggcgaattcgaagttgaacacttggccgagttcttcgggcgaagcataccggtattgatgctccggaggtacccaggcttcggcgacggcgaatgccggcggatcatactcgttgaacaccttgcgccattcgcgatagatgtcgtgcacttcgttcctgtcatacagcggatgcgtgccgtcggcgcaatgcatctcgcctccgatgattttgaaatcatcgagatcgtcacggtcgagatccttagtcaggccgtgcgccacatccacgcggaagccgtccgctccatggtcgagccagaagtgcaaggtcttgatgaaatcggcgcgcacgtccggattcttccaattccaatcgggctgttcgacggtaaacatgtgcagataccattgtccgtcgggcactcgagtccaagcggatccaccgaagctggcaatccagttggtgggtggctcgtcgccgttcggtcctttgccgtcacggaaaatataacggtctcgttccggtgagccggggcctgcggcaagcgcggccttgaaccattcatgctggttggacgagtggttcggtacgatgtcgacgactattttgatgcctgccgcatgtgcggttttggtgagatggtcgaagtcgtccatggtgccgagtttcgggtcgacgttgcggtagtcgtccacatcgtatccgccgtctgccagttgagacggatagaacgggctgagccagatggcgtccacgccgagtctttttagatatgggatttgttgtgcgactcctgcgatgtctccgaggcccgacccggttgtgtctttgaacgaacgcgggtagacctgatagacgaccgcctgcttccaccagagtgatggatcgtcagcgatgtgccgctcgttggcttcgttgctcattgggttgtcttccttcattggatgcattgtgattttgttatggctttttatggaagcgttttcactagttcattctggtgagaacgctctgttttgacgattggaatcacttcgttctcgtcttcgtattgcttaaaatgatagcgctttcattctgtgaatgcaataattgttttgttatggcgtgtctgcttgtgaaatcaacgattctgctaatatgaaagcgctggataaacaatgggaaactggagtggatatggcacgagccaccatcgccgaagtagcggaactggcgggagtatctcaggcgacggtttcgcgggcattgcgaggtgctggcaaggtcgctccgaaaacgcgtgccaaagttgaggcagctgcggaccggttgggctttaccttatctaaaagcgcatcgtctttggcgtccgggaaaaccatgcgggttgtcctgctgttttccggcaaactcaacgaatggttcaacgccaacgtgttgcagggcgtgtgcgaagtgttggaaccggaaggctacgacgtgtcgcccacatttgtcacaggcagacaggagacggagcgttacttcgcacaattgcctaaaaatcgcaatgctgacgcgatcatcatttcgtcgttccaactcgacgaatccgcacgtgagaaactgcgtgtcaccgatatgccgacggtcggtgtgaacattccagccgaatcgttttgcgacgcagccatcggtgttgacaactacgatggcatgtccaaggcggtgcgtctgctcaaatcgcttggacaccagcgcatcgctttcgtcgttgattacattcccgacgacatggtctacagcaccagccagcgtatggaagcgttcttggaagcggctgaacaaaacggttacgacgatgagtatgcctacgtcataaccgcggacgagcatgatgcgccattgtcgaaagcggaccttgctgcgcaactggtggcgaaattactgtcattgccacacatgccaaccgccatctgtgccgaaaccgatcaagtggcaatcgcagtcatcaaggaactcggcaagcaacaattgcatgttcctgaagatatctccgtcatagggttcgatgatgccgacatcgcacaggcgacgaatctgaccaccgttcgacagaatccgctggaaatgggacgcaacgccgcccgtaagacgttgtcccttctgcgtggacagacgccagacgcatcctatgaatcgcaggaggccacgctgatgttgcgtgacaccaccagacgcgtggcgaccgaccgttcgtgacggttcttccgtattctccgaacggaatgaacgcaatatggaaggatatgggcccatgtagcctatgcgccctatgatgcgttgaaggaaaccggtcttcggaaaaccgagacggtggtcgaaccatacgaagacatcgaaagacattcggcagggcatgggcaaaatcaacgaaaacagcgcaaagtcaacgaaaacgaagaatgtgacgcccgcggtcacgccatggggcaagaaccgtgtgaagaacaccgaaacaggcaagcacgtactcatcatgccgggcatcggctacaccgtggacaggccgctgctgtactggtcggcgcaggcgctcgcggccaacggctggttcgtggaccgtctcgacctgaaactgacggaaagcgtcgagtttccggaaatgatcgcctgcatggaacgcgtggtcgacgaatggcgcaaggcggcgctcgaacatgctgccgaatcgggtgaggagctgcagttgctggtcgtcaccaaatcgctctccacactctcatatccgcattccgcaaagctaggattgcgcgtggtgctgctcaccccggtactcaatccgccgccattcgacaagcacaagtcggtcattcccgcgccgctgccgggtgcggtcggcagtccgatgccgttgatctgcgccggcgacgccgacccgtatttcgatgatgccaaggcgcatctgctcaccgaccatgtgcgcacgtacgctggtgccgaccattccatcgaagtgccggacgattggcagacgtcgctcgactacctgaaacaggtcacgcaagccatcgtcgactacgccggctgaaaagaacgggacggaatatgcgcatcgtattgcagaaggtcagcgaaggaaccgtcgacgtggtcgacgaggtgagtggggaagtcgatgccacgttcgaaccgcagcgtatcggcgtcggctatgtgctgcttgtcggagtggaagacacggacggagcgaaacaaatcgactggctcgcccgcaaaatcgccaacctgcgcgtcttcgaagacgagaacggcaaaatgaaccgttccatccacgacgcggacggcagcgtgctgtccatctcccaattcacgctatacgcggacgtgcgcaaaggcaaccggccaagcttcgtgaaagcaggcgcgcccgcgcacgccgaacagatatggaacggattcaacgacgccctgcgcgcgcaaggactcgaagtaaaagaaggacgattcggctcccacatgcgcgtgcggctcgccaacgacggtccggtcaccatcatccttgacaccgacgaactcggcgtctgacccaaaacccaacgtgaaaccctatatccgacgattgccatagggtaaaacgcatgggaatatggaacgaccgcaaactgatcgtcaactgcctgccgttgaccgaatccgaacgtgcgcaattcatacgtgccgcgaaagacataccacaggaattcgtcggcgattcgacccaacggggaagcatgagctggaccgccgcagtaccggaggaactcaaagccaaagccaccgcggtcatcggcaacatcgcgcccgaggaatgcgcgcaatgccccaaactcgaatggcttcaaacttggagtgccggcgtcgacaaataccagcaccccggcatcctacagcccggatccatgctcaccaacgccaccggagcctacggacaaagcgtctccgaacacatgttcgccatgatgtgggccatcatgaagaacctgcacatctacgcggcaagcaacccgaacgccatgtggcaggacgcgggccgcgccatcagccccaacggaaaaacggcgctcatcatcggaaccggcgacatcggatcacacttcgcacgactctgcaaaaacgtcggaatgacaaccatcggcattcgccgtaatctcgccgtcgaagcgccgggcatcgatcatatggtcggtttcgattccctcgacgacgtcctgcaatacgccgatgtgatcgccatgtgcgtaccatccaccccgacaacgcgccacctgctcgatgcgaaacgcatcagcaaactccaaaacgacgccatcatcatcaacgcgggccgcggcgacgccatcaacagtcaggcgctcgccgaagcgctcgcggacggcgcaatccgaggcgcgggcatcgacgtgaccgaaccggaaccgctgccggaggaatcgccattgtggagcgagccgcgttgcctggtcacgccacacgtggcgggcggcaaccatttggagtccaccgagcgccgcgtcatcgccatcgcattgggcaatgtacgctgctacgccaacgggcagcctctcaacaacctcatgcccctcaaaggctgacggtcgcgcgcgggggagacccgtatgatggcagtcgggaaggaaggaaagggtatgacattgaacaaatggcgtcgtgcgacggaatggttcatgacggcattggcattggtgttcctgttcgcgtattcgtgggaagtgctggcgagaacgcatatcgtattgtgcgaaacggtgatcaacatcatctggatggcgttcatcgtcgactacgtcgtttcgatcctgctggcgaaggacaagaaagcctggttcaaagagaatctgctgatgctggtgtccatcgccttgcccatcttcagaccattgaggctgctgcgattggtggcggtgctcaacgtgctcaaccgtaccggtggcatggcggtgcgtggacgtatcacactgtacacatgctgcagcgtgacactgctgatgtatatcggcgcccttgccgaattggatgtggaacgtggggttccaggcgcttccatcaccgatttcggcgaggcgatatggtggtcgttcgtgaccgtcaccacagtcggctatggcgatttgtctccggtgacatggcagggaagaagcatcgccatcgggctgatgataaccggcgtggccctgatcggcatcgtcaccgcgacactggcctcatggatagtcgatcgtgtccgtgacgaaaccgacaagcgcgcggacgaggcggaatcggaaacggaacagttgcgccacaatgtgcgggaactgacggacaccgtcaaccagctgcgtgacgacatcgcgcggctgcgcagaccataacggttctcatgactgcactgcggaaaatgcggaaagaggctgaggcataggaaaagcgccggatgaataacccggcgcttttcctatgcctcaccgtcatacgtcttacaaccggaaaggcggagacgctgcattggatttattcgcaggcgactccgtcatggtcgcggtccagttgtgaacggtagcccggctggccctggtagataggcgcggcgccagcggctcgtgccgcggtgcagttctggtagtagacgtcctgctgtggcgctggttggggcgcgggagccggagccggagcgggttcgagcgcaggtgcctgtgtcgtttgttgagtctgctgggcctgctcagctgactgttcggtttgcgtctgttcggtttgcgtctgttcggtctgctcggactcggtggtcttctcggctgtggaatccttgacccccgtgtagtcgggcacggtttgcgtcgggcaggaggacagcaccttggccatggcttccttttcggcctgcgtgacccacagtgagtatttgtgcttcacgccgatctgacgcgccacgtattcgcaacggaaccccttgttggacggcagccacgtggccgcatcgccatcggacttcttctggttggcacgcccctgcacggccagcagattgtacggatcgttcgccaatgcggtgcggcgctcctcgctgagcttctgcgcgcccttctgccacgcatcgctcaacgccaccacatggtcgatctgcaccgcggtggaagtcttcttgcccttcttgaacttgatgtccttgccagtgtatggatcatgcagttttccggacttcaccacgcaattgtgcgtacgccacttgtgcctcacgccggtcagatcgcggttgaggatatcattgcgggtgtcgcagccgttgtggtccacgtcggcccacgccttgccgaattgagtgcgcttgtacccggttttcggcgcgcggcccttgacctccaacgaatccaacacctccgtggcggacgtgccggccccggtgccatccgtcggctcgtccgcatacgccgaaccgaccggcagtccgatggccagactcgcagccagcaatccggacaaaacaaccatcatcgaaccatgacgacgcatgatacgctcctcaccctaaaacccctcaagtagtacaagaatatccccggaacgaattcgaatcgcttatttacggcagatttttcggcatgccgaaaccagtatttcgcatccgtcaagacgtatggcaagaatcggccgtatgaccaacagcatcacagcaatcaaaccggaacgtctcgcacaatacgccaaagacttcaacgccgaccgggccaaccttgtggccgccaacgccgcggtgtcctcgggcgtgctcgaagccgccatcgactacaaaggccagcgcgcgctgccacgcgacttctccatcgaactgaaacaggggtccatcaccaaccagcgccgatccggccgctgctggatgttcgcatccctcaacaccctgcgttacgagctcatgcaccagtggggactcgacgatttcgaattctccgaaacctacctgttcttctgggatgcgatggaaaaatccaacacgtatctcgaaaacgtgttcgccacgctcgacgagccgaccgacagccgcctgttccaggagatcaactacgggccggccgatgacggcggttggtggcagatgttcgccgcccttgtagacaagtatggtctcgtgccgaagagcgcctacccggaatccgccaattccaaggactccgacgcgttcaaacaatacctcaacagcaggctgcgccagttcgccgccgacctgcgcgaacgttacgcagccggcgccacggtcgatgaactgcgcgcggtcaaggacgacgacatgtccaccgtgtaccgcatgtgcgccatctcgttgggcgagccgccggagaagttcgacttcctggcccgcgtgagcgacgatgacaagaaggacgataagaaaagcggcgaagacgaggccgacaagccgaaaaccggcaaggacgagcgcagacagatccgcgaaaccggcatcacgccgatggaattctacaagaagtacgtgccggtggacgtcgacgatctggtgacgttgtgcaacgtgccgatggcgtcccgtccgttcaacaagcgttaccgcatccgctacaccgccaatgtggccgaagcgggggatatggaattcgtcaacgtgccgctcgacgtgttcaaaaaggccgcggtcgaccagattagcgccggacacccgatctggttcgcctgcgactgcacccagttctcgctgcgtgcggccggctatttcgactgcgacagcgtgcgcgtggaccagctgttcggcaccgatttcgacttcgacaaggcgcacggcctcgaatacggcgacagtccaagcaaccatgccatgaccctcaccggcgtgaaccttgacgagcaaggcaagccgaaccgctggaaagtggagaacagctggggcaaagacaacggcgaagacggctactacgtggcctccgacaagtggttcgaccgctatgtgaccgaaatcatcatccgcaaggaatacctcgacgacgccacccgagcgctgctcgaaaccgagccggtggaactcgacccatggcagccgctgaccaaacgctgccgctgacgcaacacgggcgataacatgccgcggtccggatcgggccgcggcttttgctgttccaccgcgctggtatggttgcatgagaacaaacgtacgaacgatgggggttcaggtggcggacactctggcatggctttccgacgagctgcgcagcgaatgcagccagccggtactgcagcgcgcccgcggcatcgccaaccaatggcgttccaaaatggaggacctgcattgcctgaacgacaccgcatccaaccgcatcaccctgtatgccaccatacagggcaccacctcaccctccagccgttacgaagtgcaagccacgcttgatttcgccgacgagctgtttctggcacgctactgctcctgcccggcattcagcggttcgcagcgcggctacggttcctaccggaccttcgactaccacaacagtccgaaataccgcagcttcgacgatgacgacgactacgattacgtcgacgactacgacgatttcggctccggcagcacgtacggccacgtcaacgatgatgacgactcggcttcctccaccagccgccggtacaccggcatgtgcaagcacgtagccgccatgctgctgctgttcctgcagcagccggaacgattccggggattccacgccgcagccgcaacaccccgggccctcgccgactacatgcgctccctcgatgcgaaaagcaacaacgccggcgagaacgcccaactcgacgtgctgaaacgaatcatcaacgcgaaaagccgattgatcgaggaacaacgtggcgcctccggacagggagccgccaaaccgaaacgcaaatcaagcgcgccggtcgacgtcaaaccgggaagcgtgtacctcgagcccacgctgatcaacggccatgacgccctgcgcctgtccctgcgcatcggatgcggcgacgccgactatgcgctcaaaaacatctcaagattcgtggccgacatgcggacgggaacatacgagtcatatggcaaaaaactcgcgttcacccacactccggacatgctcgaccccttctcgctgaagctataccgcttcctgcagcaggtgatcgcatccagaacggcggcccaactgcaaaacggatactattacggcgaagcggtacgcgtcgaccgtgaactcgtcctcaccgattgggaggcatgcgacctgctcgacctgttccacgccgtgacacaggacgaatacaaggaacacgagtcgaaggcccgcggtttcctgcgcacgtcggacggtgacgggctgagacgattgcttatcgaggatttccaacgcaccaaggaatccgggccaagccgcatccacatggccaacgaaggaggcgagccgttcggccttgacattgtcgaaggcgaccccaccttcacgttcaaggcgtcctacgtgcatgagggcaccgcgtcgggcgtgcgcatcacatcgaaccaaagcatctccgatgtcatcaacggacgcaacggcttctacgttttcagccgcgaacgtcccgacgattccacggcgacggacaggataggcatcgacgggctcttccgctgcaccgataaactgcgcccggcattgcaggtgctgcctgacctgtgttccgacgatccggacggcgtgttcatcgccgaaaacgactggcccatgttcgcccgaaccatcgtgccgaaactcaccgaagcgggcatcggattcgacattccgcaggaagtgaccgaagcggtgggaaccgaatgccggatcgaattctatctggaccgcgatttgtacggcatcacctgcgaagcggtggcgaaatacggcgacttcaccttccaactggtgcccaccgccaaagaactgcgcggcgtgatcaaccccgattcacgttcaagagcctcgcaggtcaaacgcgacctgtcacgggaatcgttcgccgtgcaggtggtacgccagctgtgccctacatggagctccatcgacgtggcacgcgtcaaagaagaggatgagcaggctatcctgctcatgctcaccgacggcgtgcagatcctcaaatcggtgggccaggtcttctccacggcggcattcgatggcatgatgcagcccaacccgccatcggtgaaggtcggcttgtccatcgactcgaacctcgttgaaatctcaccgatcgccgacgaggtgccgatgaacgaagtcggcgcgctgcttgactcctaccgcagaaaacgccgctaccatcggctcaaaaacggcacgttcgtggatttgaaggaagccgacctgcatgagctcgaccaagtgtccacggacctcgacctgagtgaaaaacagctcgactccggcatcatcaaaatccccggataccaagcgttcctgctggactcccaagtggacgacgaaggcaaaagcgcctcgttcgtggactatgtcaacgatgtgaagatcgtcgatccgaaacgctacgaagtgcccgaacggctcaaaaccgtgctccgcccataccaggtggagggcttccaatggctgtccaccctgtgggacaagggcttcggcggcatcctcgccgacgagatgggcctcggcaaatccgtgcagctgctctcgctcatcgaagcgcgcaaaggaaacggtccgtcactcatcgtctgcccggcatcgctcgtctacaactgggccgcggaatgcgagaaattcgcgggcgatctgacggtggaagtcgtcgccggtacgaaagcgcagcgacgcaaggccatcgcgacggtggccgcgcaatcgcaggagaacgacggtgctacgacgaatggcgccacgacgtacgacggcaccgacgtggtgatcacctcctacgatctgctgcgtcgcgacgtggacgattacgcagcctgccatttcgcgctgatggcgctcgacgaggcgcaatacatcaaaaaccatgccacaaaggtggccaaatcggtcaaacaggtcacggccgaccatcgcttcgctctgaccggcacgccaatcgaaaaccggttgagcgaactgtggagcattttcgacttcctcatgcccggactgctcggcacctatacgaaattccgcgaaaaatacgagcagccgatcatggctcccggtccggaacattccgtcatggccgacaaactgcaggcattggtgggactgttcatcaaacgccgtctgaaaaaagacgtgctcaccgacctgcccgacaaattcgagaacgtgctcaccgtcaaactggaaggagagcagcgcaaactgtacgccgcacacgaacagcggctacgcgccacgctcaccaaggcgtcggacgccgacttcaacaccaagaagatccgcatcctcgccgaattcaccttgctgcgcgaaatctgctgcgatccaagactcgtatacgccgacgcgaagaacgcctccgccaaactcgacgccatcgccgaactcgtggccacatgcatgggcgaaggcaaaaaggtcctcgtgttctcgcaattcacctcgttcctcgaactcatcggcgccagactcgccgaacaaggcgtggaatactacaccatcaccggcgagacgccgaagaaacgccgtgtggaactggtcgacgaattcaacggcaacgacgtgcccgtattcctcatctcgctcaaagccggtaacacgggcctgaacctcgtgggcgcatccgtggtggtgcacgccgatccatggtggaacgccgccgcgcagaaccaggcaaccgaccgcgcgcaccgtatcggccaaacccaggacgtgaacgtataccagatcgtggccaaagacaccatcgaggaacgcatcctgaaactgcaggaaaagaaaaacgagctggcgcgccaattcaccgacggcaccgcatccggcggcgtcggcacgctcagcaaggacgatctgctcggcctgctgtcataacatgcccgctgtcgcggcgtgcgcagactgcgttccgaatcgcaagacgaaaacggaacgcaggttgcgcatatcgcatggcgggcgtatatatggacaagcaagtttcagggaaggtgaaaatccttactggcggtaacggcacgaccggcattcataacggccccataccgaagcccgcgacccgcgaaagcggctgatccggtgagaatccggggccaacggttacagtccggatggaagaaacggagctcaacatgagtgtatcctctcctagcaatacctccaataccgcagctgatcaggccgcagacaaaccgatgacccgtccggacaacgcgcactccacaggcgtcgccgactccggccgctggtccaccaaacgcatcgccatgtacgcgctgttcgtggcgctgtccatggccgtcagcttcatcgaattcccgatcatcccaggcgtgcagtggctcaaatacgacccatccggcatcgtctgcctcgtcgcgggcttcgcgttcggaccggccgcagccgtcatcgtcagcgtgctcggcttcgtgccgcacctgttcaccaacccatggggcaccctgatggccgtgctcgtggcattggccctgtccgtgccggcatcgctcatctacaaaaagaacaagacgcgcaagggcgcgctgatcggcatcatcgtcggcgctgtcgtggcgctcgccgtcgccatcgtcggcaacatcatcgtcacgccgttctacgcgcacatgaccaccgcgcaggtcgtggcgcttatcgtgccggcgctcctgccgttcaacgcgttgaagttcaccatccacggcgtggtcacgttcctgatctacaagccgatctccaacctgctgaaccgttgagcttcgtttgttcccattgaaatgaacatggagggaccgtccgcatccgccggagggttcctccgtcttgttttccccgagaattccatacagtgctggtgaaggaagattttatggttacgaccaatgcgccgatcataacgttacgcgatgtgcgattcacctatgatggcggcgcgacatgggcgcttgacggtgtgagccttgacatccgccgtggcgaacgcatctgtctgacggggccgaacggttcgggcaaatccacgctgtcacgtgtcatcgccggactggtggctcccgatgagggatatgtcgtattgtcaggcaatgtggtgttcgacgagtccggcgcgcacgccgacgagtatcgaaccgcccgttgcggcatcggcgcggtgttccagcatcccgaagaccaaatcgtcaccaccgtcaccgaagacgacgtggcgttcggaccggagaatcttgcgattgagcatgatgagatcggcctgcgcatctccggttcgctggacgccgtggatatgagcgactatcgcgcttccgatccgacgcgcatgagcggcggccaacaacaacgcatcgccatcgccggcatgctggcgatggattccgatgtgctcgtgctcgacgagccgaccgccatgctcgacccgcaagggcgcgccgacatcatgcgggtgctggacgaactccaggaccgcggcaccaccatcattctcgtcacgcaccatgcggacgagttggaacatgccgaccgtgtgattcagctggaagcaggccacatcgtaggcgatggccccgccgacgagcggcttcggatgccggttcaatcggtgggcctgccgaaacgcattgatgatgagtccgccgaaacgctcatcgaagcacgcgacatatcgtatcgttacgtggacgccgaacgtgacgtgttcaaccacctgtcgttcagcatcggcaaaggcgagacagtggcgttgatgggacgcaatggcgccggcaaaaccacattggcgcgcatgctgtgcgcgttggagaaacccacgacaggctcgatcgtcatcgacggcatcgccgtggccactgcgaaggcgaacggcggaacgaagcccctcaatcgcaaaaaccgtacgaggctgcgccgtacggtcggctacgtcatgcagcatccggaacggcagctgttcgccgacaccgtggccgaagacgtcgcatacgggccttccaacctgggattggatacgtccgaggcgatggaacgcgccatgcaggccatgcggctgctacatatcgaacatctgcgagaccgttcgccgttcgacctgtcgggcggccagcagcgactggtggcgatcgccggcgtgattgcatgcgagccgaaagcgttgattctggacgagccgaccgcaggtcttgacgaggaggccgccgcacgcgtgcacgggctcatccacgggctcaaatcacgcggcgtgaccatactgctcatctcgcattcgcaggatgaagtggacgagcttgccgaccgtaccatcatattgggcaagccggcgaaacgtgcggactctaaggaatccacggaatccacagtgaaagccacctgcgaagaggagccggatgcggaaccatccgtggacgccgccggctcggacaccgcgaccgtgggggagcggcggaccctgttggaacgcctcgatccgcgcgtgggcatgctgtccgcattggcgctcatgttctccgcgttcgccatcggctcattctggcaattgctgcttgccgtggtgttcaccggcgtgatcgccgcggccggacgcatcaatgtaggccgattggccgcttccgtgcgtgtgttcctggcattgttcgttttctgcggcctgctgaacatcttcttcgtgcgcaccggcaccacggtggcgagcctcgggccgattcccatcaccgatgacggcatccgcatcgccctactctacgcatgtcggttcgccgtggtcatcgtcatcggagcgatgttccttgcctccaccacaccgaccgccatgaccgacgcgttcgaatcgctgctgtcaccgttcgccagattcggtctgcacacgcaggagacggcattggtgatgagcctcgccctgcgtttcctaccgacgcttggtgtggaaacgaaagcaatcatcgacgcgcagtcggcgcgcggcgggagcgtcgaaacaggttcgttcgtagtacgcatcaaagcgatggtggcggtcgtcgtgccggtcttcgccgcagccatccgccacgccgacaacctgagcctcgccttggacgcgcgctgctatgaggaaggtgcgacgcgcacgcattggcgtgtcatgcgcgtcaccggcatggacgtggccgtggcgatcgtggtgctcgtctatctcgtcgcactggtcgtgctgggcgtgctgttatgaccggtgcgttgcgggcggatgggcaaataccgtcctcacgctaggcttgagcgggtatttgtagataggaatggaacacatatggcacttaccaaaaagcaggtcaagcagctgcgcggcctggccaccaaactcaatccgctcatccaggtcggcaagaacgatctgagcgaaaacgccgtcaaacaggcggacgagaccatcgagaagcgcgagctcatcaaatgctccgtgctcgacggttccggtctgaccgccaaggaggccggcgaaggtctcgccgaacagcttggcgcggaactcgtgcaggtcatcggcaaccgtttcgtgctctaccgtcgttcccagcgtgacgacgtggagcacattcgtctcgtgcgcgaatagcgagccgaacgttatatgagaagcggcccgccctccggaaccaatcggaaggcgggccgcttcatatggaaataaacaatcggaagagagcgtgccggagaatcagctctcctgatcccattcgggcttccacgtgtactgcatgtcgtacgcgctggaccagaacatgtactcgttctcaacgccggtcacaaaaatatcgaccagctcctgcttacgttcctcgctcacctcggcggcgagtttttcgatatgctcgatcagccaagccgaaccctgccagaactcgtcggtcttgtacatgtccacccagctcttgtactggttcacatcgagcgtgtcggcgaattcatgggcaagacgatatccgtaatccgcatacacccaggcgcaggggagcacggccacgagaatgtcgaggatgtccttgccataggcgatggaaaggatgttcgacgtgtacgcgcgggcgaacgccgactggcgcacgttgttcatctgctcgtcggtgatgccgtagctggccagatacgtgcggtgcacggtcgactccacattcaacgcgccgttctgcacgttgagcatgaacaccatgatctcaggatcgtctgttttggccagtcccaaagcatgcactctggcgtagtcgttaagataacggaaatcctgcagcagatagaacgcgaacttctcgcgcggcagagtgccttcgcccagttcgcggatgaacggctgcctgtagccttcctcccatacgaggtcggcggctttgcgcagccgctgcgcgaatgggggaagattggttcgcgtgacgcccttcgaagcgtcgaacgcggaatcggaattggttacggaaatcacatcagccatatggccatgcctccctacgctggtgtcaaccatcaggttcaaagggttcggacgtccacgcccatctcaatccgtcatacggattcccctgcatacgcggttcattatggcaaacaagttcgtgccgtgcaaggttctgtccatatttgtcgcggattatgcccgtgctcggctccatatcgaacatggccgatgtgtggttgagggccggtgcaagaatggaacgtatgactgaaaagcaagttgcgaagaagaccatcgaaaagctggctatcgtcgtggtgacctacaagcgccagcagctgctcgccaccctgttcgaatccatcgagaagcttaccgtcgccccgtggcgcatcatcgtcgtggacaacgagcacagcgacaagacccatggcatggtcgaagaattcagcgccaaactcaccgcgcagtggggcaccaccgtggccgacctgtccggcaacgagaaccgcgtggtctacgcgccgcagaccgacaacctcggtggtgcgggcggtttctccgcaggcgtgaagaaggcgtacgagctgggtgccgaatggttctgggtcatggacgacgacgtcgccgtcatgccggaaggcatcgagcgcttggccaagtggaccgatcggcacgacgtgattcagggaagccgctacgactatgatggcggtccgttttactggcagtacgatttcatcgtcccgctcggcattccgaacccgatcgcaccggctgcgttcggcccggctggctatcgcgtgatggacacgttgtgcttcgaaggcggcctgttccgccgtaacatcgtcgagaagatcggtctgcccgacccgcgtttcttcatctattgggacgacacgatgtacggctatcgtgccagcaaggtcaccaatccgatcgtcgtgcccgacgtggtgctgcgccgtacgcgcgagatcggcaattgggacatcgccggcgtgcgccagctcaactccacttccgacatgaaccgctaccacatcatgcgcaaccgcggctacatggcccgatacttcatgacgtacggcgattaccgtccgctgttgttcggtctgggtacggtgctgaccgcggtcaaggaagtgattcgactgacgatggtggaccgcgagcatttcaagaccggcatcgttcagatcgccaagggatggtgggattcgcgcaagctgctgcatgatccggaatggcagccgatgccgccgctgaagtaacaccgtggcccacgcgtttcccaacgcgcggcgatcacgcgattgacgattcgtcccacgtcggagcctctaccgacgtgggacgaatcgtttgcaaaacaggcgatgaaatatttactcggttaagtattacaatttgtgcaatcgttctcaccatttgtgcatgtcgcgcgcgattttgggcatgttgcgagttaccataatacgtaccggttcgaatacacccgtaacataccttgatagagaggttgaagatgattgagactgcacaggcattcggcgttgacattggtggctccggcattaaggccgccccggttaacctcgagaagggcgagttcgccgaaccgcgtctgaagatcctcaccccggaggtgtccactccgaaggccgtcggcgaaatcgttcgccagcagctcgagcatttcgaggttccggagtccgctccggtcggcatcgccttcccggctccgattcatgtgggcgagaagcttggctacatggccaacctggaccagtcctgggtcggcgtggacgtcaccgaagtgttctccgaagcttgcggtcgtccggtcaccgtggtgaacgacgctgacgccgccggtcttgccgagcagcagttcggcgccgcgaagggccaggatggcctcgtcatcgccaccacgctgggcactggcatcggcaccgcgctgattttcaacggcgagctcattccgaacaccgagctcggccatctggaactgctcaagggcaagggcgacgcggagaagtacgccgcatcctccatccgcgagaagctcgacatgggctacaagaagtgggcgaagcgcctgaccaagtactactccctcatggagttctacttcgacccgcagctgttcgtcgtcggcggtggcgtgtcccgcgtctccgagaagttcctgccgtacatcgacatcaagaccccgatcgtcgcagccaagctgcacaacgaggccggcatcatcggcgccgcatactacgcgagcaccaagcagaagtgatgtgttgaccgattaggttgtcaaaaggccgtccgacgaatcggacggcctttttcgttgttccatgtgccgcagatggaagacggcagtccatggagtagggtggagagcatgcgtttttcctcaagagtcgacatcagtgagctcaatcccatcgccaaggcggaagccaccgccaaaacagccggcagaccgctcggcaagctcaacgactccaatccgacacggcacgcgctggctccggatcttgtgccggacatctactccgccgacccgcgcggccaacgctacgcgcgtgaggcgctggccgcgttccttgacatgcaggaaatcggccattgctcgccggacgacctgtacatcctcagttcaacttccgaagcctactcgtggcttatcaaactgctgtgtgatgccggtgacgccgtgctcgcaccgaaacccggctatccgctcatcgaatcgatcgcacgcctcgaatgcgtcgacatgatcgaataccaacaacgattcgacggctcctggtatatcgacgtggccgaactgaaaaccgcgctggaaggcccggacggcaatcgcatccgcgcgctggtgctcatcaaccccaacaatccgaccggttcgtacgtcaaaccgtcggaacgcgaggcgatcgtccgcctgtgccgggaccacgacgtggccatcatcgccgacgaagtgttctacgattacgatttggaaccattcgaaggcaacgcacgactcgcgggggagcgtggcgcgctcacattcgcgttggacggtttttcgaaaatgctcgccgcaccgcatgccaaagtcggctggatccaggtatcaggtcccgccgaagacgtggcggaagccaagcgtcgtctcgacgtgatcgccgacgactatctgcccatgagcgagatcgtcgcaaaacaaattcccgcactgcttgaagcggcgccatcgcagaccgcgcgcgtgcaggaacgtgtgcgcggcaatctcaaagcactgcatgccatgctcgacgcggatgagcaaggtcttgtcagcgtattgcgtgccgaaggcggatggaacgtactgctgcgcgtgcccagcgtgctcgacgagaacgagctggtgctgcacatgatcgaacgccacggcgtatccggacagcccggctacttcttcgacatgacctccaacggctatctggccatctcactactgcccgaaccggacgatttccggcataacgtgcacgtggtgatcgacaccgtcaacgaactgatcggctgaacggactgccgagtccgaaatctcttctacgccctgtcgcccttcgccgcctcatacttcgaacgaaccaaatccgtgtaaaaatcgaccgcctcacgaggcgcgccgtcgaacaccacacgatggtcgtcgacaacgagcacgcggccgatcgcatattccggacggacgatcagatccgtgtcatgcgtggcgaacaccacctgcttgtcatagctgaacagggccttcgccacgcgcgtcgacgacacctcgtccaatcccttggtcggctcgtcggcgacgatcgcagcgggggagaagctcaacgcggccgcgatcgccagcagatgccgcttctcgctatccaaagcggaggccggctcgcgggccacggaagccaagtcgaaatgcgcgaacagattgccgatgatcgcctgacgttcgctttccggcaccttgtgcttcttcaacggcaggtcgatcgcctcacgaatcgaagccgccttgtagtaggcgttcggaatctcttcgcgccgcacgcggccgaccagatcctcgacatgcttcagatcgcgtttcacggcggggtcgtatgcggtaccgtccgcttcgatgcgggccgttccggacgtggcggtcaacgctccgtccagcaacttcagcagcgtggtcttgcctgcgccgttcaagccgattatcgccacacgcttgctgtcaggtgtgatatcaagcgtggtggcttccaagccgatattgccgtcctcgtacatgtgggcggcctggtcgagatggaacgtgacggacgaagccggtgtggaatgtttaccggcgaacagcgaatcgaagaaacccataccgccgattgtaacgaaccgcaggcgcaaccgcgcgcaggttcaccggcagttcatccgaatcgtccgtgcccgcatgcgtggcggacgccttgtaatcggcgaacaggctgccgaaatccaacagtcgcgtcacactgctggtttcggcatcgagtttgacgatttggtcctgcacggcgttgtcgtcgcggcccagttcggtggtgagcagcacgatgtcgcctttggcatccgacgtgcggcctgaggatggttgcgtggcggcgaaagcggtttcatggtcggcgacccccggaacataactcaaagcaacaatgatgacaatcactatgattgccgatgaaactcagagcaaaccggaaaaactgctatatgaatcaggaaagaaacctgaatttttactggatgtagcttatgtcggacgtcaacccaacatgaaccaggactgcacgtcgagatagagggcgggattgttgcgcaacatctcatcgtcacgcccgggcaggaacaacgacatcagcgcgacaaccagcgtgaacagcagcagcgcgaggaatccggcacgacatacccaacgcagacgcggcttgccgcaatcaagtacgatcagcaacgaaggcaacgcggccaaggcaaacagccatccgaaatcggcgatgtaccgccatcccaaaccagccatgcgggagtcaatcaccacaagcagcaatcccaatgccaggctggatgtcaacaacagccatgtgttcgtgcgcccggccttgcgcatacgccggtagaggaacgggcaggccagcgcggccaacgtcaacggagctatcgtgaataagccgccaggcattgcctcggtaaatccccaagtgggaagaggcgccggattgacggcgaggaacggaaacgcatccgtgaaccgcaacggcaggaacaggtaatatgcgacggtcagcgcaagattcgacaatggctgccgataactggtcatatccgtgaccgtcatctgatatgaggtgccgaagtcgagcggtgatccgaaccggaccacgttgtacgccagcagaggaacgatcacaatcaacgcgggaagcaatgcggccaacggcgcgcgcatcagacgccagaccgacatatggggaagggaggaatcattggaggcgtgacggaaaatcgactgaatctgcggccagaatattacgaaagccagcaacgccacgagaatgaactgcggacggcaccccagattggccgcaatgcacatcgagcctgcagccagatggggcaacgacaacgactgcgtgccatcaacctcacgaatccgatcgcctgacaccggcacccgcttggcggcgcccaaccacagccacaatcccaacacgctcagaaacagggaggcggcgatcggcaccgaatagaaattcgtccgataccacagatacaaaccattggaagccaacagcatgaacacgcacagcatactgaccgcagccaacggcgcattcggacgaattcgggatatcacacgaatcaccagcagacatccgaataccagaaaaccaagcatcagcagcggcacggccgcaccgcagggcatcatcagcccgccatcgacgaacaacgatgtgaccgcccgatacggcaggaacaacaacaacgcgggaaccacaccgaaatacgaataccagtgcccctgatagaacgcgtaatcccaatacactgggcttacgccatcggcaagcaaccgctgccgggtggccacatcatacggatccgccgcgtcacgcaacgcatccggcacatccaaatccaaccacgcgtgaccatcaagcagcgcccttgccacgtaatcgtactggtcgaaatcatacgtgtacgtgcctttcgtatggaagctcaacggagccgcctccaccagctgccacaccacaacggcacaagtgaccacaacaggcaccgccagcagcgcccccagccacgcacgctgcctcacactcgtcgtatccaacggcatccgccacaaccgcgaaccaggcctccacaccagtaccatcgccaacacggccaccatcacgccgatacgcaacggattcaacgcgaacggtacacgcacattcgcacgcaccgcatcaaacggaatcagcgaacccttcggctcgacaatccgcacgcacaccgaaccacctgcagccgccgcatgcacatacagcgaacgcggcgaagacaccgacaccgaactgaccgtaccggccctgcgattgacatcaggacggacacgaaccgtgcgcaacacctgctccgattgtctggctgccttatccaacgccttcgaagacaccgggtccatacgaacatattccgacgagccatccgcatcgacctgcatatatgcctgcgtcggatcggtgaccttcaacaacccctcgtcagtacgttcgagcccagggcccagcacgttgtacgcggcggcggaatcacccgatgcggtcaaggaacgccaaaacggcatattgcacaacacgcactcgaccgccaccatcaccgcgaaagcgactacaatggctgcgcacatacgacgacgtgcctgaaaacgctgcttcgaaaaagtcacgtcattattctaatagcttcatgtcgcattggattgaaagaatggcacacatgtctcaccgcacaccatcagacccggccagccaaccggaacataaccggaccatgctcgaacgcgtcaggcaaaatgtgcggcgactcgtcaaccaggccacgccgcgccacatccacgccaaccccttcggcaaggcgcttgacaagcccgacgacatcgtcgacgaactgacccgcaacgccatccggcttaatccgctcatcaaacgacacatcatcgacggattcgaaggcgtgcccggaggattccgcctcggatgggcccaactgccgcagacccacggccatgccttctccatcggattgttcaccgacagcgaccacttcgcccaaatcgcgctcgcggacggcaaagcgcgtgtcttcgccggcaccgatccggacatggacacgcaggaactcgaaccgcggttcgtcttcgtcaaagaggaaacccttacgttggcggacggtccaagactcggccatgcggccagccgcaatccgaaaacggtgcgcgccacgcaaggcggcgtcgtgggacgcatgccgggcggtcgcatgatgtggctcgcctcatggctcaaaaccggcagccgttacacgcttgagcaaatgcgcgccaacctgccagcgaatatgcggttcgacctcgaatatcgggacgccatcaccatcgccttcttcgccgcctacatgctgccacagatgaacggcctgctcgtcggcttcggttccggcaacattttccgcaggctcaaccgcgaagcgcccataggcgccatccgacggtccatcagagacaccatgagcgcccggtcgcatggcatgcgcgcctccggcctggaagactacttcgccgatctgatgcgcgaagcccacgcgctcgataccgatcaagggctcgaagctgtgcacggagcggaaccgctgcgcctgtacacatccagctattccggatgctacttcttcgcatgggattcctccctgccgttctcggcagtgctgtgcgccctcaacatcgagggcaacctcaaccgcttcgccgccgtcagctcatggctggaacgtaacgcacgcatcggcactctccccacggaggacacggtgacgcgtgccgaagccgcgcagatcgacttcgccctgctggagaatccgacgctgatcgcgttgaaaccggacgaccggttcggcgcgatcctcgacccgaaccgggaagacggcatccaggccgccagccgactggcggatatcgcggccgacttccggcgtgaagtcgctgaatcaaccaaggacaacgtgttggaaggcgattccggcgccgacggaggttccgaatgggtgtaccggcagaccatgtcccgtctgctgcgcagcctgcgtctgccataccgtttcgacgttgacttccggtgcgacctcagcgacggcgaagtcgcaatcggcttcacttctgctggagtgtccatgatgccgttcacccgatacgacgtatcgcgccgcgcgtggatcgacctgaccgacgtcgaacgcacgcgtatgagcgtcgattacaatctgcgcgtcggactcatgatggccgcgctgagcttcggagccgatccgaatgtcaaacgcgtgtcgatgcacatcgattcgattggtctggaagaggccgtagccgaacaggattccgccatcagcgagttgatgagcgaggcgttaagcgccttcgaacgcatccgtaccggagacatgaggccatccggatccaaagccgctccaaaggacggcgactaccatggcgatccggctcggcccgtcactccgagaaccaccgatatctcatccgaatcaatcgattccgacgattcggctggctcggatagcgttggcactggagacgatacggtggacggccagttcgaagacctgatgaaagacatcgacttcgacgaaatggcgttcgcggtaccggacggacgcgccgacgatgacgacgcctccatgcgggacgacgccagcgacaaaacggagtacgacacctacctcgatgatgatgacgacgatccgatggcgcagctgcgcaaaaacccgaccgtacgcaacttggtgaccgtcaccttcacccgcgacgagttcctgaagcggctcgacactgacggattggcccatccgaccgccacataccgcatgttcgacgccgaaatggacgtggacggcaaaggcgcgctcaaacccatcgacgcggccttcgaccttcgtgacagccgattctcaccggcgggaagccaagaagaacccgaactgtccgacattcgttttgatgacggcacggcgcagttgttcggctgtgagaacatgatgggcctgtccatccagcgtgtcgacctgttgcagcgcgccgtgggggagttccatcgtcttgcgcaaagcgacggactcgaatcggtggccaaagccaaacagtccatggacatcatcaattccatatccgatccggaattgaccgaattggcaccgcaggtcaccagcgcgctgatcgacggcgaagacacgcccgacttctcattcgaactggcacaatccctcgatgacgaacgtctgaaggcacgagacatgctgttctccggagacgtcgagcgggccatcgaatccgcccagtccacactcgaacgcatggaccggatcttcgctgaaaatccgggcgtgccgcggtacttcaattcatatgcggaacgcgtcatctacaaccgcatgttcgccaccgaaggcgaaagaacggtgctcattcccgacaacctgttctacatgcatatggagcttgccgacctgctcgcccaagtcaaaggcgtcgatgccgcgctgccgcatctgaacgccatggtgcgttacgcccccgcatacccgctgtcgcacctcaagctcgccgtgcagctggggcgtgccgaggactgggatccggcacgtgcggcatgcctcaacgcgctgaacgtcgcgcttgaccgggaagacgcctcattcgcctactatcgcctcgcctatgcggaatggatgtgcgaccacttcgaccttgccgccgcctcatacatcatgagcgaggagatcgcccccggacgtatcgccatgctcgaaagcgaactgcaggaactgatcggaagagcgcaatcgcagtgcattccggtgccgaccaacgtgcaggaagccatccacgtgctcgccgacgccggactgccggtatggccgaacacgccggtcgcgcccctgatgcaccaagcggcccgcgtctgcgtggacaaaggcatgttcgtgcccgcacgcaccctgtcggtggccgcgatgcgcatggattacgaagaccatgacggtgccgacgtggtgcaggtgcagttcctgcgctctctgaacaactaacaaaacggtcgaacatttgtgcgataatcggtgctggcgtggacatccgcgcggcatggcggaaatgatgggaaagcggtgacaatgacgaatcgtgatgattccgaacagttggcatgggatttcgacgcgccggagagcgacggtagttccgcggccgtcgtggccgatgaggggctggcttcgctgactccgggcagcgaacgttggattgccgcgttgcagccgaccgatgccgacgccatgcgcctcgacaaggttgatgtggcttcgatgagcgccgaagccgcggccaggctgtgggcgcgcgtggccgcatgggtggaatcagaccagatcgcatactatatcgacgatgcccccgtctcatccgacgcggcatatgacgcaagattgcgctgcctgcaatcgcttgaggcgcagttcccatcacttgactcaccgcagtcaccgacccatcgtgtgggcggcacgttctccaacgacttcgcttccgtacgtcatccatcgcgcatgatgagcctcgatgacgtgttctccatcgaggagctgcgcgaatggtacgacggcgtgctcaggggattggattggcccgaatcgaagccactgcccatgacctgcgaggtgaaaatcgacggtcttgcgctgaacctcatctaccgcaacggcgtgcttgaacagggtctgaccagaggcgatggcgtgaccggcgaggacatcactctcaacgtgcgcaccatctccaccattccgcagaaccttgccggaccggaggaagacattcccgaattcgtggagatccgcggcgaagtgttcatgcgatgggacgatttcaacaagctgaacgccgagaacgaggacgccggtcgcgcgccattcgccaatccccgcaacgcggccgcaggtagcctgagacagaaggatccgcgtatcaccgcaacccgtcgcctgagcttctacgcgcacggcatcggatcgctgcgttggggtgcggggcacgccggcaacggccatgatgtggtcaacgaccaatccgaagcctacgaattgtataagaaatggggtgtgcccgtctctccgcacaaccgtgaggtcacgtcgttcaaggaaatcctcgacatgatcgactattacggcgaacaccgaggcgacatcgaacacgcgcttgacggcatcgtcgtgaaggtcgacgatttgggattgcagcgttcccttggtgccacatcgcgtgcgccgcgctgggccatcgcctacaaatatccaccggaagaagtcaataccgagctgcttgacatcactgtgcaggtggggcgcaccggacgtgtgactccggtggcggtgttgaaacccgtgtacgtggccggttccacagtatcccgtaccacgctgcacaacccctttgaagtggaacgcaaaggcgtgctcatcggcgacaccgtggtggtgcgcaaggcgggagacgtgattcccgagctcgtcggtccggtgctggagcgacgcaagggacgtgagggccagatccgccggttcgtgatgcccacgcgttgcccgagctgcggcgcggaactcgctcccgccaaagagggagacaaagatatacgctgcccgaacgtggaatcctgcccggcgcagctgaccgagcggatcatcaatctggcgtcccgcaaggcgttcgatatcgaacatctgggcgaccaatcagccattgcgctgacgaatcccgaagaggacaggcccgattccatcgacacgtatgcgccgaacatcaccgaaatcgtggtgaaacccggtgaggagcctgaaccgtacgagccggtggcaggactggaactgccgcccatgcagacacctgtgctgtccagcgaggccgggctgttctcgttgacgtccgcagacctcaaggatgtgcgcgtctggcgcgaggccccaatcatcgaaatccacgagaccgtcgggtcaaacggcaagatcaagaaagtgcgcaaacgtgtgggcggatccggattatggcatcaggtgcccgcattctggaccgcgcctaccgccgcccgcaaacgcaaggaagccgacatcgacgagaccgcggaatatccgcaatacgtggtgccggatgacgccgtggtgatccgcgaggaaatcaaggtatcccgtggaggcacgtccagcgtgcagccggtgtacattcgtccggcggaaaacacccgcaagatgctcgacgaaatggacaaagcccgccatgccgacctgtggcgcgttctggtggccctgtccatccgcaggctcggaccgcccaccgcacgcaccatcgccagcgcgttcggtacgttggatgccatcgaacatgccagcgtggacgaattgtcccaaatcgacggtattggtccggaaattgcggaatccgtagtcacatggttcaccgcggcccgtgagccgggcaattggcgcggtgccgtgcttgacgcatggaaggccgccggcgtaggagtcggacaagcccaagccagcggactaccacagacattggcaggcaaaacggtcgtggtcaccggctcgttggaaggattctcccgcgattccgccaaagaggccatcgttctgcgcggaggcaaagccgcaggatccgtcagcaagaaaaccgattgggtcgtcgtaggcgagaatgccggctcaaaagccgcaaaagccgaggaactgggcatccccatgctcaacgaagaccaattcaaacagctgctcgacacaggaacagttgaataatcgccacaccatctggcaagccgtgccgcgaaccgctactgtggtacgcggcataaggaggaagcatgagcgacgagcacaccatcgaagcgcgcatctacgaacggctaagcaaagtgattgaccccgaactgggcaggtccgtcaccgacttgggcatgatcgcagccattgacgccacgccagtggcaggcgaaaccaacacgtacgacgtacgggtgcgggtcgaactgaccgtggaaggctgtccgctgtcgcagaccatcaccaaccagatcaacggcgcggtcgcctcctatcccgatgccacgttgattcccagcatcgaagtcggctccatgagccaagacaaactcacccagctggtggccggcctcaaagcggaacgtaaacagaacccgttcaacaaacccggcatcaaaacccgcatcttcgccatcgcctccggcaaaggcggcgtgggcaaatcgtctgtcaccgccaatctggcagccacattcgcggcgctcggctacgataccgccgccatcgacgccgacatctacggtttctcgctgcccaggctattcggcgtgcaatcacagcccacgaacctcaacggcatgctcatgcccgtcaccgcatggggtgtgaaactgatctccatcggcatgttcgccggcgcggacagagccatcctatggcgtggtccaagactgcaacgctccttggaacaattcctatccgacgtatggtggggcgaaccggacgtattgctgctcgacctggcgcccggcaccggcgacatggcgatttccgtggcacaggcactgccgaacgccgaactggtggtggtcaccacaccgcagccatccgcctccgacatcgcggtacggtccggcctggtggcattgcaggtgccgatgaaagttcgcggcgtcgtggaaaacatgagctactacgagcacaaaggcgagaagctacgcatcttcggcgaaggtggcggcgcacgcgtatccgaacagctgacccacagcctcggctatgaagtgccactgctcgcacaactcccattggagcctgaactgcgcgaaaccggcgaagcaggccggcccgcagtcctaaccaaagagggcgcgttgcggtcggacggtatcggagaaacattcaggaatcttgccgaatcgctgatgagactgcctcaataaaatcaccatacggttggagcgttcctccaaaacaacacatcggaatgcgactcagccacggaatacggaatccgttatgagacaaaaccgacgtaaatcgtgggtcctgtgtaatatcaggcgcagacacgggggccgaatggctgagaggaagcaaccgcttcaaccgtatgaacgtataccgggtaatgccggcgcacggacgtctctctatttcccgtgccttgacgaaaagagaaaggcacatatcccatgactgaagaaaaccagtcttccgcagttcgcaaacacaacaacaagtggcgcgtggtcgatatcgtcgtcgcagccatcatcgccgtcgcatccggcgtgatcttctggggctgggacatcgtctgcaccgcgccgctggccctcttcgaggcggtgactccaggcttcgaaggcctgcttaacgctttctggctgttcgcaggccctctggccgccatcatcgtgcgcaagcctggagccgcactgttcgcggaaaccctcgcggccgcgctcgaactcaccatgggcaaccagtggggcgtcggcggctcgctgatcgtcggcatcgtgcagggcctcggcgccgaaatcggtcttgccatcttcgcctataagaagtgggacctgctgtccaccacgatctccggcgcacttgcaggcgtcggctgcggcctgtactactggcttaccaatccggcttggagcgcgctacgcgtcagcatctatctgattgcctccgccatttccggcgcggtgctcgccggcgcggtgatgtacctcctgcaggtggccatcgccaagaccggcgtgctcgaccgcttcgaatccggtcgtacgcaggaactggtctgattgtccgatgcaagcaaatcccgcatcacatcaaggtggtgcgggattttcttgtgatggcgcatcgcatgacaacggcatacgaaacaacagcatgacaatcagaagaaagaacgacgaatgaccactgacgttcagaacacaacagcggccggcgtgaccgcacatgattggggatggagacacgcctcacgtaaggatttcgcgctacgacacgtcgacttcgacatcaaaccgggggagcgggtactgttgcttggcgcgtccggcgcaggcaaatcaaccctgatgtccggtttggccggcgtgctcggtggagatgacgaaggcgagcaggaaggcgagctgctcatcgacggcgtcgacgccagacaagcgcgcggacgttgcgggctggtgcttcaggacccggactcgcagacgattctcgaacgtgccggagacgacaccgcattcggctgcgagaacctgaacctgccgaaagatgaaatctggaaccgggcacgagccgcccttgacatcgtcgggctcgactacatggcgttcgaccgctccacacgaggactttccggcgggcaacgtcagcgcctcgccttggcgggcgtgctggccatgcaccctggcctgctgctgcttgacgaaccgaccgccaaccttgacccggacggtgtcaaggaagtgcacgacgctgtccgccacgtcctcgaacaaacccatgagacgctggttgtggtggaacatcatatcgacgtgtggctcgacctggtcgaccgcgtcatcgtgctgggcaaacccgaagccgattcgaacgtcggcggcgtaatcgccgacggcactccagacgaagtgttcggccacatgggtcaggtgcttgccgacggcggtgcgtgggtgccgggccgcaccatcgaaagccatgcgcccaaaccggaacaaatccggcaaccgcaggacgtcgtgctttacacgcgggatctgagcttcggctatgatttcccgctcggcgagcatatcgacatcgaattccattccggtgaggtgaccgcgttgaccggcagaaacggcgtgggcaaatccacactcggactcactctcgcaggactgctcaaaccgatagcaggacgtgtatgcatggcggacgatctggtacctccccatcgcgaaaacaatgtgatcacatggaaaagccgcgacttgctgggacgtatcggcatggtgttccaagagccggaacaccagttcgccgcatccaccgtgcgagacgaggtggccatcggccccaaatccatgggcaaaaccgacgaggaggcgtattccatcgccgacaggctgttggaacgcctgaatctttcccgcttcgccaaagcgaatccattcaccctatcgggcggtgagaaaagaagactgtccgtggcgtccatgctggctgccgcgccaaaagtgctggtcatggacgagccgacattcggacaggatttcaccacgtggaccagcatggtccaattgatctccggtgcgcgcgaccaaggttgcgcggtcatcatgattacgcacgatgagccgctcatcgaagcgctgggcgcacgccgtattttggtcagagagggggagtgacatgctcgaaaccaacaaaaacagtgggcgcgacggcaatgaaaagctcgaaaccattaccgtggtgccacacaaggaacgtcgtaacgaaacgaagccggcgtcaccgtcatggttcgtggcgaaaatcaacccggtaagccgtttcatcggtgcgttgatcctgtgcattccgatgttcttcaccctcgatgtcgtttcggcatccgtggcgtttggtttggaaatgctattgttatggatcggcggagtggctccttggacggtcttgcgcaagacatggccggtatggatagcggccacaggcagcttcgtttccgtggcgttgtacggcaagacatccggcacggtgctggccaagctgggcggcatcatcgtcatctcccaaggatcgctctatctggcgttggccacattcctacgtgtcgccgcaatcgccgtgccgggtgtgattctggctttgggactcgacccgaccgatctggccgacggactcgtgcagattctgcgcctgccgcaacgtttcgtatacggcggccttgccggcatgcgtatgttcacgctgctgcaggacgattggcgtgcactcggccagtcacgccgctcgcgtggcctcggcgacggcagcaccatcaaacgcgtcttctcgcaagcattcagcctgctcgtcgtatccatccgacgtggaacgaagctcgccaccgccatggaagcgcgcggattcggatccgacgcgccacgaagccaagcgcgcgaatcgaaactgcatgcggtcgactggctgttctacgccatctgcatcgcggtgccggcaatcgcgttggccaccgcatactacaccggctactggcattgggcgttcagcaacgtgtccaactaatggatgatgattccccaatcggcagctaaatgataaagctctctgtcatacgttccaatcggaatcgtatgacagagagctttatcctatttcggcaagccttacacggcttcttacttggcgagcttatccagcagcaacgcttcggtgatgacgttgttcttcaacgccggcaggctgatggactcgttcgggctatgcgcgttggccttcggatcctccggaccggtgaccagcacctgcgccttcgggaagatgcgctgcaattccggaatgaacgggatggaaccaccctcgcccttgttgaccggagccacaccgaacgcttcctccatggcgtccatggcgtccttggtggcctcagcgttcggatccatggcccagcccatgccgttgtcgagcttgtcgacccacacttcggcaccgaacggcgcatgctccaccatgaacttggccaacgcctcctgggcctcttccgggcgctggttcggcgcggtgcgcaagctcagacggaacgtggtttcaggagagatgacgttgaaggatccttccaccggatgcgcgtcgaacccgatgacggtgacgctgggcttcgtccacagacgcgcggcgagcgaaccggtgccggcaagacgatacgattcgacgatgcccgcgtcggcgcgcacagtcgcctcgtccatatcacgctgcaggccgccaaccggttcctcggacgcaacgcccggcacggccaaatcgccattggcgtcgtacatggaggaaatcaacatcgcagccagcgtgttcgcgtcaagaatcgggccgccatactggccggaatgcaccggatgttccaacgccttgacatgcacatcaatatcggtgttgccacgcagcgacgtggtcagcgacggaatctcagcggaccagttgcccgaatcggccacaatgatcgcatcggaagcgaactcgtcccggtgctcttcgatgaacggaatgaagctcggagaacccatctcctcctcgccttcgatgaacaccttgatgttcaccttcagatcgtctccaagcgctttcagcgcaccggaatgaatggcgattccaccgccgtcgtccgcggctccgcggccgtacagacgcgtgtcgatttcagtgccgacgaacgggtcggtgttccacacgttcggatccggcaccggctgcacgtcatggtgcgcgtacagcagcaccgtcggcgcgtcctcgctgacgtttttggaaccgatgacctcccaagcgcccggcgtgccgtcgggattgtgcgactgcaccaccttcgtatcgacaccaacctcgcgcagcaggtccgccacgaattgcgcggaacgcttcatatggtccgcggtgatgcccttcgcggaaatcgactgcaaggcgatcttctggttcaacacgtcgacgatgcggctgaaatccgactcgacgcgcgtgcgaatctcttcggctcctaaagctgtcataatccttgatgctccctatatatgcgtgtgtattacgcggattgaatatcgtgtgacgaatgtccattgtatccgttctttgcagaccgtccgaccgcagcttgaatcgcagcttgaaccgcaacgcagacggcaccgcgggcggcatcgagcgtcgatacgtcaccttacgctctataggcatgagtttgtttaccaagaaggaagaaccggcgcaggagaacgtcgagagcaaggctgcacagccgacctccggcaagggccgtccgaccccgaagcgcaaggacgcccaggcgcagaatctccgtccgctggtccccaaggatcgcgacgccagccgtaaggcggccaaggcccgtatccgcgaacgtgagaacgccgaatacgatgccatgcaaagtggcgacatcaaccacatgccgaagtcggaacgtctgccgtggcgcatctacatccgtgactacgtcgatgcccgcttcaatctgggcgagttcttcatcccggtcgcgttcataatcctgatcggatccatggtcgtcacctacaagtggcctgcattggcgttgccgctcatgctgatcatgtatgtctacttgttcgccgtgattatcgacgtggcggtcatgtggcacaagctcaagaagaagctcatcgagaaattcggtgagcagtccgtggccaagggcatgcgttccggttcctatgcgtggagccgtgccatccagattcgccgttggaggcttccgaagcctcgttacccgaagcgtggacactggccggagtgatcggtatcgagaaccgccggtgatttttcaagccgtcagcgaacaactgacggcttttccattaccatggaaaacgattgctcgcatcgaacaaaagctcacttcacgtgcgtgcaaacgaatcaatgaggaacgaattgggattcaatatggttcaacagcatttcgacatcgctatcatcggagccggccccggcggttactctacggcactgcgtgccgcggaactcggcaaatcggtggcgttgatcgaacgtgacggtacgctcggtggcacatgcctcaaccgcggatgcatcccatcgaaggcattgttgaccgccgtgcatagcgtcgaaaccatccataacgccgaacgcatgggcatcaacgccacgctgcagagcatcgatttcggcagattacgtgatttccgcgtctccaccgtggaaacgatgacgaaagggctgacgggcctgctggcgcatcgcggcgtcaccgtattccgcggttgcgcggcattgcagaacgcgcatacagtacgtgtcacgccggctgagggggagacgcaggtatcgcggtccgtggaagccggcgtgttcgaaccggttgaaacggaacttgcgatcgatgccgacgacatcgtgttggcaaccggatcgcgtccgcttgcgttgcctggaaatccgttcgccggcgcgctgatcgattccacccaggcgttggagctgaataccttgccctccagcgcggtgattatcggtgcgggtgcggtggcattggaattcgcgtcgctgtggaatgccgccggttgcgaagtgacactgctgattcgtaaggaccgcgtgctgtccacatgggaacgccgtgcttcgatgatgctgacacgtgagctgaaacgcaggggagtgaacgtgatcgcacgcaccgcggtggaccgtgtcgacactggcgcgaacctaggggccactgtgcactatcggcagggcgattccgatgaggaccgcaccgcttacggcgaagtggtgcttgccgccatcggacgtgtgcccaataccgacgccgactggttccgctccagcggcctgaagctcgacgaacgaggatacgtgaccgtcgacggatacggacggacgaaccttgatggcgtgtgggcgctgggagacatcactccaggtcatgcgctggcccaccgcgcctttgaacaaggcatcaccatcgctgagaaaatcgccggagccgatccaaaacccgtgattgacgacaccgtgccacaggtggtgttctctttccccgaagcagcaagcgtcggattgacgctcgaccaggcaaaagcgcgcgaagacgtggtcgagccgaaggagacggcatacccgatgctgtccaacgcgcgcatgctgatgagcggggaaggcggatcgatgaccgtcgtcagcggtgcgtttgcgaacaatcctgatatgcaggtggtgttgggcgtgcacatcgtcagcccaatcgccagtgatttgatagcggaagccgaacagttggtcggcaaccgtgtcccgcttgccgatgcggcacggctcatccacccgcatcccacgttcagcgagacgctcggtgaggcgttgctgaaagcggacggacgcccgctgcatacgagataggcggagtagaatagcgcagtcgcaccataaatggcatggttcctgatagactatcgtcccagtgtgtgtaaccgaaccgtcaagcgaggaagtcgatggcagataaagcagagaaaaagaagcagaagaagcaaggcaccatcaaccagatcatccagatcttcaaatacacccaagctgaggataaggcgcttccgtggctgtgcggtggcgtgttcgtggcaccgattatcgtgttcgtcgtactgggcgtcatattcaagtggcatgtgttcagctggatcctgttcatgattcttgccgtcatgctgggcgtgctgttcgccaccatgatgctcaccaagcgtgccgacaaggtcggctacgccaagatcgaaggtcgtcccggtgccgcagtaagcgtgctcggcaacatcagcaaggccggcttcaacttcccccaggaaccggtgtggattgacccgaagaccaaggacgccatctggcgcggtaccggttacaacggcatctatctgctgggcgaaggcgattacaatcgcgtcaagcgagccatggatcgtcaggagcagcgcatcaagggcgtgaccgccggctctgaaatcccggtctaccgtatgtacgtcggcaccggcgcaaaccagacccgcctcaaggacgtgcgcaagacgctgctcaagttcaagagctaccagccgacccatcacaagaacaagctgatggccgccatccatccgaggactcgtttcgtgctcaccaagaccgagctcacggtgctcaacgagcgtctgcgtaccctgcagctgaagaacggcatgagcgtgccgaagggcgtcgacccgatgcatccgcagcgcgtgagccgtcgcgccatgcgcggccgctgacggtggaatcgcattattccgttgaaaaagctccaatcgcgtcgtgcgattggagcttttcctatattcgaagccatacgtgtccattaattgacacgccgctgaagggcatgacgcgaccgttcgtaacacttgaatccccatttttcgcgaaatcgcacttcgaatatgtcattacgaaacattctcgtaacccaaatggcgagtgagcgaaactcgcgaccatagactaatagcctgtaagtaacttattcgaaaggagcggtcccgtgactgcacttgaaaccaaggctgatgctgaggcccttatcaacaaggaaggcattgagtatgtctccgttcgcttcaccgatctgatcggtgttcagcagcacttcaccgtgccggcaagcgaattcctgaaggacgccttcaccgacggcatgccgttcgatggctcctccgtggaaggcttccaggccatcaacgagtccgatatgaagctggtgccggacgtttccaccgcattcatcgatccgttccgcaagcacaagaccctcgacgtggcattctccatcgtcgacccgctgaccgacgagccgtactcccgcgacccgcgtcaggttgccggcaaggccgaggcttacctgaagtccaccggcatcgccgataccgcttccttcgctccggaagccgagttcttcatcttcgacaaggtgcgtttcgagaacagcatgcagcgctccttctacgaggtggactccatcgaggctccgtggaactccggcattgacaccgaagatgacggcaccccgaacatcgccttcaagaaccgcgtcaagaagggctacttcccggttccgccgattgaccacacccaggacctgcgcgacgacatggtcgccaacctgcagaaggtcggcctgattctcgagcgttcccaccacgaggtggcaggcgctggccagcaggagatcaactaccgcttcaactccctgcagcatgcaggcgatgacctgatgaagtacaagtacgtcgtccacgagaccgctgccctcgctggcaaggccgctaccttcatgccgaagccgattgcaggcgacaacggtaccggcatgcactgccatcagtccctgtggaaggacggcaagccgctgttctacgatgagaagaactacggcggtctgtccgatctcgcccgctggtacatcggcggtctgatcaagcactcttcctctgtgctcgccttcaccaacccgtctctgaactcctaccaccgtctggttccgggcttcgaggctccggtcaacctggtgtactccgctcgtaaccgctccgccgccatccgtattccgctggccggcacctccccggctgcgaagcgtatcgagttccgcgctccggatccgtcctgcaacccgttcctcgccttctccgcacagctgatggcaggcctggacggcatcctgaaccacatcgaacctccggcaccggtcgacaaggacctgtacgaactgccgccggaagagcacgctggcatcaagcaggttccgagctccctggctgaggccatggacgcacttgaggaagatcacgacttcctcaccgcaggcgacgtcttcaccgacgacctgattgacacctggatcagcatcaagcgtggcgagattgaccaggctcgtctggccccgaccccgctggagtacgagctgtacttccacatctgacgggcataacccctgagccctactggcgactgggtttttaccctgtcagtatagctcaggtctagttatggtctagttgtattccgaaaacacgacccccgcacgactcgcaagagccatgcgggggtcgtgtcttttccgtttaccgcggccgttcggacaggccggcgatccagtcgtccaggtcgcgccgccggatacgctcggtcgacgaatgcaccgggcgatgaggttgtcgtgcttgatggccgtacgcactgctttcccgggtgatccggcgttgtcattttcttccttacggatgacgctttttcgcgcatggtcagggacatgacccctgacaaagtagcgtcgttctttcttcggcaacggtcacattgtgtctgctgatcccgcaatgcgtcgtttacgctcctatactcggccgtatgttgttccaagccggatctttgctactcgtcatcatcagcgtctacctgctcaaacgcatccatatcttctccgacaaatcctataaagtggttcagggactggtattcaacctcactctgccatgcgccatcatcatgagcttcgccacgaacaagcatccgatgagcctgctgtggcttgtcgtattcggcttatttgcctgcctgattccgttgttcgtcgtgtatttcggatcgcgcggcgacgagccacgctaccgtgcttatcagatgctcaacgcgtcgggactgaacatcggcgcgttttgcctgccggtggtgcagaccttcatggggccaagcgccggcctgccggtcatcatgcttgatatcggcaacgccatcattgccaccgctgcatccctgaccatcacccgttcgttgctgcacttggggagccccgccaagaatctgccgttgagccttaagatcaagaacatcgcgcacgatttctactcgtccatctcgtttgactgctacatgcttatgctggtattcatgtttgccgggtggagcgtcccacattggatcgtcacgcttatcacgccgttcgccaatgccaacgcgttcgctgcaatggccatgatcggcctgatgatggagattcccgacaatcacaaggaccgttcggaactgggcaaggtcatcgcatggcgtttcctgttcagcgtcctcatcgcattggccgcatggttcctgttgccgttggacgaacgtgtccgcgaaatcgtggtcttggccgcattcgccccggtgacgattttctctacgaaattcaccgactcgctgacgggcaatgccaagcttgccggcttctcattgaccgttaccgcggtcatcggattgacgatcatgacgattctgcacgccgttctgccggtcgcctgacttagacttgcgggcgtgcatgccgtccgttaggcctgatgtgtggcgatgatgtgttcgatttcggtcagattcgacgcgaaatagatgccgtgctgacgttcggacgtggagaagcccacgttgatcatccgctgcaggaacgccttcatatcatcgtagaaaccgttgaggttatagaagatgcacggttgggacagctgattcaggcagatcttcgacaccacttcgctgacttcctccaatgtgcccgtgccgccggggaaggcgatgaacacgtcgcccagttcgatcatgcgggtacggcgttccgtgatgtccggcacgatgaccagttcggttagtccctgatgcgccacgccttggtcggcgaacatctgcgcttcgatgccggtcacctcaccgccgtgcgccagcaccgtatcggctatcacagccatcaggccctcatccgagccgccatacacgagacggttgccattgccggcgatccatgcgcccaattcctcgacggccttcctgtacgacgggtcgttgccctcatgggctcccagatatacggtgatgttcatttatcgcctttccaacgtgattgccttgttcgatccgttgactgtcgtgccgacgattcggtaatgcctggtttcggtgatcttctcgccgccacggacaagataggtcactctttcggtgtccaggtcatcgatatgacgtacttgcgcgggactgccgtgcagcggcgcgtaaccgccgcgcgtgctcacctcgccgtccttcagaaaatggtagttgacgcatgagcggaaatagtatagggattcaatatagtcgaattcgctggatgccaccaccgcgttatccgcgtcgcaggccacggtgcgtgccgtccgcgcggtttgcggcgtggtctgctgttcgtagatgtagtttccttggaacgcgaagccgatggaaccgcctgcgagtaccgcgatcgacagcagccatgcgctccaacgacgcaggaagcgggtggctttgccgcaaaagcccccggcaccggtctcccgcgtgccaaggacgatgcgcgagcacagcaatcccaggaacatatagctgaacggggcgaatgggcacacgtagcggatggtgaagaatccataaggtgcggtaaacggttcgcggactgccgcgaaaaccagcagcagcgacaatgggacgaacgcgaaaaacgccagatgccgtgccgcgcgtccgctgtcggcgcgatcttcggcggccgccaccgacctggcagctgatggttccatgccggaccggaccgtggacccggccgtatcgcgcaaacgcgacgatcctgcgatcaacaccgccaacattgccagaagcgccacggtcatccccgaagtcaagcgtttggcatcgaagccggtcgtgagaatggaaaacaccgaagtgagttcactcagattcatggtctccttcaacgggggcaaagccgaggaggcgaactggccgaccgcggaaggaatccatggaatgtacagcgccacggcgagcgcgtagggaatcagcatgcgtgggaaacgacgcgcatggccatgacggcgtaacgcgacgtacagccataacacgtgtgtcatccacacgaatgccatcatgtattgcgagtacatgcccaacgccaccactatggcgtaggcgatccaccatcgtcgatcggcaatcctgcgaagggccgtcgaacctcgtcccgaccgacgccgatccggacgcatcccatcctcgcgcatcgcgcgcagcagcagatacgtgcccagcacggacaggaacgggatcaacgaatacatgcgaatctcatacccgtaccgaagcatcagcggcgcgaacatcacaaacggcgaagccaacagggcatggcgctcgcaggccatgaaacggagcagaaccatcgacatcagaacagtcaacccgcagaacactcagctcatcgcacgcaatgccatgacatccgagccgaacaccgaaatccacatgcgcagcagcagataatagagcggcggatgcacgtcgaccttcagcagatccatcattcgggcgaatggctggctctccacaatgagcgtatacccctcgtcgaaccagatggaacggccgacgcccagcgcgaacgacccgcaggctgcggcgatcgcgcataccgccgtgacacaggcaaaacgatgcttcgaaacggattgtcctatcgacatggtgtggtttcccttttcattgtccaaacatatggtggaacgtcggtccttgagaatgccatggccatggtcggaatcggcgtatcccatcattcccatgccgcatggcgtatgcggcatgtcagcgcatcaccagaccgccgtcgacatgcagggtctgtcccgtgatgaacgcggcatcgtctcccgcgagcatggccacggcgccggcgatgtcctcggcggtggcgagccttccaagcggcgtggaggcgatgatgcgctcgcgcatgtcctcggtggtggcccgactcgaatcggtgcccacggtcagtccggccgcgatggcgttcacggtcacgccccaagcgcccgcctcctgcgccaaggaccgggtgaagcccaccaacgcgcctttggccgcggtgtaatcgtgataaggcacgatgggggagtcgacgaggttgctggatatgttgatgatgcgtccgccggcctgacgtcgcatctgcggcagcacggcctcgcaggtgttgtacgcgcctttgagacagccttcgagctgcgccgcgtaatcggaccatccgatcgagccgaaggttttgcggttgcgcggatcgaacgagtaatgcgcgaacgcgttgttgacgagaatgtcgagaccgccgaacgtggtgaccgtggtggacaccatgccgcgcacctgctcggcgtcggtgacatccgccttgcatgtgatcacgcgaccggccgcatcgcaatcgtccatgatccgttgcgcgcactgccgggcacgctcgtcgttgctgacataatcgatgaccacgcacgctcccgcacgcgtcagacggcgtgcgatcgccgctccgatgccacggcttgcgccagtgaccaccgccacacgtccggcaagcggcgcgttttcagactgctgcataatgaggatttcctttcgattcggaaaaacgtttcgtaagaattcgcgcgatcattcgacgtccatgtcgaagccgtcgcaatacgtgtcggtattgcgttcgatatcgacggcatgcaccagatcaagcagattgaagccgccgtcgtgatgccagccggatttcgcgcgattcatctcgcctaccgggcagatgcggtcgatgccggtctcgccgacgcgttgcgccacgtcgaacagccggtccggagcgagcgccacaccgcaggtctgcaaccattgcgcgtaagggcgcagcgtgggcagcgcgtcctcgacatggtccaccgccacgatgttgacggtgcggttcagtggtgtggacagcgagtcggccatgccgatggacggatagtacagcaccgtccagtcggtgcccgaacgcgactgcaccacgaacgggtcgtcggacggcgcatcatccgcgttgccggccgcggcggccatcgggccggcgcccagcatcagcgctttcatctgcgcggtggaacgcaaccgctgaatcgccatggactcctcttcggacggtgtggaacggggatatttgcgctgctgcccgtccaattcgctggcaagcagttcggcgacctgcgccggagacatcgcgccgccacgttccacgaacatggtttgcggcgccagacagctttgctggtcgtatgtggccacgtcgatcgccatacgatgcacggtgccggcatacagatcggcgcgaagcgcctcgcggccgatcagcgagaagccgattttcgcgccgtagctgaggaaaggctttccggcacgcacgcgcgggcgaatcgcctcggtggtgtgcgacgaaccgtacgcgaccaccgcatccgcctcgccaatcgcggcatcctccaaatccacggtgccgccacgccaaggcacaatcgccaaagcgtccgccatatcggggtcgacgcttgccagggaacgggcgaacagcaccggcatcagcggctcgtcgaacgacgatttgccgagaatcgcgcttttcgtcagcagacccatcgtcatgctccacactggaatgcccggcacattgctggaaaacacgtggaacgacaattccggaccgtacagccgcgtgtatccgcccgaacggttcgggcgatactcgtcaagcatctgcgggcaattcaactcgtcatccacgaaacgcagcagctcacgccgacggaacatgcgcatgtaccgcttcaattcgatacgcaccatggacgcgtcatagccggtgaccgcgggaatgagccgctccgcaagccgacgttccggatattccggatccgtccacaattctacggcgcgcgcgatcacgtcgacgatcccgtccgtggaataccgcgccagtttctcggcgcgatgccgccgcaccgacgccgccagcgcatgcacggcatcggcgtcgagacgggggaaacgcaacgtcgccgtgccgccatcggacgccgtgacgttgcgtgtgtcgaaatcatggaactcgaaatcccgcggcgcgtggaaaatgtcgacgtcgctcatgcgttggccgccatcacctcgtcgacggtgatcgaacagccacgcgcctcggcgcccttcgcacgaccgttcagcacatagccatgttcggtgcgcacacccagatcctccgtcagaatagccaggcacgaattccaattcgccagatcataatgcgcgatcacaccctgctcgccatcggcgaccggcgtaagcgaagccggatcgaggaacaccgaacgcacccacgacggcgtggctttgagataattcgacgaaccatccgtgtaataggacaggatgttctgatcgtagatctgcgaactcaactccgtcatgccatacatgttcacgcaatgcgagcgcttcacgccgaacactcgttcgaacgccgcatacaggtcgtcgaccgtcatgtcggtgcgcgtgcttttgaaaccgcccgtatcgaacacgcgggaatcggcggccagagcgtaggtcttgccctgcttgtccagataatccagcagatacaggtaggcggaggaggcgcccataagcatcaccggttcgccgtcggccgcggcctcgtcgaggaagcgctcgacgcccgtgaaatcaaggccatcctcatggaagaagaagccgctgccttcggcgccgcactgctccacggcgcgggtcagatatcgggacagcgacgaatgctcgttcatgtcccatgcgggggagaggaccgcgatgcggatgcgctcgcggtcgggcatgatgaaatgcctgaacggcacgatcatcgactcgtcccacacctgcaggtcggggtggaagttgcgcccgcgttgaccgggatgcgtggtaccgctggtggtgaacaccgcttcgcaatcctgttcgggcacggaggtgagcgtcagcattttgaagccgtccaccggcatggggggaatctgcatccagttggcgagcgtctgcggcgtcacgcgtttggacatgcagtaggcgcggtatgggaggttgcgctcgaattgaaaggcgaagatatgcttcgccagcgtgtcgaacgcctcatcgggcgccttgccgcagccgtattgtgcgatgaagtcgagcacctcccgtttgatggtttccttcgtctcgtcgatgttcgtggattcctgcgattgccccatgctcatgccatgtcctttccgtcgtatggttgtcggattattcggatgctttcgattattccgcttgtttcgtccgctcgtctgcgtgtcgtgcgataaagttcggcaggtcgatgatgagggccttgagaatcacgacgctgaacgcgccgaccagaatcgaattcgagaagaacacgtgcgctccttcttcaagaccgctcaacgcgttcggcagggcgatgccaagcagcagggaaaggccgatcaccacttgggtgcggtcgtcgctttccaccttgtgcagcgtgttgaagccggtgctgatgaggcttgcggcggccggcaggaagatgccgccgatcacgggggatgggatgagcgacagcgctgcgcccgccttcggaatgaaaccaagcaccacgaacaccacgccggcaatgatcaccggcacgcgggtgcgggtcttgccttcgtcggtgactttgagcagcgccacgttctgcggatacgcggtggtggtgaaaccgccgatcagcgaggagatcgccgaaccggcggcctctccggcaagaccgtaacgcacctggcggtcctggagcttcgtgccttggatctccgtggccgcctgatacacgccgagggcttccatgatggccaccagataggcgatgaagaacggtacgaaaatcgccgcgttgaaatcgaaaccgccatacggcatgaacttgggcaggccgagccacggcttggaggccaccgcggagaagtcggccatgccgaacgccagagacagcgcggtgcccacgaccagtgagatcagatacgacagagccttcaccatgcccttgccgaactgggaaagcaccaccaccagcacgcaggtgatgatggagacggccagcgtcttcggatcggcgaagcccttgtctcccggcgcgccgccaaggaactcgctcaatgtgaatcccgacagggagacgccgacgaggaagatgatcacgcccgatacgatcggggcgaacaggaaccgcagcttctcgatcacacgcgtcaggcacagcaccaggaaaatcagcgagctgatgaagatggacgtgccggccgcggcaagtgatccggcggtgccggcggcgatcatcagcgcgtcgaacgccgcggaaggaccctgaacgatgggcaggcgcaccagtttcgtggcctggataagcgtgaccaggccggagacgatgaaaatggcgttcaccatgttcgacgacaatgccaacggcagaccgatggcgcccgccacgaacaccggatcaagccacacgtttgatacgagcacatgctgcaatcccagcagggcgttcttcggcgtgaccttcttttcggctgacgaaccggcttccgccacgctcgtttcggttttctttctggttgcggcatcgccgtgcgtctgcgtctgcgtcgatggcttttcgttggccatggtgtcccttctcgacttccattgggtgccgaaatacaacggagatcgtctttacgggacgcgacgcgttttgccggtactgttcctacgcaagcattaccttgatcaggtcaagggtccgggcggtcgcccgtctcagccgtattcggcaccccctgtacttcgacgcgcccaatcataacgccaccgtccaaccgaaacaggaaaaaatacggcatgcgtgtccgttgcatggggacgcatgccgtatttcttttcgagaagctgccgacgcttatctgcgacgcctgatgggagccagctcgaacacctcgtcggacgtcttggccacttccggactgtgcgtcacaatgatgacgcaacggtgctcgtcatgcgccaacatacggaagatgcccatgatgtcgtcctgcgtggccggatcgagattgccggtcggctcgtccgcgacgatgatggaaggaccatagcttaacgcgcgggtgatcaccacacgctgctgttcgccgccggacaggtgcagaatccgctcgtttgcgtattccttcggcagatgcacctgtttgagcaattcttcgacgattgctttcttcggcttgtcgaacgatttgccggacgcgtccatcgacaggatgatgttctccgcgaccgtaaggttcggcagcaggttgaagctttggaagatcacgccgatgtcatggctgcgaaaacggtatcggtctcgttccgacaggtcggtgccgtcgaccagcaccatcccttccgtgggattcgccagtcccgagatcagtgatagcagcgtggttttgcctgctccggacggtcctgtgatggcatgcactttgctggcttggaaatcgtggctgatgtttttcagcacgcgtttgccgcctttggtgtaggcataactgacgttatccagctgcagcgtaggcgggtcggtctgctgcgattgtgcgccgttggtctcgacggcttcttttgcgattgccgtattggcggtattcgcggaattcgttgtcatgggaggtcctttccaggaaaaacgtgcgattggattgtcaggaacggtcggtgagcgatttggagatgatggcatcgccatcactgctcgcgtcatagccgaacaccttgcccttcaccatcgtgaagctgccattggaggcgttggcgacggcctcgtcgctggagaagccgattagggagaaatcgccgctgaccatgcccgcgccgtctttgctgcccgcgacgtcgcccatttgtccgtcggagccaccggactgttcatcctgacgggtgccgttatccgtaccggcggtatcagacgaatccttcatattggacgagccggacgagctggaggaatccgaaccggacgaatcggtgaccggctggaaatcgtcggtcgccgccaaccccgtggtctccatataatagtggatttcaccgcggatgaagccttcgcgtacttctgatagtcggcaagcgaaaactgcttgtcggccaaagcggaacgcatggcgtcgaagtcaggtttggcggaagcatcggacgaatcggaatccgacttggactgctcgcgcgattcggaaatgagtttgccgcgatcaaggctgatctgcgcggtggcggtggtgttatctaatccgctgcttcttgcggtggcagccgcctgccggatggataggccgattgtggcggcagcggcgatgatggtcacgatgacgatgatgagcatattgcgtcccttgttgcgggtgacgcttttccatgcgtttttgacgacgaacatggctgtttccttatgtgtttcgatagatatgagcgattgatggttccgcgccgctcgcgatcggcgtttatgctgatggtaaaagttgtatctggcatacaacagaaagacgctttgttcgcgctgggatgcggctggatgttttctggacgcctcgaaacatgacatggccgcgtcgccaaccgcttcgaaggtgttaggctaacgcgtatgcctatgaaatccgaagtcattgcaaacccaagggccgaacgcgtccgcagggtctccgaacttgccgacaggaaaggccgcaagcggtccggcaggttcatggtggaaggaccgcagtcggtacgtgaactgctctcctggcatcccgacatcgtcgaggatctgtatgtggaggtcgtctccgccgaaccggacgcggctttcatcacgcccaccgtggcgcagatggccggcaaggccatgcaggccggcgcttacgtgcacaaggtgacgcattccgtcatgcagcacatgagctccgacgcgcagggagtgctcgccgtcgccgacatgcgcgctttcctcgattccgccgtcattgatggcgatttcgacgaacgtacgatggtcgccgcgttctggcaggtgcgcgatccgggcaacgccggcaccgtgatccgttccgcggacgcggccggttgcgcgggcgtggtgctggtggacgactgcgtggacatcttcaacccgaaggtgattcgttccactgccggctcgctgttccatctgccggtcgtctccatgggcacggacgagtatttcgattggtgtgcggaacgcggactcgccgtgtacgccgccgacgtgtatggtaccgacgcacggccgccggaaccgcttacggacgtgcttgccgtgccgcagtcgcttgcacaggccaagacggtgctgttcggcaacgaggcgcgcgggctgacccaggatgtgttggaacgcgtcgacagaatcgtgtcgattcccatctacggcaaggcggaatcgctcaatctcggcaccagcgcggcggtgatgctgctgagcttggctatgtcgagtcatgttgaaagaatgtgaagtcgtaaaaacgttggaattgcgcgttttatgcgtaaaacaaacggttgataagaaaggtatctcgtggcagagggtgcggtattcgacgcccaagcggtaaccgatgcggttgccgagggcatcgcgaaaatcgaaaacgcctccacaatggaggaattgaaagccatcaagacgcagtacgccggagcggaatccgcgatgacgcaggccagcaaggccatcggcgcgttgccgaaggaccagaagaaagacgccggcaagctcatgggcaagcttcgcgccgacttcggtcgtgcgttcggcaccaaggaaaagcaagtcaaggccgaagaagaggcccgcgagcttgccgccgaaaccgtggatatgaccctgccggtcaaccgcaagccgcttggcgcccgccatccgctgccgaagctgatggaggatgtcgaggacttcttcatctccatgggctggcagatctccgacggtccggaagtggaaaccgaatggtatgacttcgacgcgctgaacttcggtccggaccatccggcacgccagatgcaggacaccttctacgtcaagggcaatcaggccaaggacgccgcgggcttcgtcggctccaacatggtgctgcgcacccagacttcgtccgatcaggtccgtggactcatcacccgtggcgtgccgctgtacatcgcctgcccgggccgtgtgttccgtaccgacgaacttgacgccacccacaccccggtgttccatcaggtggaggccctcgccgtggacaagcatctgaccatggccgatttgaagggcgtgctcgacaagcttgccgtggccatgttcggcccggaagccaaaacccgtctgcgtccgagctacttcccgttcaccgagccgagcgccgagctcgacctgtggttccccgacaagaagggcggcgccggttggcttgaatggggcggctgcggcatggtcaacccgaacgtgctgaagtctgcgggcctcgatcctgaggtctacaccggcttcgccttcggcgtcggcgtggaacgtaccctgctgctgcgccacgacatcaacgacatgcacgacctggtggaaggcgacgtgcgattcagcgaacagtttgtgatgggggagtgattgacccatgccaatggttgacattgattggctcaaggaccatgtcgaggttccggaaggccttacgtatgaacagcttgccaaggatctggtgaaggtcggcctcgaagaggaagagatccacacctcccaggtcaccggcccgattgtcgtcggctatgtggtcgacgccactccggaaccgcagaagaacggcaagatcatcaactggtgtcatgtggacgtcggcgacgaatacaacgagaccgatgaaaacggcaacaaggtgccacgcggcatcatctgcggagctccgaacatggcagccggcgagaaggttgtcgtgaccctgccgggcgccgtgctgccaggcgatttcaagatcgaaccgcgcaagacctacggccacatctccaacggcatgtgcgcctccgagcgcgagcttggtctgggtgataaccacgacggcatcatcctgctacgcaagtacggcttcaccccggaggaatacgaaaagctccagccgggcgatgacgccatacatctgctgcacctggaccagccgctgctggaaatcaacatcactccggatcgcggctacgcgttctcctaccgtggcgtggcccgcgaataccaccattccactggcgccgtctacactgatccggcaaccgccctcggcaagaaggcgcccgtcactcagggtctgccggaaggtgtcaagagcgacatcgaagtgatcgtcgacgacaagaatccgattcacggtgtggtcggctgcgatcgttactacgcgcgcgccgtgcgtggtttcgacccggcaagccacacgccgaactggatgcgccgccgcctaatccgcgcaggcatgcgctccatctctttggcggtggacgtcaccaattacgtgatgcttgatcttggccagccgatgcatgcctacgatctggacaagattgaaggaccgatcgtcgtgcgccgcgccaacgaaggtgagaagctcaccacattggacggcaaggatcatgacctgagcgtcgaagacctgctgatcaccgactcgccgaacggcgagcgtggctctcgtgtgcttggcatcgccggcgtgatgggcggcctgtatggcgaggtcactgctgaaactaagaacatcctgctggaatccgctcatttcgaccaggtgtcgatcgcgcgttctgcacgtcgtcacaagattccgtccgaagcgtcccgtcgtttcgagcgtggcgtggatgatcagctgcagccggctgccgcccagatggccgccgagcttctggtcaagtatggcaacggcgagccgagcgagcacccgactgattacaacactgtctgcaatcgtcgtccgattctgttcaaggcgtccgaagtggcccgcgtggcgggactggacactgacgtgaacaccatcagcgacattctcaccgatatcggctgcactgtggccggcggtggcaacggtgagttctccgtgactccgccgagctggcgtccggacctcaacgaaccgtgcgatctggtggaggaagtggcccgtctggtcggctacgatgagattccggtcaccgtgccgccggcaccggtcgaagccaaggtcggactgaccgccgagcagctgcgcaagcgccaggtggccgacgaactcgccgaatacggcatggtggagaccctgagctatccgttcgtgggcgacgaagactacaagaacttcgcacttgacgccgacgccaccaagaaggtcagcgtcgaaattgccaacccactggccggcgatcgcccgttcctgcgtcgcgacatcatcccgaccctcgcgcagaccgtgcagcgtaacctgcgccgtggcgtggaaaacgtgtcgctgtacgaaatcggacacgtctacctgtgggatccgaacgctccggccattccggcattgccgggtgccgtcaagccaaccgacgagcagttggccgcgcttgacgcaggcctgccggaccagccgatgcacgtcgccggcattctgaccggcaacgccgtcgactccggctggatgggcgatcgccgtgccgtggactggtccgacgcagttgaagccgtgcagcgtatttccgaccgcatcggcgcaaagctcacgttggaccagccgaaggctgaggacgtacccgcgcagtggcatccgggccgtgcggcacgtgtgatggcaggtgacacgttcgtcggcatggtcggcgagcttcacccgcatgtcaacgaggcgttgggcttcccggcccattccgccgcgttcgaactgaacctgaccgcgctgttcgccaccttgagcggcaagccggtgcaggccaagccgatttccaccttcccgccggtcaagcaggatctggccttcaccgtgtcgacggacgtcaccgccgccgaacttgagaagaccatcgtcgaagccgccggcaacagcttggagagcatcgacctgttcgacgtgtacaccggcgaccagctgggtgagggattgaagtccctcgcatacgccgtcacgttccgcgctgaggacaagacgctgacctccgaggacagcgaagccattcgcaagcgcatcgtggatgcggccgcgaagctgggcgcgcaactgcgtgcctgacacgtcaagtccatcgaagtaaccaaaaagataaagaggacgacatgaacgaaccggagcagaaccagccgatcaaccccgacgaagggcaggaggcggccggggctgctccggtttcgtcgtcttcgccgtcggaccagtcggcacagccggaattcggacagtacaaccagcctgaatatggcgcgatgtccaaccagtatccggcgaactacaatccatacatgtatggggctcccgaccagcccaagccggcggacgatgcacaacaaacggcgcagcggccgcagacgaatccgtatatgcagaacgggtatccggcgaatccatatgatgcatcgggacggcagcaatcaggccagcccaatggctatcagtatggaccaaatcaatacgggccaagccagtatgggccgaatccataccaacagcccggcatatatcccatcaacccgaatgatcccagccagaaccccctgtacggccattgggatagctatgcgatcatctcgttcgtgttcgcactattcctgccggtaccggtcatccctgcggtgatgggcgccatcgccatgtggcgtaccaaaaaactgcatatgaaaggctacgcgcttggcgtggcagcgctgattatcaacgtgctgtacaccattgcggtgatttggatgacggttcacggcatttccacagccgatttgtataaccagatgatgcagtacatgttcggtggcagtggacaaagtggtgattccagctcgatttccgcctgaaaccaatctttttatgttcgtctgaacggtcccgttatgggcggtgaccactatccgacacgattgaactgcataattatgcaatgtagtgcataaagtgtatgctgaatgtgtttcaacgagtcaaggaaaagagacgtgacatggccaaatacacggtagccgtggccggcgcgactggatacgcgggtggtgaggcgctgcgcatactcgcggcacacccgaatttcgaagtgacctgcgtcgccggacattcttcggtgggggacaagcttggcaagcatatgccgcacattccgcagttggcggacctcgtggtcgaggacaccacgccggaagtgctcaacggccatgacgtgatcatcctggcattgcctcatggcgcttccggagcattggcctcccagcttgacccgaatgccgtggtggtggatttgggcgcagaccaccgtcttgaggaaaagagcgcgtgggacgcgttctacggcggtgacttctaccagcattggacctacggcatgccggaactcatcaccggcgtcgcggctgacggctcctacagccgtcagcgtgaagcgcttcccggcaccaagcgcattgcgggaccgggctgcaacgtcactgcgaccacgctggctttgcaaccgggcattgcgcagggtcttgtcgaatcgaaagacatcgtggctgatttggtggtcggttattccggcgccggcaagaacctcaagcgcaccaatctgcttgcggctgaggcgtttggttccgcactgccgtattcggtaggcggtacgcaccgccacattccggagatcctgcagaacttcgcgcacgcggccggcaagagtgctgcggaggcagacgattacaccctcgccttcacgccgattctcgcgccgatggcgcgcggcattctcgccaccgtttccgccaaactcaccgataaggcgcttggcatgacggatgccgagatccgccaggtctggctggacgcatacgaaggccaggatttcatggtcgtgctgcctgaaggcgtaatgccggccaccgccaacatcatcggttctaacgcggcccacattcaagtggtcgtcgaccatcatgccggccgcctgctggcattcgcggccatcgacaacctcaaccgaggcaccgccgggcaggccgtgcagtcgctgaatgtggcattgggacttcctgaggatgcaggattgacgaagattggagtggcaccgtgagcgtaacgttcgcacaaggtttttccgcagctggcgtggcagctggcatttccgcggtcgaaggcaagaaggatctggctctcgtggtcaacaatggaccgcttgacgccgctgccggcgtgttcacctcgaaccgtttctgcgcggcccctgtgcagtggtcgaggaacatcgtatccgacggccatgtgaaggccgtgattctgaactccggcggcgccaacgcatgcaccggcaagccaggatacgagcagtccaaggccaccgctgaaaaggtcgccggcctcatcggcgccaaagccgaagacgtggccgtatgttccactggtctcatcggcgaattgctgccgctcgacaacgtgctgtccggcgcggacaaggcatttgaaacccttgccgataccgccgaagccggagccgatgcgtcgcacgccatcatgaccaccgacaccaagccgaaaaccgtcgagctggaaggttccaacggcttccgtatcggtggcatggtcaagggttccggcatgatcgccccgcagctggccaccatgctgtgcgtcatcaccaccgatgccgtcgtgaccgccggacagcttcaagccgccttgaacgccggagtcgaaatgtcgttcaaccgcatcgacgtggacggctgcatgtccaccaacgacaccgtgctgctgctggcttccggcgcgtccggcatcgaaccggacccggacgagttcaacgagcttgtggccaaggccaccgcctcgctcgcccgccagatcatcggcgacggcgaaggcgcaagccatgacatccgtgtcaaagttaccggcgcgaccaccgaagaagccgctctggcatgcggccgcgcggtcgcagcgtccaatctgctcaaatgcgccatctccggcaacgatccgaactggggccgcatcgtcagctccctcggcaccgtgccgcccgacgtcgcaccatacgattccgaaaaggtcacggtggacgtcaacggcgtacgcatctgcgaaaacggcggagccggacgcgaccgctccgaagtggacatgaccccacgcgaggtgcacatcgacatcgacctgaacgccggagaagcggaagcgaccgtctggaccgacgatctgacccacgaatacgtacacatcaacgctgactacgaaagctgatcgaataggaatggccaaagaactcaaaggacctggattccacttcgacgtgcacaccgacctgcgcgccgaccagaaggcggaagtgcttatcgaagcgctgccgtggctggaggaattcgccggacaacgcatcgtcatcaaatatggcggcaacgcgatgatcgacgatcatctgaaagcctgcttcgccgaagacatggtgttcctgcgccaggtgggactgcacccggtcgtggtgcacggtggcggtccgcagatatcccaaatgcttaaggccctgggtatcaagtccgaattcaagggcggattgcgtgtcaccactccggaagccatggatgtggtccgcatggtgctgaccggcaaggtgtcccgtgaactcgttggcctgatcaacgcgcacggtccattcgcggtcggcctgtccggcgaggacggcgccctgttctcggccatgcagcgcaaaccggtcattgacggcaagcccaccgatatcggcttggtcggcgacgtggtgagcgtcgacgcgtccgccgtggaggatctaatcaacgccggacgtattccggtggtttcctccgtggctccgaatgaagacgatgccactgaagtgctcaacgtgaacgccgactccgccgcggccgcccttgccgcggcccttggagccagcaagctggtcgtgttgaccgacgtcgacggtctgtatgccgattggccggaccgtgactccctgattggccgcatcggcgtggagaatctgcgcgatatgctccccgacctggaaagcggcatgcgtccgaagatggaagcctgcgtgcgcgccatcgacggaggcgttccgcgggcccatatcatcgacggtcgcaaaccgcattccatcctgaacgagatcttcaccaccgacggcatcggcaccatggtcgtgcccgaggacggtattgaaatgaggagttcctatggcaactgaacaactggaaacactcggcactgaagatgccaagtggctgggagagtactcccaggtgcatatgaacgtgtttggcacgcccctgcgcgtgatggaccacggtgagggcgcccacatctgggatgtcgacggcaatgaatatctcgatttccttgcaggcatcgccgtcaacgcgctcggatacgcccatccgaagtgggtgaaggccgtcagcgaacaggccgccaaggccgcgcatgtgagcaactacttcgccaccgaaccgcagatcaagctcgccgccaaactcgtcaagctcgcgggcgctccggaaggttcccgcgtctacttcggcaattccggcgcggaaggtaacgaggcggcgctgaagctcgccaagctctacgggcgcaccctgccgggcgcgttgcctgagatcggcggcaaaccggcacgcatcatctccatgacccacggcttccacggccgcaccatgggcgcgctgtccgcaacgtggaagcccgccatccgtgagaaattcgagccgctggtaccgaacatcgaattcgtcgaagccggcaacgtcgaagccttgcacgacgctttcgccgaaaccggccaaggcaagtacggcaaagggccggtcgcggccgtcatcatggagcttatccagggcgaggccggtgtgatgccgctcggagcggactatgtgaaggccgcccgcaaactatgcgacgaacataaggcgctcctcatcatcgacgaagtgcagaccggcatcggacgcaccggagcatggttcgccttccagcgtgaggatctttccggcggtgtgaccccggacatcgtcactttcgccaagggcgttggcggtggtttcccgatgggcggcatgatttccttcggcgccgaactgtccgcgctgttcaccccgggttcccacggctccactttcgcaggcaatccattgggcgcttcggcggcattggcaacgctgggagtcatcgaagaggacaacctcgtggacaacgccgaagaacgcggcaagcagctgcgcgacggtatcgcctcctgcggtaatccgctgttcgtctccgtgcgtggccgtggcctgctcgacgccatcgaacttgcccacccctgctcgcatgcggccatgaactgggctttggaacacggtctcatcgtcaatgcggtggctccgaatgcgttgcgtctcgccccgccgctggtcatcactgctcaggacgtcgatcaagcggtgtccatcctcgccaagattccgtccgacctgcctaacgactgatctcggacgaacccgaagaatttgaaaggagcctctataccaatggcaacccctgaactgcgccatatgctgcgcgatgacgatctgaaccacgaagaacagaagcaggtgctggaactggccatcaagttccacaagaaccgtttctatcaccagccgttcgctggcccgcagggcatcgccgtgattttcgacaagcccagtacccgtacccgctccagcttctccattggcgtggccgaactcggtggctatccgctggtcattgacaagtccggctcccagctgggccgtggcgaaccggtggccgacacggctcgcgtgcttgaccgtatggcctacggcgtggtgtggcgcacctttggtcaggaccgtgttgaggaaatggccaagtactccacccatccggtggtgaacgcactgaccgacgaattccatccgtgccagattcttgctgacttccagaccatctcggaacatcgcggcggtgtagacaacctcaagaaccagaccatcgcctatcttggcgacgcggccaacaacatgtccaactcctacctgctcggcggcgctgtggcgggcatgaacgtgcgtgtggcaggaccgtacggatacctgccggatccgcagatcgttgccgatgccgaagcgattgcctctgagaccggcggctccatcctcgtcactactgatccgaatgaggctgttgccggagccgattgcgtcttcaccgacacgtgggtctccatgggcgaggaagcggaatacgctgtccgttccaagccgttctgggattaccaggtgaacgccgaactcatggccaaggccaaggacgacgccatcttccagcactgcctgcctgcatatcgcggcaaggaggtcaccgccgaggttatcgatggtcctcagtccgtggtttgggatgaggcaggcaaccgtctgcacgcccagaaggcgttgctgacctggttggccggcaaggcccgtggcgatgaaagcctgctggtctgatgactgaccacactcccgcgttgcagcgtcctgccacacgaaccgctcgactgagcgccattgagcaggcgctgctgacgcgcatcgtcacctcgcaatcgcaactgtcgcagattctcgccgaccagggcatcgaggtgacgcaggccacgctgagccgtgatctcgatgagattcacgccacgaagacccgtcttgccgacggaaccgtggcctacgccgtcggcaaacagaacattgatgaacatccggtttctaacccggacgccaaaaccgagcagcagattagccgggtactgtccggactggtcacatccgtggccgcggcacgtaatctcgtggtcgtgcacacgccatccggcgccgcgcaatatgtggccagcgtcatcgataagcagcccatcgaaggcgtgcttggcaccatcgccggagatgacacggtcatggttatctgctccgaggatgatgtcgccaaacggcgtgcgcaatggctgcttgatgtcgcttccaaagcgtgaatagccatatagtggacacgacgcaccaaatatgcataaatatacagagctgtgcatatactgatgaataacgttggatgttagaaagggaaaccatgagcgatcagaatcgtctcgtcctggcgtactccggtggtcttgacacctccgtcgccatttcgtatctgaaggaacgcaccggcaaggatgttgtggccgtgtccctcgacgtcggccagggcggcgaaagcctcgaaaccatcaagcagcgcgcgctggcatgcggtgcggtcgaagcctacgtggtcgatgcccgtgatgaattcgccaacgaatactgcatgaaggccctgaaggccaacgccatgtacgaaggcgtgtacccgctggtctccgccatctcccgtccgctgatttccaagcatcttgtgcgagccgcccaccagttcggcgctgacaccatttcccacggctgcaccggcaagggcaacgaccaggttcgtttcgaggtctccatcgcctccatcgacccgacgctgaaggccatcagcccgattcgcgacctgtctctgacccgcgacgtcgagatcgccttcgccaaggaacacaagctgccgatcgtgcagaccgagaagagcccgttctccatcgaccagaacgtgtggggccgtgccatcgagaccggtttccttgaggatccgtggaacggtccgaccaaggactgctattcctacaccgacgatccggcgttcccaccggtcgaggatgaggtcgtcatcgaattcaagcagggcgtcccggtcaagatcgacggccatgacgtcactccgctgcaggccatcgaagagatgaaccgtcgtgcaggcgcgcagggcatcggccgcatcgatctgatcgaggatcgtctggtaggcatcaagtcccgcgagctgtacgaggctccgggcgcagtggcgctgatcaccgcccaccaggagctcgagaactgctgcctcgaacgcgagcagcaccgcatcaagcgcgacatcgacaagcgttgggcggaactggtctacgacgcgcagtggttctccccggcaacccagtccctgaacgccttcatcgaagacacccagaagtacgtttccggcgagattcgcatggttctgcacggtggccgcgccgtcgtgaccggccgtcgctccgacagctcgctgtacgactacaacctggccacctacgattccggcgacagcttcgaccagaagtcctccaacggcttcatcgacatctatggtctgccgagccgtgtggccgcagcccgcgacgtcaagttcggcaacggcatcgaggttccggagaacagcgtcgagtaagcatcatccggattcacgttgtgaatcgtcttgataatgggggagagcgtaccgtcgggaccatcctgactggtaagctctccctcagtcatatctgcaaggagatttggaaaaacaatgaccgagagcactactaatggtgagcatcttgccctgtggggcggccgtttcaagtctggtccgtcgccggaactcgcacggctgagcaagtccacccaattcgactggcgactcgccgatgacgatatcgccggttcgcgtgcccatgcccgtgcattgggccgcgccggactgctgaccgccgatgagctgcagcgcatggaagacgcccttgacgagctgcagcgccgcgtggattccggagcgttcgctccgatcgaggatgacgaggacgaggccactgcactcgaacgcggtctactccagatcgcaggtgacgaactcggcggcaagctccgcgccggccgttcccgcaacgatcagatcgccgcgctcatccgcatgtggctgcgccgccacagccgcatcatcgccaaaatgctgctcggtctcgccgcaacactgatcgagcagtccgaaaaagccggtcgcaccgtcatgccgggacgtacgcatatgcagcacgcccagccagttctgcttgcccaccagctcatggcccacgtgtggccgctgctgcgtgacgtggaacgtctcgccgattgggataagcgcatcgacgccagcccgtacggctccggtgccctcgccggcaacacccttggcctcgaaccggtggctgtggcccgtgagctgggcttctccaaggtgaccgccaactccatcgacggcaccgccagccgtgatctggtcgccgaattcgccttcatcgccgccatgaccggtgtcgatctgagccgcctgtccgaagagatcatcatctggaacacccaggaattcgcgttcgtgcgtcttgatgacgcctactccaccggctcgtccatcatgccgcagaagaagaatccggacatcgccgaactcactcgcggcaagtccggacgactcatcggcgacctgactggcctgctcgccaccttgaaaggcctgccgacagcctacgcgcgcgacctgcaggaagacaaggaagccgtattcgaccaagtggacacgcttgaagtgctgctgccggcattcaccggcatggtcgccaccatggtcttcgacaaggaacgcctcgaagccgaagccccgaccggtttcgccctcgccaccgacatcgccgaatggctcgtcaagaacggtgtgccgttccgtcacgcgcacgagctttccggcgcatgcgtcaagattgccgaagacctcggccaggagctgtgggatttgaccgacgaggacttcatcaacgtgttcaaggacttcctgccggcggacaaggccccgcaggtgcgtgaagtgctgtccaccgaaggctccgtctccgcccgcaacggcaagggaggcacctccccgctgcgcgtgcgcgaacagatcgtttccgccaagaccaccatcgagcagctacgcgccttcgccaactccgtgtccgacggttccgcatacaagtcgcccgaatccctgctcaagtaatccctatcaagcaaggagcaaaaagcggtgctgttgacgcgcacgcagatacgacggctggtctacgcgcacggccgggagattctggaacatgaccacatggccatcgaaagggtctgctaccagcatggcgtggtcaccacattcgcccattccattcgtgtggcttgtctgtccgtctggctggcagacagactgcacctgtggaatagggttgatctacattcgttgattcgcgccgctttgctccatgattacttcctttacgattggcatgactgggacaacggcacccatcggctacacggattcacacatggtgaaacggccatgcgcaacgccatacgggatttcaaactcaaccagatcgaacgggacagcatcgaacatcacatgttcccattgactccctatccgccgaagtacatcgaaggataccttgtcaccgcggccgacaaaatcagcgccacgaaggaaacgctctctttcgatcgtttcgacaaacccgcatccggacaaccgatggacaggagctgatggctgtggcgctcacactcgaatatttgttcctttggttcctgttgtacgcctttatcggatgggtgtacgagtcggttctcgtgtccgtttcggaacgtcgatgggtcaaccgtggtttccttaacgggccgttgtgcccaatttacggatgcggcgcggtgcttgcgatcgtgctgttgcatgacttcacgaatcccatcgagattttccttatctcctcatttggcgcgagcatactcgagtacatcacctcttggggcatggaaaagctgttccacgccagatggtgggattacagccattaccgattcaacatccaaggccgcatctgtctgctcggcgcaatcgtattcggattcggcggagtattgatcatcgatgtggtccagccgcaggtcgaacggctcaccgccatgattccgctgcttgccgtgcacgtgatatgcgcggtcgccgccatcgtcgttatcatcgacaccatcgtcaccgtggtgggcatcgtcggcctgtccgagcgtctcgccaaattcagcgaagcggtgcaggatcgtgcggagaaggccggagactcctggcagtggggcaaagaggagttccgggaaaagatgcatgatttgtcggaatcgtcgcaggaacgtgtcgccaatatgcgtcagcttgtctcttccgcgttgaattggcagcaacgtcgtatgatccgctccttcccacgcatgcgttccacggactccaccaaatacagcaagatcatggaaaccgtgcgtgagatgctgcgccgaaagtaagtttccaccggccacacgtgtcgtatagcatgtgtccaaaaacgatttgccccgccaacctgcgttgcgcacgctgacgggcaaaatccctttatgcatcacatcggataggggctacgacacttgcgatgtggccgaccccttgtaatcggtgatgccggcaccaatgttcggatgctgcgccgaatacgcctggtccacacagtagaacgccagaagcacgacggccacaacggtgagctttcttgtatcgatacgactcagcaagttgtccaatgcaggagccagcagatacacaatcgccaaaccgcccaaaccaaacgtcagcagaccctcggcacagatacgaccattgagattgagaaaataaccggtgtaatcccaccagcgttgtcctccgtgggtcttctccagataccaggacgagaagtactccaacccgccacacaagaccatggcggccaggaactcgaacaagggcttcttcctcaacttcttcagcagaataaggataatcactccgccggtgccatagatcggcagccatggcccatgcagcgtgccacgattcacgaacgttccttcggaaatgaaggcgaggctcacctcccatacccatcccacgaaacagaagatgaagaacatcatgaccagattgaccaacgaatagctgcgatcggagctgacggtgcgggattcgcggaaccggaacgccatcggcgccggagccagacgaccaggatagatagcgccgtccagaatctccctgccggtatcgatctggtgcagttgctcgcgatactcctcatacttggtcaccgaccgcgcatgcaggatacgcacgcccaaccattcggacaggaacccgacgaaaccgtttggcttgtccactggaacaagattgctggacaactgctccaccgtttcggcaacatcaccatacgcggcatgcaatgtctcagcggaggccttgctgtacaggtattcgtcgctgagcagctcgcttccctccaatcccgaatccttggacaatccgcgcacatgcacgtaatattcgacgaaaaacgccgcgttatagccgttggaatagaagatgccgctcaagccgagcgtgaacagattgagcagccaccagccaaggaacgacaggtcggccacgaaacactcccacttgtgacccttcatcatgcgcctggacaggctgatggcctcccgtgccccgatattcggattttcggcgacgatgtagggcaccatacggtaggaatacggtttgatgaacgcgccgatgatggtgaacgtccacaggaacaggaacacgttctcgagcagcatcaccttcgccatcgacaaccatttgcgcgtggtgatcgggtagagaaaacggctcacgggaagtttgtcgtaggtccgcccctcaagcagcatgcgcatcatgaccacccggtatgtctgctggacgaacagccatacgaaaaggtaaacggccagggatacgacgattggtacggccacggcgacgccgtcattatgcacgatggaattggccgcatcggccatcgacagaatgaccgaacccgatgagaacgagttgagcagagacgcgaacacgccgcgtttacgccccatcatggcattggtgtcgttttgcacgatctgctcctgattgtgctccacttgcctgcgtgcctggctttcatcgccgacaagcaggttctccaacactttcgacacgttgtcggattgcgctgtgccatcctcctgcacggttgcggacggggaactggcgttcaccgaccatgtcgacgaactgtaggcgacaccgaacaccgaagcgaacaggcagatgacgactatcatccaatagtgtctcttataggctttccttgcattggccttcatgcctttgcgatccatgcaggcctcccttcttctcgtcaatgagattccgttttcgattttaaccggcatgttccgtgatcgctttgataaaaacatggaaaacggcacacgcggctgtctgtgtcttctgcgaaactgtagggtgcgtaaaacgcggtaatgtccacaattcgatagggagaaagcacagttatggctcacgtcatcgatttcaaggaggccggtttcgattccgtcctcgatgaactggaatggcgcgggttgatttcccagtccactgacagggatcgactcgccgaagcgttgaacggagagcccatcacctattattgcggcttcgatccgaccgccgcctccctgcacatcggcaacctcgttcagctcatcaacatgcgccacctgcaggccgcaggacaccatccgatcgcgttggtcggcggcgccaccggcctgatcggagatccgcgccagtcgggcgaacgtacgctcaacccgaaggacgtcgtggccggctgggccgatcgtctgaagaagcagatcggcggcatcctcgagaccgaaggcagcaatccggtacgtttcgtgtccaactacgattggaccgcttcgatgaacgtcatcgacttcctgcgtgacgtcggcaagaatttccgtatgggcaccatgctcgccaaggacaccgtggcccgtcgcctcaactccgaggaaggcatctccttcactgagttcagctatcaggtgctgcagggcaacgacttcctgcacctgttcgacgagtaccattgcgtgctggagatcggcggctccgaccagtggggcaacctcacctccggtctggatctgatccacaaggtgcgcggcgtggacgtgaacgtgttcaccagcccgatcatcaccgacgcgcagggcaagaagttcggcaagtccgaaggcaacgccgtctggttggatggcacgatgcttagcccctacaagttctaccagttctggttcaaccgtcccgacagcgagatggagaacctgctcaaggcgttcaccttcctgccaaaggccgaaatcgaacggcttatcgagggaagcaagaccaatccgggcgcgcgtgaggcgcagcgcaccctcgcatgggaggtcaccagcttcgtgcatggcgaggaagccactcgccaggccatcgaagctgccggcgcgttgttcggacgtggcggcgatctggcggacatcgatgagtccacgcttgaggccgctatcgacggcatgaaggtcgatggggaattcgccaaggtcgcagccggcgaccgtgtggccgaggctggtatgaaggcaggcctgttcaagtcgatttccgaggcgcgcaagaccatcaagtccggtggcgtgtacctcaacaacacgcgcgtggaggatgaggaacagacgttgcaggaaggtgacttcctgcatggtcgtttcgtgctcatccgccgcggcaagaaggcgctcggcgtcgtcgaacaggcgtgagacgcataggcaatcgtaagtaaataatcgcaagtatctcaagaccaataaggaacagcatggcagaagaacagcgcggatcgcgcggcaagtcctacggcaaccacaagtcctacggctcgggcaggccgggtaaccgcggtggcaagggattcaagccgcgcggcaacggcggcaagtcctacggacacaagtccggcggcttccacaacgatgaccgtaagggcggatatcgcaagggcaatggcggcggataccgtcgtggcgaccgcgatttccatcgcgatggcgaaggcgaaggtcaggagcgtcgtttccacaacggtccgcgcaagttcaaccgcgatggcgagcgtcgtgacgaccgccgcggcggctatcgtggcaatcgcggcgacaatccgcgctaccagcgtgatggcgagcgttccggcttccgtcataatgaccgtcgtgacggcgatcgcagggatttccatcgtgacgaccgccatggtgatggcgagcgtcgcaatttccgtcatgacggtgaccgtcgtgacttccgccgtgacgatggtgagcgtcgtggcggccgcaatttccacaaggacggcgatcgcagggacttccgccgcgatgaccgccgcggggagcgccgtgatggcgagcgtcgtaatttccgtcgtgatgatcgtcgtgacggcgatcgcagggatttccgccgtgacaaccagcgtcgtgacttccacaaggatcgcgaccagcgtccggaaggcgaggagcgccgcgaattcacccgtgaagagaagatggagtaccgcgaggcgaagcgtggtgaatacctgtcgaagccacgtcgcaattccgacggcacgatgagcttcccgtcgcaaaacccgtacacgcatcgtcgcccgggcgagccgaagatgccgaagggcatcgagtggagcatgctgtccaccgatgaccgtgagcgtctgcgtggcctgtccaaagaacatgcggagaacatcggcctgcacatcctcgccgcctacacgcttgaggaaagggatccggagctggcgctcgaacacgccaagtgggtggcgcatcaggcttcccgtattgatttcgcgcgtgagacccttgcgttcgtggcctaccgtcagggcgattacaaactggccctgcgtgagttccgcaccgcgttccgcatgaacggtttccttgactatctgccgttcatcgccgactgcgagcgtggtatgggcgagccgaagaaggccatcgaaaccgccatgagcgatgacgcgaagtatctgcgcggcgaatccaaggccgagatgttcctcgtgtacgcgggcgcgctgggcgacctcgagctgtgggataaggccattgagatcgtgcatacgctgggccgttccaagggtctggccggcgaataccgcatgcgtgcggtgcaggccgaacagtacttcctcgagcaggccggacgctccgatgaggccgtggccctcgaccagctgcttgacaagcttgagctgcagtacgccgatgccgaagaggacgagacctccgacgatctggtcatcgaatacgacatgcaggaattgaacgacgagcttatggacaagctcggcatttccgaagatgacgcccagtatgcgccggaagacgaggatgaggacgattccgaggccgtcgacgagaacggcgagaccaacgatgagacccagcttgatgccgaagcggccaaggaaggcgccgagtccgacgacgagcctgccggtgacggcgaaaacgcgggcgactccgaagacgaccagactgaggatgaggtcgaatccgcagccgattccgacaacgagtgaggtgcggcaaaacaatgctgaaatccacaacccgtccgctgagcgaagcctaccagctggcgctgcttgatcttgacggcgtggtctaccgtggcaagaatccggtggaacatgctgcagagagcatccgcaaggccgaaggcctcggcatgacggtggaatacaccaccaacaattcctcccgactgcaatccgtggtggccgaccagcttaagggcttcgaccttgacgtcgaaccatggcaggtcatcacctcgtccgtggtggctgcccgtatggtggcccgtgcggtgccgcaaggtgcgaaagtgtttgtgctcggagcacagcatctgcgtgaggaagtcgccaagcagggtcttgaagtggttgattccgccgaagacaagccggtcgcggccatccaaggctggtacccggacatgtcttggaaccagatggcgcaaatcgcctacgccgtagaacagggcgccacgtatttcgtgaccaaccgcgacctgaccattccgcgtgagctgggcatcgcccccggttgcggttccatgatcatggccgtcatcaacgccactggtgtggaaccggtttcgtccgcaggcaagccggaatccgccatgtatgacgaagcccgactgcttgccgcgcatgatggtgccgaaccagtggccaaggaagcatgcctcgccatcggtgaccgtctcgataccgatatcgaagccggcaatcgtggcggctatgattccctggccgtgctgaccggcgtcaccaatccgcatgagctgatgttcgctccggagcatctgcgtccgacctacatcgccaaggacctgaccggacttaacgagccggcccccgaagtcgtgcatgaggctggcgcttggagctgccgcgacgtgcaggcgtgcgtcgacggcgatcgtctttacgtcaccgacatcaccagcgtcgacggtcttcgtgcggcctgcgccgccatgtgggatgcggcggatcgcggacacagcgtcgacggcatgatcgtgccggaattccgaatcgcctgattgccgcacgtgcgtatgcgcaacatgaatgacgattccggtgccgtcgtccgactcgacatcgcgctggtggagcgtggcgtcacggacagccgctccaaagcacaacggctgatcgaatccggcaaggtccgggtgaacggcatcgtcgcatccaaagcgtcgctcaaagtcacggccgccgacacgcttgatgccgatctgggagacgattacgtctcccgtggagcctacaagttggtcggcgcgttcgacatgttctcccagacgggcctgcgttccgcggaaggattcgattgcctcgacatcggcgcgtccaccggcggtttctgcgacgtgcttctgcgacgcggtgctgcgcatgtgatcgcgctcgacgtggggcacggccagcttgacccgcgcatcgcaggcaacgagcgcatcatcgaaatgagcggcgtcaacatccgcgacgtcgaagcggatgatctgccgtaccggccaagcatgatcgtatccgacgtgtcattcatctcgttgacatacgtgattcccgtcatcgcgcgcatcgccgcgcccggcgcacacgtcgtgctgctggtcaaaccgcagttcgaagtcggcaaaggcaacctcggcaaaaacggcatcgtggaaagcgaaaccttacgcaaacaggcgctcgacaccgtcaccgcctgcgcgaaagccaacggactggatgtacgcgccacggcggtctcaccgatcgaaggcacgcacggcaacatcgagtatctgctgtatgcagtggcgtaaaccgttctccgccaatcgatagcgtaaaaatgaaaggccggcggcccatatgaaaaatcccatatggaccgccggccttttgcatgttccgtgggcctagcccctcaaaaacttgtcgatctgatcctgcttgcccatgatgatgagctcgtcgttacggtgcataatcagctctttcgaaccgtattcgaattccttgcccggcgatttgacaccgaccacggtgatgccgaaccgttcatgtacgcgcgcatcctcgatggagtaaccgacgacatgcgggggagtgtggatcttcaccacgctgtacgcgccttcaagctcgatgtagtccagatagttgccggacaccaagtgccctacgcgtttgccggcatcggtctccgcgttgatgatgtgccgtgcgccgatacgctgcagaatgcgcgcatgctccttggacaccgacttcgcccaaatgtcggagatgcccgcgtccagcagattgccggcggtgatgacggacgcttcgacgctgtcgccgatggctacgaccgccgtgtcgaaatcggaggcgttgatctgctccaacgccatcacgtcggtcatgtcggcctgcacggtggggatctgcgacgaccagcggttcaccagttcgccgtccttgtcgacggcgagcacatcctgtcccatcgtatccaatgtggtggctacggaactgccgaaacggccgagtcctaccacaagaacgcttctggtgttgttagccatgattgttcgcgtacctttcgatgttctgttccggattcaagtataggaagttgcgggtatagaaaccgtatcgacgaatccgctcagccgaccacgatctgctcggtggggtagcggaccggctccacattgcgcggcctggagatcgcgtaggcgatggtgagcggaccgagcctgccgatgaacatggtcgcggcgagaatgtacaggaccgctggactagaagcgctggccacgccgaccgaatagcctcccagaccgaacgccgagcaggtgtcgaacagcgcgttgctcagcgagcatccggtgatggccatcaatgtcatggacactatggtgacgagtgccagacatgaggtggtgacggccacggccgtcatgacggcttgcgaatggatgcgacgatggaatgcgttgacgtcatggcgtccggtgaacgcggcgcggcaggtcaacagaatcacggcgaatgtggtgacgcggatgccgcctgcggtcgaagtgctgccgccgccgatgaacatgacgatggacaggaacaccttcgtcgcgtcgctcacgcccggcatccatgacaggtcgaagccggagctgcggggcatgacggccgccaccatcgcatgccacaaccgcggttccacgccttcggtggcgaacagcagtttgttgttccattccatgaggaggaaccaggtgaacgaggcgagcacgatgcagaacgtggtggtcagcgtgagcttggtatgcaggctccaacgcttcggcggacgatggttgcgccatgagcgcatgaggttaagcaggacgggaaagccgagcgtgccgcagaacgcgctgacgaggataggcaggccaacagcccaattgttgacatgcaggccggcgccgtcaggggtgaagccggcgttgttgtatgccatgaccgcgaagaacaacgattcccacagcgtgtgccgcacattgccatgattgactttgtacaggccggggaacagcgccacgaacgtgatgccttcgatggtgaacgcggtggcgatgaccacggtgagcacgcccttgatctcgccgagtttcgtggtgcccagctcgttggccgtcagcagcttttgcgtggccttgagatggtggttcacggccaaggcgatgagtgaagcgaacgtcatgacacccaagccgcccatctgcacggagaagatgagcacggcctggccgaaagcggaccaatgcgtcgtcgaattgacgatggagatgccacacgtcgaaatcgcggagatcgcggtgaagaacgcggtggtgaatgtcgtttgctcgcctttcggcgtggcggtgggcgtgagcaggagcagcgtggacaatgcgcccaacatcatgaagtacaggatggtcagacgtccgggatgtgtggtgagtctgtgcattaggctgcgcttgcgcggcttgcgctcctccgccatggccttctcgaacgtgtccccggagaaccaccaggcatagccatgtgaggcctcgcgattggaggaggactcgtcgaagacgaggttggacatgctgttcctcgctccttgtctgtataaacggtcttcgtttccttgagctattgtagacggtagtgtgacgaacggtgcagagacataccattcggcctgttcggcggattcgtgggaaaacgacgaacaggttttgcgggtgggatgtacgtggctcgtgaacgaacggaaacgtctgcggcgtgtccggacacccgctaccgccattcgttcatttgttcgattacaatggtaggcatcggcgtccgtcgaggacgtggtatgtacgagagttctcggaaagggcttgcgatgcacggtacccggcatgcggtggtagtgacgcatacacgtctgcgtgaaagcggcacggtggtcgaagaagccgtcgaacagctgcggcgcgccgatttcgaagtgacgatcatcgacaatatcgaagcgcccgatttcggcagcaagacgccagtagtgccgaaaaacacggaaatcgtggtcgtgcttggcggggacggtaccattctgcgcgcggccgaactggttcattgcactgaagtgcccatcctcggcgtgaacctagggcatgtcggctttcttgccgaatttgaaagcttccagatgagcgaggcgatccgtcggatcgccgaccacgactattccatcgacgaacgtatgatcgcccacgtcgacgtatggctgccgggcgcgacggaacccatcgaggactgggcgttgaacgacatcactttggaacgtgcggaccgtggcaagatggtggaattgtccatccgtgtcgacgacgtggagatgagctcattcggttgcgatggcgtgatcgtatccacgccgaccggttccaccgcctacgcgttttccgcgggcgggccgatcatgtggccgaatgtgaaagccttgcaattggtgccgttggcggcgcatgcgttgttcgcacgtccgctcatcatcggttccggctccacgttcgccatcgacattctcgaggattccacgtcggatggctggatctgctgcgacggccgtcgtcaacgcgcactgcccaaaggcacacgtgtcgaagtgcgtgaatcgaaatgcactttgcgattggctcgtttgtctggcgtgccgttcacgaaccggctcgtcaccaaatttgatttgcctgtcgtcggctggcgcgagcaggcgcgcaaaaccggtggcatacatcatgggcaatcgttccctagaaccggcaaaccggaaagcgggaagtgaccgggcatgctggaagagcttgagattcacaatctcggtccgattcgttccgctctgatcgccccggcaggtggtatgacggcgatcaccggtgagacgggagccggcaaatcgatgctgctcagtgcgatccgactgatttccggcggtccgtccgatggaggccgcgtttcggtgggcgctcaggaggcgtgggcgcagggtgtgttcgaagtcgcctcgtcgccggccgcggtggccgcggcacgggaagccggcttcgaaccggaggatggcgagctgtttctgtcgcgtaaagtgcccgcttccgggcgatcccgcagcatgctgtcgggacgtagcgtgccgcgttccgtactcgcctccgtcgccgccgaactggtgacgattcacggacaggccgaccaattgcgcatagcgactacctcacgtcagcgcgaattccttgaccgctatgcgggagacgaagtggctttggccgcctacggcaagtcgtggagcgcgttgcgcgcgatggacgagcggttggaacggctcaacagccaggaatcgtccatgcgacagcaggcggattatctgcgcgaatcaatcgaacgcatcaaccgtgtcgacccgcagccgggggagatggacgaattgcgtgcgcgccgcgaccgcatcgaaaacgcggccgagatcgccgaaggcgtgacgcgagcgttgggcgcgttggacgcctcgcaggtggtggacgatgtcgaatcgtccagcgcggccgatttgatcgaccatgcttcgcaggcgttgcgcgccatccatgtggaaggcgtgttctccgaactcgccgaccggctcgactccatcagcaccgatttgtccgacgtggtgttcagcctgtcgggagaagtggacaacgaagcgagtatggaggatttggacgccatcaacgggcgcatccacgagctggacgagctgacccgccgatgggggccggaattgtccgacgtgatcgcatggcgagacaaggccgtatacgatctggaggatctggacgcctccccggaaaaggtcgaacagctggaagccaaacgggcgcagttgcttaacgcggcgaaaaaagccgcgcaggctgtaagcaaacggcgcaggaccgcggccaaggagcttgcttccaaagtcaccgccgaacttgactcgctggccatgggcacttcgaaacttgagattcgcgtggccgaacgcgaacagttggacgccaccggagcggacgacatcgaattcctcttcaccccgttccccggctccccgcaactgccgatgggcaaaagcgcatccggcggcgagctgagccgtctgatgctcgcgctcgaattggtggccgctgaaaagcatgtcgtggccggcggaaccgtgccgccgatgacgttcatcttcgatgaggtcgacgccggcgtgggtggcaaggccgctgtggagctgggtgcccgcttggccaaactcgcccaatccgcgcaggttctggtcgtcacgcacctgccgcaggtcgcctcctgggcggacgaacagtatgtggttgccaaaggcgaaaccaaggatggttccatcgccaccaccatcagccaggtgcgcggggatgagcgcgtgcacgaaatcgcccgcatgctgtccggcagcgaaagcgaaacatctctggaacatgccgaggaactgctcaaatcgtcggtgcttgactgacggcggattcaatcgtaaaaagtaatcgcaaatcgcaaaagcggtaattgcaaaacaaaggagccgatatgacacaggaaaccaaggcgaaccaaggcaaaggcgccatcttcgaccttgacggcacgctactcgactccatgggcgtgtgggatcaggtggacgtcgacttccttgccaaacgcggcatcgaggtgccggacgactacatgcagaaggtcgcggccatgcaattccgccagatcgccgaatacacaatcgcacgattcggcctgtcggacactcccgaagcgttgatggaggagtgggaccatatggcacgtgtcatgtacgccacggtggttgaagccaaaccgtatgcgcgcgaatatctggaatcgttgaaggcgagcggcgcgaaactggccgtggccacgtcattgccgccgatgctgcgcgaaccggccatgaagcacgtcggcattttcgactatttcgatgacgtggtcagcgtcgacgatgctggcgacgtcggcaaaactgagccggacgtatatctgctggccgcgtcgcgtctcggcatcaaaccaagcgactgcaccgtattcgaggatctgctggtcggcatgcgctcggccaagtcggtcggcatgcatgtgtgggccatgcacgacgattcctccgacgccgactggcctgagatctgcgatctggccgacggcgtcatgttcgacttccacgacgcgcccgtcatactgtaacggtttgcatcatcgcctgatgtttccgggccattgcgtgattcgaccgcttcacgctttcatgacgccgatcaggtccatatcttgttgagcctcatgaagacgcggctcatgattgttccctatacgccttctcgaacatgccaagcagatcaagcaggctgatgtcggcggccttggcggcggttaccgtctgccggaacacgtccatgatgcgttcgcgcgcacgttccttcataagctcgttgccgtgggccagcacgaacgtgcctttgccctgcacattctcgacaagcccctcatccgccagctcgctgtacgctctggcgatggtgagcacgctgatgtgcagttccttggcaagcttcctgagggaggggagcgcctcgccggtttgcagttcgcccgacatgatcgccgctcggatctgatcttcgatctgttcgtaaatcggtttgccggacgcggatgagatgttcagcttcactgtatccctttctgcgagtgatatatatcctgaccgaacagtgtacgcaaactgttcaacagctatatataacagtaacacagatttggccatgctgttattatatgatctataacagcatggccgtaattgaaaaccttggtattccgccattctgaacagttagtgcctaccggctgcggtgcctgtccgttacttgtgcgacggatggatgagacggtggaaggacaggtagatcagccaagacaccggcagcgccagcatgaacaggggatagaaccatgcgatcggcaggtgcccatagagaactccagccagcaccggccccaacgccatacccaagtcgatgcccatatagtacgtgccgttggccaagccactgcgctcccggccggcgatcaccaccgcctgcgcctgcgtgacggaactcatcagtccataactggccgccatggcgatgcccgcgccaagcagataccaatcgttcgtcatgaacgtgagaaaggcaagcgacgccaacatcgcaaacgaacagacgacaagccagaaacggaaacccttcgaatcgaacaggtcgcgcaacgtgagccgcagtaccagcagcgcggccgcatagaacacgaagaataagtcggacgagatacgcagatgtcgtgcggaaatgtaatccaccaggaacgactggttcgcgaaataagggatggcgaacatcatgaacaccgcggccaatggaatggcccgtggctccaccagattgcgaagacgcagacgatgccgtaacgactgttcggcggcaacggttttacgagccggcctgccaccgtttttcaccagcagaaccgttacgaacgcgcacacgttaagcgtcagcgatgcgatgaacgtccactggtagccgacggccgcctgcagacggatgccgagtgccgggccgaccgcaatcgccaacgcgttgacgatgccgtacaatcccatgcccgcgcccatatgccggatcggaagcagcagcgacacccacgtcgccagacaaaccgtgccgcatgcgaagccaagcccgttgaccatgcgcgccgcgaccagcatgcccgtcgaatcggcaagacaatacatgacgcccgccacgatgtacagcaccgttcccgcagccaccagcaacctcttgctgaccaaatccgacagattgcccgcgatgggacggcagaacagagacacgaaactcatcgcgccggcgatcacgcccatcagcgcgcccgtcgctcccatcgactcgccatagccggcgatgaccggcgtgatcaccatgttgctggtcatgaagaagaacgtcgccagcatcaccagcgccacgtcacgggtgatgagccggtccttcctcggttccgcgggttcatccggccgatttgccgttacgcccgactgcgatgctgaagctacgctcatgattctcctgcctttcgggaacgcactgtaccagcgtcaatgaaaaacggccgcccgcgtatcgcggacagccgattcttctatgtatcgttgccgttttgcctgtcgaaaccttacagcgccttcgcggcctgctcgacgaatccttccatgccgtcgatttcgacgacgttatcgaaacgcacgtcggcggtctcaagaccgcgcagcgcggccggagcggtggtgccggtggccttggcaagcacgtccatgcattcgaaatcggtgccggacgcgtcaagacccagagattcgttgactacgcgcgggaacttgtacgggctggcggtggacagcagcacgcgcggcgtgagcggatcgcgcggcatctgctgcatgacgtagtagccgcatgcggtgtgcgggtcgatcacgtaatggttcttgttccagcagtccgcgatcatctcgcgcacctggttctcatcggcccaaccggtgccgaagatggaacgaatcttcttcatcatcggctcgggaacctcgtaggcgccccactggctcagatcgttcatcagcatggagatcaggcgtgtgtccttgtcggacatgtaatacagcatgcgctccaggttcgatgagatgaggatatccatcgacggggaaatggtctggaagaacggacgctgacggttgtacgtgccggaagtcaggaagtcgaacagcacgttgttcttgtcggacgccaccacaagatgcttgaccggcaggcccagcagtttcgcgtaatagccggcgaggatgtcgccgaaattacccgtcggcacaacgaactcgacctcgtcgcccacattgatgacctggcgttccagcagctgcgcgtacgcggagaagtaatagacgacctgcggcaccagacggcccacattgatggaattcgcggaggaaagcaccacatgcgaatcatcggcgagacgttcggcaagctccttgtcgccgaagatgcgcttgacggcggactgcgcgtcatcgaaattgcccttgaccgcgcacacgttcacattggagccggactgcgtggtcatctgcagctcctgcacctggctgaccttgccttccggatagaacacggtgatgccggtgcccgcggcgtccgcgaaaccagccaacgcggccttgccggtgtcgccggacgtggcggtgacgatcatgatcttctcatccgcgtcgccatccgccggagtggtgcgcgccatgaaacgcggcagaatctgcagcgccacatctttgaacgcggaagtcggaccgttgaacagttccatcacatagtcatcgccgagcggcttgaccggagtgatcttctcgtcggaccactgcgggccgtacgcctcgtcgatgcactccttgagctcggcctcggtgtagtccggcagcagcacggacagcacatcgaacgcgatctgctggtaggacttgccggccaaggaagcgatatccacatgggtctcacccaaggagtcggtcacgaacaggccgccatcatcggcgatgcccttgcggatggcctgcttggaggtaagcgaatcggtggtgctgcgtgtgctgtggaacgtggtcacttgatttccttagcaatagaacggacagattacgtcaaacgtgcttctcagtgtaccggcacaggtgggaagaacgtcgcctcgcgtccgtggaatgggacgccgaccccatacgattgccgacggaaggtcctgcttttccacgtggcaccgcgatcgtgccgtccatgtcttcgcgcgcaggcggtgccatatttcccacatgtttcgaaacccggttttcctccgatcgttttcacacgtacactgctctgtaacccgcggtacagcggatgatcattccgaagtcaaggagggcttcatgactgcatcacctcttgcgcaaacaccgaacgacatgttcaacgcgcccatcgccgaagcggatccggaaatcgccgaaatcctcgacgccgaactgtccaggcagcaaaacggactcgaaatgatcgcatccgagaatttcgtgcctcgcgccgtcctacaggcacaaggctccgtgctgaccaacaaatacgccgaaggctatccgggacgccgctactacggcggctgcgagcaggtggacaaaatcgaaaccatcgcccgcgaacgcgccaaaagcctattcggcgccgaatacgccaacgtacagccgcactccggcgcacaggccaacgcagccgtctaccaggcgctcgtcaaacccggcgacacggtcctcggcctcgccctcgaccacggcggccacctcacccatggcatgaaaatcaacttctccggccgcttctaccacgccgaagcctacggcgtgaatcccgaaaccttccgcatcgacccggaaatcatccgccagcgtgcgctcgaaacccatcccgccatgatcatcggcggatggagcgcctacccgcgcatcgaagacttcaaagccatgaaggagatcgccgacgaggtcggcgccaaattctgggtggacatggcccacttcgccggcctcatagccgccggactgcatccaagccccgtcccatacgccgacgtcgtatcctccaccgcacacaaaaccctcggcggcccacgctccggcttcatcctcgccaagcaggaatacgccaagaaactcaactccgccgtattccccggccagcaaggcggcccgctcatgcacgtcatcgccggcaaggccgtcgccttcaaagtcgccgccaccccggaattcaaagaccgcatgcaacgcaccctcgacggcgccaagatccttgccgaacgcctcatggccgacgacgtcaaaaacaacggcatcagcgtcctgaccggcggcaccgacgtgcacctggtcatggtcgacctacgcaacagcgaaatggacggcaaacaaggcgaagacctgctcgcacaatgcggcatcaccatcaaccgcaacaccgtcccgttcgacccacgccccgcatccgtggcctccggcctgcgcatcggcaccagcgcactcgccacccgcgggttcggacccaaggaatacgaggaagtcgccgacatcatcggcaccgctctcgccgcaggacaggacgccgacgtcgacgcgctcaaggcgcgcgtcgacaagcttgccgaagacttcccgctttacccgggactcgaccaaatccactgatcaccagcctcgactgacgaaatcgcgtcccgccgcgcaaccaacgacccgaaaatggccgtcattgcccagcgaggcgtgatttcgcgctattctaagagactatgacgaatccacagaaccaaggcaccgccatgaacgccgacgtgttcgaagcagtatgcgccatgggcgacgcagcccgcaccgcgcaatcgcaacttgcccaggcaaacaccgaagccaaaaaccaactgctcaacgccatcgccgacgcactcgaccagcatgcggacgacatcgccgcagccaacacgctcgacatgaaccaagccgaaaccgacggcatggacgccggcaaactcgaccgactcaaattcgaccagcagcgcatcaccgccgccgcacaaggcgtacgccacgtggcatccctaccagaccccatcggcgaaatcgtacgcggataccatctggaaaacggcctacgactgcagcaggtacgcgtccccatcggcgtgctcggcatgatctacgaagcgcgccccaacgtcaccgtcgacgttgcctccctatgcatcaaatccggcaacgccgtcctgctgcgcggcggacacgcggccgaacacaccaacgcggcaacactcgccgtcatcgccgacgtactcaccaaacacggatacgaccacaacatgatcgccaccgtagaccaatacggacgcgacggcgccaccgccatgatggaagcacgcggccacatcgacgtgctcatcccacgcgggggagcaggactcatccaagccgtggtacgcaactccaaagtccccgtcatcgaaaccggagccggcaacgtgcacatctacgtcgaccgcaccggcaaccccgacaaagccatccccatcctcatcaacgccaaaacccaacgcgtcggcgtatgcaacgccaccgaaaaactcctcgtccacaaagacatcgccgaaagcttcctgccgaaagccgcggcagcgctcgccgcagcgggagtcgaaatgcatgccgacgaacgcgcgtatgacatcatcgaacatgccggaatcgcaaatgcgcaactcgtgcatgccaccgacgaggattgggacaccgaatatctggcactcaaaatcggcatcaaggtggtcgactcgcttgacgaggccatcgcgcatatcaaccgccactccaccgggcacaccgaatccatcatcgccgaagactattcggccatcgaggaattcaccgcccgcatcgactcggcggtggtgatggtcaacgcctccacacgtttcaccgatggcggcgtgttcggattcggcgcggaacttggcatctccacacagaagatgcatgcgcgcggtccgatggggctgcgcgagatgaccacgaccaaatggattggctacggaacaggacaggtgagagaatgagcgacgaagtcatgcaggacaatatgcagcacaccatgcaggacaacaagaacccatggaacgcggaattgaccgacccaatgctcagattgcgattggcgtccgaacgattgagcatcgtgcggtatgtgttccttgtgcaggtcgaagacggtatcgcgtcagcggacgaacgcgcctcgctcgaatacgccgacgcggtgctgatcggctggcccgaaaccgacgcttcggacgtcatcactcccgatgccgcccagcttgacgatatcgacgagcagatgcgggtcatggaacagcacatcgccaagttcagcgcgatggaacgagaccatgacatcgtcggcatgaccgacacgctgattcgtgtcaccgagcgcgttgccggaatccgcagtatataccagccggatttcccgctgccgacattcgccgagattcgacgtgtggtgcaggacgagtgggatgaggatatggacaagatcgatcctgacaacgcctcaccgaccgcggacagcatcgagcaggaaaccgccgacgcggacaaagagcagcaggccgagaaacaggccgaacagcaggccgatggcgcgcaaaagagcggagcgtccgcatgaccggaccaaaacgcatgcggccggaatctgcggaggccgatcccgaactgaccgtcagctacgtggtcgagccggaacgacgcatgtcggaactatccgtagaccggccgcaatcagccgtggccaccggacacaggtccgcgcgaggcaactggcacaaccggttgcgcatcggcatcatgggcggcactttcgacccgatccataacggccacttggtcgcagcctccgaagtatcctgggtgtacgacctcgacgaggtgatcttcgtgccgaccggacggccggtgttcaagttggacaagaaggtcaccaatgcggaggaccggtaccttatgacggtcatcgccaccgcgtcgaacccgaaattcaccgtgtcgcgcgtggacatcgaccgtcccggcgtcacctacaccatcgacaccctgcgtgacatccgcgcccagtatcccgatgcggaactgttcttcatcaccggtgccgacgccgtggcggagatcatgcaatggaaggacgccaacaagatgtgggagctggcgcatttcgtggccgtgacacgtcccggttattcctcgccggacggcgtgaaattacctgaaggcaaggtggatacgctggagattcccgcattggcgatttcctccacggatgtgcgtcgccgcgccgaacatggcgaacccgtctggtatctcgtacccgatggcgtggtgcaatacatcggcaaacacggcctataccgatagaagatggatggggccgtccgcatggcccccgaacacacggggtcggtgaggtctgcgcggccggttagtatgggtcacatccacttcgctagaacagacgtttggagacacggtgagcgcaatccttgaaggaaagccggataagaaccttatccttgtcacaggcagagcacacccgaagctggcggcggaagtcgccgaacagctcggcattgatgttctggaaaccacagcatacgattttgcgaacggcgaaatgtacgtgcgctacaccgaatccgtgcgaggcgcggacgtgttcgtactgcagagccattccaatccggtcaaccaggccatcatggaacagctcattatgattgatgcgttgaagcgtgcttccgcgcgttccatcaccgcggtctgcccgctgctgggctattcccgccaggataagaagcaccgcggccgcgagcccatctcctgccgtctggtgtttgacctgctcaagaccgcaggcgccgaccgcatcatgagcgtcgatctgcatgcggcgcagtcgcaaggcttctttgacggcccggtcgatcatctcatcgccatgccggtgctggtcgattacatccgtgaccgtttctccaaccaacttgacaacgtcgccgtcgtctccccggacgccggtcgtatccgtgttgccgaacagtgggcgcagcgcctcggcggcggtccgctcgccttcgtgcacaagacccgcgacatcacccgcccgaatcaggcggtcgccaaccgtgtggtcggcgacgtcgcaggcaaggactgcgtgcttgtcgacgacctgattgacaccgcaggcaccatcgccggcgcatgcaacgtgcttaaggatgccggagccaagtcggtgaccgtcgtcgccacgcatggcgtgctgtccggcccggccgtggaccgactgaagaactgcggggcacgcgaggtcgtgctcaccgataccgtgccgattccggaagaaaagcgttgggacggtctgactgttctgtcgatcgcgccgttgctggcaagtgccatccgcgccgtgttcgaagacggttccgtcgccgaactgttcgacacgtatccggaacatcacggccagggcttcctgttcgcctgattttctaggaaactcggatacttctgacacttcagatatttcgaggttttacgttatacgggttccggttcattcggaacccgttttctttatgcttttcgctgcattgcacgctgacggttgcgcggatgggagtgtttccgccatgccgtacgggccgatccgacttgttcgaatggtaatgcgtgtggaacgtcatgatgcccccgcatcttaaaaaataatcgtcagtccggcatcagacctgtacgcctgcgagcttcaggaacttcttgtcggactggatgccttgagtcaggaactctccgtccttgaacagcgcgtaggtcgtgaccggagctggcgtattctgggcctgctcacggctgatgatgtgaatggtttttaatggaatgctgtgctcttccgccaccgcttccacgcgtggcacccagtagtgggtgaacggacactggtccgtgtagtagagaacgaatccatcaccatctgctgcgggatatttggcgcattctttgaattgcggaggctccgtgtccgaaccgaacggcaggtacatgagcatgattccgcatgatgacgtgtccgcaaccatgaaacccttgtgcgcaaggtatttcgcgtcggagaggaattcgcgcttgcgtccttcggcagacaaaatacacaatcccttccgcccctgctccttcgcatccctcacgcacccccgtaacaggtcgttggaatatccgtgccctttcatggagccggcgacccatagacagtcgatgtaaagatacccgtccgcttggataggaacccacgcgttctccgcggggatatattcgatgaagcattttccgcgttctacgctgcggtagaagatcaatccttcgtcgaatcgacgtttgagccactcctttttcgcaagggcctgtttgccggacatggcgcagcagacgtgctctgcatcgatgttgtccctggtaattcgaatgtattccattcgtgacctccttgtcttgcgcggttccgcccatgttgccgcctatggcgtgggattattgccgagtctactggaaggcgtcgttccttgacatcagcgttgctccgaaaaaacgagattccggtttccatgacgttttcagacttccgtattttagatatttagacaaacgtctaaatatctggtaggatgaatatcgcaatccgatactggaaagagagcgatgatggcaggagaaggattcaaggcgctcgccgaccccacgcggcgtcgtatcctcgagctgctgcgtgcgggggatatgaccgcgggggagctcgcggagcatttcgacatcagcaagccatcgctcagtcaccatctggcgactcttaggaacgctggtctcgtaacggacgaacgacatgggcagaacatcgtgtacagcctcaataccacagttatgcaggacttggtcggatggttcatgggcttcgcggacgatccggaagacaggcaatgaaaggtctgacaatgcaaaagcaggaaaaacccgagacaaccaaagcctcgaccggtattccggcccgtgtatgggtcgtcctcatgctgctttgcgtgctgaacgtcgtggcgcatcttgccgccatgccggggctacctgagcgcattcccatgcattggggtgctgacggcggtgtgaacggatgggggccacgttggatggcatccgttctgggtgcgcttccattgacgtttctcgcactgttctatgtggtgccgcgcattgatccgaaaggtgccgcatatgccaagttcggcggattctaccaaggattcgtgatctcgttcacggtattcatgtgcgccatcagctggcttggggaactcaccgtctggaacctccttcctggcaagggcgcggtcaacgtcatcgtgtccggggcgatcggcgcgttcttcatcggcatgggtaattatctacctcgtgtgcggcaaaactacacgctcggcatcaaaacgccatgggcgctcgacgaccccgacaactggcgccgcacccaccgtttcggcggagcctgtttcatggtggtgggcgttagcctgattgtgctgggatttttaggaggtatattgcctgaaacctggattctggcagtgattatggtgcttgcgattggctcggtcgcagccatgtatgtttactcgtatctcatctggcgcaaatcccacaacagctgattgggtagcacccccggttttcttcagcgaaaccacaggggagtccgacccgaattgcctgaccgtgcgggtcgtgttgacgcggataaacggataaaagacaccccggtgacatggaaaccagcggttagcatggggggctcgtacttgtaagtgcaacaggcattccgatgatgtttgattttcctgcatgcaaacccgtcgtgttctttatttctgttgtattgcgagcagtacggtggcgcgcaggacgtcctcgtcggtgaaattcaggccccatatgatctcgaccttgtcggtgaggcgcttctgcacgccgccgacgatcgccgtggcgtcggacagttggaggctcttcggaccttcgatggcgattatcgctcccgtgacctcgtcggacgcgacgctcgaatcatggaaccgtccgtcgagcgcctccacgatgcccgtcgacgacccgctttccacgcggatgaccgtggtcagggcgccggcgcagacgcttctgacgtcgtccccatcgatgtggatgtacttgttgttgccgaggaatccctccaacgccgcgacggcatcgtccatcgtcgtggcgggatcctcttccgggacgggcaggaggtccacgtccacgcggtccgtggcgtccgttccggctgccggcatgcggacggtcagttcccgttcgccgtcgttttcgttccataggatcttgacgacatggcttccgtccgtcttgtccgtggcgtcgatgtgtcgtgcggtcatttttggttccttttcgatgaggcgggttcgtttctttccggggcatgtcccggccgttcttacttctgtcgatgccggacgggcgtgtggtccgatcggggcgagtgcgaatcaggacgggggtcggcatgggcgtcgtggatcggcgacgagtcccaaaaacgtcaccgatccacgacgcaatcccgacacccgtttcgcagccgaggacgatggcggaaggggcattggcgcggttcttgccggccacgacggaagacgtggtctgtgcgagagtgctatgccttggctagcttcttatgtctgagggtgtaaacggcatcggcggaatcggcgacacgtttggaatgcgtcaccacaatgacacatttaccgagttgatgagcggcatgccgcaaaagatcaatcacctcatcagtcatttccggatccaggctgccagtcggttcatccgccagaatcgcgcggccgggcgccaccagggcgcggccgaccgccacccgctgacgttggccacccgacaagtgcatgatgttgcgcttcgattcctcacggctcagccccagatcctcgaggatcttcatatcggccttgggattgaccaggcgcagattctcttcgggggtgagatagtcgatcagattatggtcctggaacaccaaggacacgtgctcgcgacggtgctttgaataacccgtcgcagctatatcctcgccctcaaaacgaaccactccatcagagggggcatccagaccggccaacagagacagcaaagtgctctttcccgctcccgatggaccggttatcgcatacatctttccggattcgaaatctgcgttcacgtccgaaagaacgcgaatcttcgccgcgccatatgagtaattgacatggtccaattgcagacagatagtcataattagtatctcctaacgcatagaggaaagaatggatttcggggatttggccagcactgcggcgcacgacacggcaagcgcgatcgcgatgaccgcgcatccgagcagcaggatgagcagcgtctgttccggcggcagagcctccacctgcaatgattcaagaggtgcgactcccgaatcgtgcagcaggagcaaggacacgtaaccggacaatagggagcccgttcccagcgagcacagggcggcgaccacagccatgagaccggtttcgatcgcgaactgggcgataatctgcatcttgccgatgccgagggccagaagggtgcctatctcatggatgcgtgagcgaatccagaagacaagcgccatgcccaataccagcacatcggccaggcagacggacaacagcaccatgcggaccagatcgcgtaccgtttccaccgactgcagcacgccggaaagccgcgccgagtcatcggtgacgccatactcgcttccggcgattttctttgcttgggccactgcggcggaaagatcccgcggattatccgagaggcaccggatcgtgccgacccgttcctctccagtcagcgcggaaaccacttgagcgcccgaatagatgagattctccgatgcgtccgatggcatagggctctgtgcctgtacattgccagagaagattccggccacgcgaacggtggaatcgcggccttcctgactgagtcggaaggtcgatcccaccgatagtccattctcacgtgcgaaatcccggtgaatcagtacgttccggccattacctgaaatgtggtgtccttgttccaaccggtacaggccgctttggaactcttcggacaacgaggagtcagtggtgcccagcacgctgacctgcgtggatagaccggaatccagtcgaggaccatgttcggggacaaccggatgcgcgccatccacctgcgccagggtcttacgttcgtaaacggttttccctacgccggggatgcgtgagaaccggctcgcttcctttggactgacgggattctcgccggtgtcgacggtaaaacccattcccaggcttccgccgatatcgtcggacattttctgaagcgccgttgacgctccgacctgagccacgagactggtgaaaaccatcagcatcaacagtccgatgattccgctgcgtaccggtttacgtacgattgccagcgtggcacgcttccacacgttcatgcccgtcatcggagctccgacaggcttcgtggcgacttgcgcagcatcggtatgcacgatatggcgacgcataccagcatcaccgccagcaggccgagcgatacatacagtacggcggttgcgtcgatcgataccgtgagcgaatccaaggtacgaaccgacatattggactcaagatcgccgccgacctgtcccatgctgctcagttccttcgccgcggaggcgttcacggaacggagggccgaggtgccaagccattgggccgctccccgtgcgcacagccatccgaggaccagggacggcaggccgatcagaatcatctcggttagatattgggcgatcagggatggcttgccgatgccgagggacaccaatacgcccatctcctgacgtcggtcgttcatccacagcaagagcatgaggctgaggactatcactgccgagatggtcacgccgatcaaagcgccgcgcatcatggagcgcacacttcgggcggcattcagcatgctcgacgtatattggtcattgcgcgtgatctggtagttgttccaatccaccggaagcttcttcgccgcttccatggttttctccacgtcgacacccctatccagaacgaaagtggcatcctggtatatttccttgccggccttgtactggtacagagtacttgtagtgtccaaatcggtgtacacagtgttggaggtgagttccgcgcggctggatacctttctgtcgctgtcccctttgaatattccgacgatggtggttttgacagtcgccgtcgaatgcgactcattgtcggcatcatatggattggccttgagcgtgagggtatcgccgactttaagcccattggttttggcgagatcctcatggaccatcgacatatgcttatcggacgtctttagatgacgtccttcgaccatgccgagcgtgtgggacgtgaacacattgagttttgacgaatcgtttgtgcctatgacgttggccgtattgccgaactgctgttctttctccgcatcgtaatcatcgccgccggggaccttcaccacgctggctcccacgagatcggcggtggcgttctgcctgaccatgcacgagccaaccccggacagcttcgagattcgttgcacatcggcgggacggaccattccgcctccgcgaggcgtcagcatgctgccttgcaggttgctggccagcacgaatccgccgaccgcctgtttctcaatctgtccggcctcatgttgagctgcctgagaaaccgcggtcgcggacagcatactcgccgttatgatggtcagcacaatgaacagcaccgcggtgcgcactcgttttctgagcacatagcgcgccgcccgtgagataaaggtcattaataccccctgtaaagctgggaccttctcggtagtgcccgaaaagatgtgcactttggaccatggccgtccatggcacgatgatcagttcgcttccgcgagtttgtcatcgagccgggacctgtcgagatagcggcgggtcgacgctttcctcgcgccgtctgtggcgctcgatgaccgcggattcgaagacctcgcccttgagcttgggcaccttcaggccgagcctgccggccttggcggtcaggctccggtcgtagtggccggcgcggtacaccttccgctccccggcgcgctcgtatctggcggcgttggcgatctcgtcggcctgaagcgccgggcatcgcgttcaatggttcggtgaccttctcggcgaccaggcggtcgagcttggtctcgagcaggttccggtcgatctgtatgatgctcgagggtcttgccgactttgtcgcgtccgcgccgagcggattcctacactctttggcggccctgtccagatcggcggccgccgacacgcacgttccgcgcgccatggccgtcctgtggtcctcatatgcccgatagcccaggcggccgcccacgaccactgcggtagacgcggccgccgccacgccgctgaagcggccggaatgacggactggaacccgccatcgtcggcatacgtcggtgtatgcggtcggcgcgttgggcaaacccatgccgcaccggccggaggctgagggggccgttcgaccggaaaactcaatggccgtaggattcccggatgcgggcgtcgggcccggtggcaatccggactggaaccctcatacgaaaaacgggctgccgtggtccgttgggaaccacggcagcccgccatgtgattcgttggaatcggaaagccttacttgttgaggaccttcttcatcaggtcggaggaggccttggcgagtgcgaactggccgaagcccgggtcgatggaggcgaggttggcgttgatgatctggttgaaggtgtcgttcttcatggtgtttcctttcggacggccgcctgtcttcttgctcttgtcttcttctgcgtcgcgcggctcgtcgcttcgttgttttcttgtctctgtatcttctgttgtttttctgttgtgccttcactataggcaggaaagtatgcgtacgtcatgccgcaatcgccatttctattgtagactcatcggttcatcttaaagaaagaataaaaaacggtcatatattctgttgcgcagcctgccgcagcgtagttttgggtagatgaagtgcgattgttctgcccattccgacggaaaagttcatgtttgcgtcggaatgggcggatgaattgcgattgttctgctggtttcgatgcaaatggtagctttatcgtcgtttcgagcagaaaagtcaacggttttctgttgatttcaacgctggcagcccggtttgcgtcgtttcaagcagaagaagtgcggctcgtctgccggtctcaacgcgaacggcagactttgcgtcgttttgaatggaaagaccaatggatttctgtcggtctcgacgtggacggactcggcctttttctgcaccagtggggattgaccttccgtcggcatccggagcgaaggcctatcgcttcgaacgcttgcctacaagaaccatggaacagcctgccgacacgcacaggttcactccgcaggtcaccgccggcaatagccgtatgaccggctggtcatagaaatcgaggacatcgggatccatgaatcctgagtacgcctcgaaaagcggatatggcacgagtgccagtgtcgaactcgcaaagaacaatatccagataacggagaggcacaggatgaaggctcttcgaccttctggacggatggttttcgagaatgcgaaaagagtccatgaaagcacggtgattaaagctccggcgacatacagcagactcggaatctcgtcatacatgatttcgcctcctctcgattcggttgcagacgattcgatctatcggcagtatgggctgattataaggcggcgttgttttttgcgtcaagaggttttggccgctcatggccgatttgacgtttcgccggaatcgcaaggcaatgatgctgtacggatctggcgagtcttcgatacctgcgcatgccaagcgagggacgatccatggggtggcagggtcgagggatcttcgcaatgccgttctcgccgctcgcgaaaacggttcgtcatgattccgttcggctacaacgcggaccgagcgagcctgcattggaacaactggagctactgaaacggcaagacctccgaaaccgcgattgccgacggcgacgaggattcgccgaagaaggagaagtatcggtcaaggtggccgcggtgaacctgaaagcagtctagattatcccgatccacatattgtccattgtgtccatttgccgcatgatgaaaacagatggaggtggttgcgatgaccatgatgatgggtggcaaagtccataggacgaggtctaaggcacggcgctctgctggcggagttcccggagcgttcctgcaaggggtggacggcacgcgtatcccgttgacgccggacgactacaggcgcgttagggagtttctgcttgcagagccggaacgggcggtggcggatgacgagcgtatcacgactggcgaggcggcgcgtattcttggggtctcccaacgcacgctcacacgcatgctggacgcgggcatgattccgtacacccgcatgggggagcgcagttaccgtttcctgaggctttcggatgtgaccgactacaagcgcaggcgcgacgaggccacatccaaggcgttggatgagatgcgttccatcgccgatgaggacggcgcgtacgacatcgactattcggattacctgtcccggttcgataagtagagtgcccttatgattgcgctgcttgacgccaacctgttcgtacctacgtggatcatcgacccactgcttagcttggccgaggctggtctgtgcgagccagcatggtctgcgagggtcatggacgaggcacgcttggccatcatggaagtgcggcatgtgcccgacgtccgggcccgcggttttcttgacgcgatctgcagggcctttccgatggccatggcggaggattgggagcggtttgaaccggacgtgaatttgtcggaccccaacgacgggcatgtggtcgcggccgcccgtcgggccggtgcggaaaccatcgttacattcaacctcaaggatttccccgcagacgaactttccaggtacggactgcacgctcaatcgccggatgttttccttacctccgtgttcgatgcacatccagaagaagcgatggacgccatgcgcagactggtcagctccaaacgccatccgccgcgtaccatgagcgaagaaatcgagcatttgcgcgtcttgcgccttccgctgttcgcacggagattgtccgaaacggtaggctaatccccgtcatctgcaacactgcgaatcatacggtaggcgcaatcaatgcacaatctgtgaataatcgctaatccattggctcaacacaacctattgccgccttgcaccgtggaatcaagcaaatcacgaagaaaaggccgtccgcacggcaagatttcggtcgtaggcgatggattcggacgagccgtatccgagagggtgccagtacgaataggtggactcggaccggtcatgtctagggggtcggaatagccccctagacatagtcctttttgctcccccacctggactcgaaccaagacaaagggttccaaagacccgtgtgctgccattacaccatgggggaacggcgataaaacccgaggttttccgccaagtgtctattatgccatatgcggccatcacctgataccgcgtgtcggacgctttcgcaggtgatggccgcttcctccggattcagttcaatgccttgaccagccaaccatgcgtaccgttgtcgaaaagctcgctggtgatgcggtagccaagatgttcatacatcgcgaaattcttatcttcggagtgtacggcggcaacatgtccaccggccttccggatgagacgttccgcctcggccagcaccgtcttgccgataccatggccacgttcgtcggcgaccacggccaaacgaccaatcacccaacgtccgggttgatcggcatggtcgagatcagggtagagacggcatgtcgccacggcgcggccgtttccaaaagccagcagatgcgtggctcggcccggctcatcccattcgtcgaattccggacgataatccttctccacgacgaacgccgccgtgcggatgccgcgcgcctcgtccgtcatcatgtcgtattcgcggatctccatatgatccgacactacagtcgggcggggaagagagacgaatggaagttatgtggcgtcgtgttcgacgatggcactgttgtcgaacgcacgccgaacaacgcacgccaaacgcacgtaggcggatgtatgacagccagcgcacgtgatagggtacacccgtgaacgaaaaagagaaggactccgacacacgcatatacgctttggacgggctcagaggactcgcggccctggcagtggtcgcataccattacacgggaggcgccctccgccaactattgccaggcgcccaattcgtcaccctattcttcattctcagcggacttgtactttccatcgttccgctacgcgtcggaatcgacacatacaactggtctcgctaccagctgcgtcgcatcgccagactcgccatccccacctgcacggtaatcgggatctgctgcatcgtttccacaatcgccatgcatatggggtggaaagcggaagaatacgcaaacgcgttcagcacatcctcgccatcagtctggctccacaatctgctcacccaactcgacatgctttcaatgaccaccgccggcaccagagtggacggttccacattggcaatggtcgacctgccatcatggagcatgtgctgggaattgcttttcagcctcgccctgcccgtatacgtcatcatcgccaccgacatgcgattcgtggcacccattgcgctcgcatgcgtgctgttgtcggagtggacgcagtggccgccgttgcgtcacatggccatgttcgcgcttggcgtcgcgttggcgaaacggcttacggacaacgggcgcgagacgatgcgcgacgtcgttgccgtaccgctcgccctgtgtggcatcgtcttggtttgccaaagcggtttcggtttgctgcctggtattgtcgcccaacctttagccgtgtgcggatgcctgatattggtggtggtcgcacttacctgcaacgtggtatccgacctgctttccacgccacctgtccgttggctggggcgcatttcattcagcctatatctgacccatcttcccgtccgcgactggattgtgccgtacattcccgtgcagggtctattgcgcccggtggttttgtttgcattgtgccttctggcagcggaggcgttctatcttgccgtggaacggcctgctaccagactgtcaaggaggctgggaaaggtgaaaagggaagcctgatgtattccgcttgcgcatggtgctttaggcggaatcgccggtttgcatgaatgtcgattgagcgaccggtatacgcttcctgcgaggacatgttcggcatgttccgcggcaaggcgtgcattcggaaactgatccgcggaaacatgtccggccacggcaagtcagtcgccatcactttggaacatggcatccacggaagcgcgtacctgcccggtgtcctgtcgtggcccgtcaaataccatcagggagatggagttggtacgtagttcactcagcgagctcagcaacggacgcaccgccgcggtgctgcccaaagcgaccgtgcgcccgtcatcatcaaacggaacaggacatcctacatgtttatgagtatcaacagctatcagaatctcttcgaccgtcttgaggataagttcgatgcttgcctcgccgacgcccgcatagccgagaacgatggacgccgcaacaggcatggactctgatccgacgcagacggtattcgtggcatgtcaattgaattatgattcccttagtttcagattcgaaggaatcgtctggagcgatttccacgacggttcggtcggcattcccgccttcgtgcgcgaaggacagaacgtccacatcaaagcaacagtggacaaatacaatcccgacagcggctttcccgcatatcgatgggttccgtgtttttccgaaggcccaggactttcggaaaaacacggaacccatttttccatttcacgagacttttggccgacatgtggaataccagcctggaaacgcgccgaaccatgtaatatcgcttgcggacacgggggccattatggctgagaggaagcaaccgcttcaaccgtatgaacgtataccggataatgccggcgcacggacgtctctctacttcccgtgcctttgcataagagaaaggcacatacctatatgactgaagaaaaccagtcttccgcagttcgcaaacccaacgtcaaatggcgtgtggtcgacatcgtcgtggccgcgatcgttgccgtcgcatccggcgtgatcttctgggcctgggacttcatctacgccgtcccgaccgccctgttcgacagcctcaccccaggcctgggcggactcttccatttcatgtggctgttcgccggcccgctcgtggccatcatcatccgcaagcccggcgcggccttcttcggcgaaaccatcgccgcggtcatcgaaacgctgctgggcaatccattcggcgtggcgcacgcactgctgatcggcatggcccaaggactcggcgccgaaatcggcttcgcggtcttcgcataccgcaagtggaacctgctcaccgtgaccctggccggcgcgttgaccggcctatccaatggcctgtacgaatgggtcgtcaccgccggctggtcgacactgcaaggcgtcgtgttcaccgtctgctgcgtcatctccggcgccgtattcggcggagcgctcatgtggttcgtacaaaaggcgctcgccaaaaccggcgtgctcgaccgcttcgaatccggcaaggccgacgtcgtggcctgaaccacgcaactcacaatccaacaacaaacatagaaaacatgccggccgtccgccggcgtatccaagaaaagagaaaatcatgaccaaccacgttccagaagcaacgaaacccgccagcggagactacgcctggctgggcgcggaagccggctccgtcgccgacctcatgtacatgctcaacaccgaggactggtacgacgccatcaactcgcgtttcgtcagcgagctgcttgacgacactttgccggaatccatcctcaaggcgtatctgattcaggacttcaagttctataacaacggcatgatggcacgtctcatcaaactcgctccacgtcaggagaccaaggacatgctcgcggcgcaatcgcagtggttcgccgacaacgaggccacctacttcgagcacttcctcgaggcctatcacgtcagccaggaggaatacgacgcgaccgaaccgaccccggccaacaaggagtacggcgcatacctcgacagcctgtccgacaagagctggccggaactgatcaccgcgatctgctgcatggaatggctgtacctcgcatgggccaagcgcaccgtcgatgccgacgtcatccagcaggtgccggcgcacaagggctgggtcgacctgcatgaaggcgcgcacttccgcaagtgggtcggcgacctcatctccctggtcaacgaatactgctccatcgatggtccggaagccgaagtgttccgcaccatcgtgcatctggagcgccgcttcttcgacgactcctacccgcaggagtgagcctgcgatccacgaccgcataagccatgagccgggcgcgtacgatcgatgtcgtacgcgcccggctcatttgttgcggttccgtccggagcccgatttcctcgtgcgcggctgccgcgcgagggcggcccgtctacagcgagatcccgtcgatgcggcggagctcctcgtcgctgaacgaagtgttcctcagcgcaccgatgttgtcgatcagctgctgtggacgggacgctccgaccagcaccgaagccaccatgccgtcgtgcagcagccaagccagcgacatttcggcgagcgtctgtccacgctcggcggccagatcgttcaggtcgcgaatctgctgaagccgttccggcgtcaacgcgctctgctgcaggaatcgtccgtcatgtgcgattctgctgtccgccggaacgccgttcagataccggttggtcaacagtccctgggcgagcggggagaaagtgataaggcctttgccaagacggtgcgcggtctccttgagcccattgcgttccacggtgcggtcgaagatgttgtaacggttctggttgatgatgaacggcacatgcatctcatccaaaatggcggtggccttctcgagtgtggggccatcataattggacaggcccacatacagcgccttgccgctgctcacggccgtggcgagcgcgcccatggtttcttcgagtggtgtggatggatccatgtggtggtggtagaagatgtccacgtagtcgaggttgaggcgtttgaggctttggtcgagtgaggcgagcaggtatttgcggctgccgaggtcgccgtaggggccggtccacatttcgtagccggctttggtgctgatgatgagttcgtcgcggtggtggtggaagtattcgtgcaggagtcgtccgcagtttttttcggccgatccgggttcggggccgtagttgttggccaggtcgaagtgggtgatgccgttgtcgaatgcggtgaacacgatgcggcgcatggtgtcgtatggggtggtgtcgccgaagttgtgccagaagccgagggatatggccggcagtttgaggccgctttcgccggcatggttgtaggtcatgctgtcgtatcggtttggcgatggcgtatagacggtggtcggttcgagcatgttttctcctttgaatatgctgctcatgtcgtatccgcaatcaacatacacgtccgtttgtcgtgccgcaacattgcgcaatacaataaggcgcatcgcggtattcgatgcggtggtaggagagtggcccatgcgtgtggaacatggattcggtccggtttgggatgccggatcgcgtgtgttggtgttgggttccgtgccaagtccgaagtcgcgtgagatgcggttttattatggtcatccgcgcaatcgtttctggccggtcatggcggctgttttccatgatgatggttgtctgcgcgagtgccgggacccgggccagattgtggggttgcgtagggatttcgctttgcgtcaccatatggcgttatgggatgtgattgagtcgtgcgacatcgatggagcgagcgatgccagtatccgtaatgcggtgcccaatgatctttccccgataatcatgcgatcgaaaatcgcccatgtcttcaccactggcgcgaaagccgcgcaactgtaccgtaagctctgcgttccgctgcttcgggcgcatggattggacggcatgccgatgacgcagctgccatccaccagtccggcgaacgccaaagccgacctgtccggactcgtcgaagcgtacggatgcgtcgcacgctccgtttcgcaggcgtcgtaaggcgtttccgacggctgcggcattgtccgaaccctatttatacaatcgcggttgcgttgaaatccgaagcgtcctccactaatccgtctggaatggacgtttcccgcgaaaaccagcaaaacggaaggcgaaagatggcactgagcgccgcaatcatccttgccgcgggcgaaggcacccgcatgcgttccaacaaaccgaaggtgctgcacaccttggccggcaaaacgttcctgaaccgtgtcatggactccgtggcggcccttgaccccgatacgctcgccgtggtggtccactaccaggccgaacgcgtcgccgaagccgcacgctcctacaacgagcacgtcaccatcgtcgaccaggacgacatccccggaaccggccgcgccgtgcaatgcgcgatggcgcagctcacgcagaaggacgatctggacggcgccgtgctgatcgccgcatccgacatgccgctgctcgacaccgacacgctcgaccagctgctcgccttccacgagaaaagcggcaacggcgcgaccgtgctcaccaccatcctcgacgatccgaccggctacggccgcatcatccgcgacagcgaaggcaacgtgctgcgcatcgtcgaacaaaaggacgccaacagcagcgaactcgccgtacgcgaagtgaacacctccgtatacgtgttcgacgccaaactgctcgccgaagccatcgccaacctcaaatccaacaacgcgcagggcgaattctacctgaccgacgcgctcgaagccgccaaagccaatggagccgtcggcgctttcgccgcccccgacccgctaagcgtggaaggcgtcaacgaccgcgtgcagctcgccgcgctcgccaaggcgcacaacaagcgcgtgtgcgagcattggatgcgcgaaggcgtcaccatcctcgacccggacaccacgtggatcgaggacgacgtgcagatcgcacgcgacgcggtgattctgcccggctgcttcctccaaggccatacggtgatcggcgaagccgccgaagtcggaccgtacaccacgctgatcggcgccaccatcgacgccgaagcgcatgtggaacgctcccgcgtgcaggagacgcacatcggccgcgccgccaacatcggcccgtggacgtatctgcgtccgggcaacgagctcggcgcgggaagcaaggccggcgcgttcgtggaaatgaagaaggcgcacatcggcaacggcacgaaggtgccgcacctgagctatgtcggcgacgccgacctgggcgagcacaccaacatcggcggcggcaccatcaccgccaactatgacggcgtgcacaagcaccacaccaccatcggatcgaacgtgcatgtcggcgcgggcaacctgttcgtcgcccccgtcaccgtcggcgacggcgtcaccaccggagccggctccgtggtccgccacaacgtcccgtccgactccatggtctattccgaaaacacgcaacacgtagtagagggctggaagcccgaatgggagcgctgaacatgcctgcattgcaagattccatcgacgccatccgcatcgccgcagccgcggccgaccgcatgaaggccaccgacatcgtggcgttcgacgttaccgaaccattggccatcaccgacgcgatgctcatcgccagcgcctcgaacgaacgccaggtgctcgccgtcgccgaggaaatcgagaaggacctgtacctcaaggccggcaaacgccagccacgttcccgcgaaggcctgaccgaaggccagtgggtgctgctcgactacggtgatttcgtcattcacgtcatgcaccaggaatcccgcgaatactaccgtctagaacggttgtggaaggactgcccgagcatcgatctgcagctcgaacacgccgagggtgagcaggagccgacggcttccagcgaagcgtgatttttcatccatcatcgaaacgtgccttcccgaaaatcctgcggaaggcacgttttggtatgcgccgtcccagcaatccgaatacgatggcagacaggcaataaatcggaaagacaaccggcagataggggagaggcatgcccagaaacgtcgaactcgaccatgatgagaccatgacgccacacgtgcgttccatcacactggtgcgccacggacgcaccgcatacaacgcgcagcacaggctgcagggacagatcgacattccgctcgacgaagtgggtatgtggcaggttcgccagaccgcgtccgcattgcgtgaactgtacgtggaccgtcgtcccgaagcggcgcgccagctggtcgtctgctccgatctcaaacgcgcggccgccaccgcccacgcgttcgccgacccgctcggactcgacgtgcatcccgacgtccgcgtgcgcgaacgcagcttcggcgattgggaaggcatcgccgtcgaagagctcgccaaacggttccccgaggattatctgtcatgggcccagttccgcggcggcgagctcaagtatggcgcagaaccgaagcagaatgtcggcaggcgtggcgtcgaggcgttgaacgattgggcgtcgaaggccggctccgataccgacctgtacgtgttctcgcatggcgcctggatctcgcagacgttgcagacgctgctgggattgagcgaagtgcatggcgatttcgccgacattctgtcgatgcgcaacgcgcattgggtgcggctggcgccgttggaactgcagggcacgctgcggtggcgtctggtcgactacaaccatggtccggcgatcgccgacaccgagcagtgggagcatccgcagctatagccgctgacgaaaacgggggatgacgcgcgtcccgttcccaagttttttccaagcttttcacagaatcgcaagttttttcaaagcgtaatcggctaccgtcatgctctgtgaagaattttttcaagggcatatcgttttcatcgattttcgcgggcgcgcttgccgcggtgacctcgttcctgctgtccgcaaaaatcggcatcgcgggatcggtgattggcgtcgccgccggttccatcgtctcggccgttgcgacgcaggtgtacaagaacgtgctcaaggcgtcgggggagaagctgcaaaacgccgtaccgttcgtggccaacgacaaggacggtacggacggtgccggcaagaacggcgatgacgccaccacggtgatcgctcccgccgaatccgagggcgagcagaccaagacgctgtccgcggaggaatccgatgagaccacggtcatgacgtccgtggacggggatacgaccacggcgatgcccgcaacgtcaggccgtgtcatctcctccgcgcaggccggaggacgcgaatcgaacatgcttccggacaatgccggcggaagtatccagcatgctggacgccgggcgtcgtttgacgcttggctgcatggcaagcgtgcgccgatcgtcatcgcgatcgtcagcgcgcttatcggcgtggccgtgagcgccggactgatcctggcattcacgggcggacatggaaccgataccgtggtgcgtgacatggtcaacagcaagcagacgccgtcggatgacaatgccggcgattccacctacggcagcggaaacaacggcacgcaggacaatatgcagaaccagtccggcacgacggacaccgataaggattccaccacgaactccgacaggaacaacggcaaggacaccgggaagaagacggattccacaacaggcggcaccggaacgtccaccgacggctcggactcgtccaccaacaccggagacgattcgaacaagacggattcgtccacggactccactacgccatccgacggatcgacgtcaggcaccaacaattcgggacagtcgggcgcggggacgaccaccacgccgaatggttcggcatccacgaaccagaatccgacgccgaacggttcgaatcccaatggcacgtcatccggcacgtcaggcaatgggacggacacttcgaaatagcccatgaggcatgtgtccggggctttcctcgaccacgtgcccgacacgccgcgaattgcatgattctgctctgtgttgtatcttatacaaggtttgcagagcagacattggggctatggcgcagctggtagcgcatctccatggcatggagagggtcaggggttcgaatccccttagctccacgattggaaggcttccggagagattcggaagcctttttctttaccgtttcccgtcggcttccgggcaatccgcggatcggatgcgaaaaccaagaaagcgagaaccatgatcgacgaagtactgttcctgcgccacggacgcaccgcatacaatctcgccagacggctgcaaggacaaatcgacattcccctcgacatcgtcggacggtggcaggcggaccaaagcgcgtacgaactcgccaaaacctactattgggcgaaagtcgcgcatctcgccgaacataacgaccagctcgcgcaacccgcatacggcaacgcccatctggccgacgtcgacgaaatcaacaacgcgcccgccgcggcccgccgcatgctcgtcgtctcgtcggatctgttccgcgcgcagcagaccgcgcacgccttcgccgacctcatggggctggatgtggaactcgacccgcgtctgcgcgaacgcagcttcggcgaatgggagggcatgacccgcgaggagatctgcgagcattacgccgacgactaccattcctggcgcgcccacacgggaggcgaaaccaagcatggcgtggaaagccgcatccatacgggccgacgcggcgcggaagccgtgcgcgacatcgtcgccaaacaccatgacgagacaatgcctaccacattgcttctcgtcggccacggctcatggatcgtggccaccgtggcggtgctgctcgacatggaccccgacgatctcaacaacgtcggcgcgatgcgcaacgccttctggacgcgcatgaccccgcacaccgaccccaggaacgcggaccgtcccacttggaagcttgaggaattcaaccaaggccccgccatcgcatcattcgccgactgggagaacggtcccgaatcgttgcgcgcgcccggcatgccgctgtggaagccgatcatccaataagcatccaatacacggcgccgaaaacatcatccaaagtgaactcttgatgaaatcaccgccgtccgtacggcaaattctcacggtgggactatccttaatgaggttgtttgcccgaccatgcggcgagccgggaatccggcgatcgttccgcatgcggatcgggcttccgtacagcgatagaacgttggaaagcgcgaaaggcgggtgagagacatgttgagaatgttcagaacgattaacggccaggtggagcaaatccaaaaaccggagaacggctcctggttatgtctctcggcgcccaccgacgtggagctcgccaacgtgtccatggaaaccggcatcgacctggccgacctgcgcgcccctctggatgacgaggaacgctcgcgcgtcgacgtcgaggacgactacacgatgatcatcgtggacattcctaccgtggaggaacgcggcggccgcgactggtacgagaccatcccgttgtcgatcatcatcacccagtccgccatcatcaccgtctgcatgcaggacacgcccgtgctgcacccgttcatggaaggcaccatccgcggcttcaacacatacatgaagacccggttcatcctgcagatcctgtaccgcaacgccaccatgtacctgcgttacctgcgcatcatcgaccgcgaaagcgacaagctcgaactgaagctgcgccactccatgcaaaaccgagagatcctcatgctgctggaactgagcaagacattggtctacttcaccacatctctcaaatcgaacgaaatcgtcatggagaagctaaccacgctgccgcggctcaagcagtatccggaggacgaggacctgctcgacgacgtcatcacggaaaacaagcaggcaatcgagatggccaacatctacagcggcgttctcgccaacatgaccgacgcgttcgcatcgatcgtgtcgaacaacctgaacaacgtgatgcgcatcttcaccatcatctccatcaccctgtcgattccgaccctgatcttctccatgtacggtatgaacttccaggaaggcatgctcggcatgcccctcacggacaagccatggggcttcgcggtgatcatcggcatctcactggtcctttcggcgatcgtcacctggttcctcacccggtcgcgcatgttcaagtgacgtccatgatgggaaaagcgcgatacgtggccgcggcggcatgcgcggcattacttgcggccggcgccggcgcgtgcggcacatcggtttccgtggtgaccgaaggcgcggcgcaggggccgacgatcgcgataggagtggccgccgaccagccggggctcggatacctgcatggaggcgaatactccggcttcgacatcgacgtggccaaatacgtggcgaaaaccctcggatacgcggaaaagcagatcgtgttcaaacagctgtccccggccatgcgagcctccgcgctcaccgacggcacggtggacatggtcgtggattccttctccatggacgggacccacgatggtgaggccgacgtcgccggaccatatctgacggtccgggaggcgctgctcatccgctccgacagcgcatccgaaatcaccgggaccgacagcctgtccgataaaaccgtatgcgcggtcgctggaagcgcggcggacgacaacatccgcaaccgcacgaaaaacacccgcacgacggtggcggaacgcgacacgtatccgcaatgcatgacggcgctgatgatcggcgaggccgacgccgtcgccgccgacgacgcgatcgcggccggactggcgtcgaacaacacaggcgaccgtctgaagatcgtcgacgttcccgacaccacctggtcctacggcatcgccgtcaaatcaggacaggacgagctggtcgggcaaatcgacgccgcattgcgtgccatggtcaaggacggctcgtggcagaaggccgcggccgacatgggcaagtcgatcggatacacgcccgacgcgtccatgaatccgccgaaggcaacggccaaggccccgtcctccggcgcgtccgcggcatcggaaaaataacggcggcgcacgtgcctgaatagtggttgattccttgcgaagtgtccagttgcgcggctaatttcatgcattatgagtgacactgagaaaagcgcgcaggcgcaaccgaacgaatccgccgaaccgtcgttccgctacaacgcgaagctggcgcagggcatcgaagagaaatggcagaagatctgggatgacgaaggcaccttctgggccgccaacgtcaacggcgacctgaaggacggcaagggccataacgccgaaggccgcccgtcctatttcgcgatggacatgttcccgtacccgtccggcaagggcctgcacgtcggccacccgctgggctacctcgccaccgatgtggtcagccgctaccaccgcatgaagggcgagaacgtgctgcacgccatgggctacgacgccttcggcctgccggccgagcagtatgccgtgcagaccggccagcatccgcgcatcaccaccgaacagaacatcgccaacatgcgccgccagctgcaccgcatgggcctgagcttcgacaaccgtcgttccttcgccaccatcgaccccggctacgtgcgttggacccagtggatcttctcccgcatctacgacgcctggtacgacgaggacgccaccaacccgtccggctccaggggctgcgcccgcccgatcatcacgctcgtcgaacagttcgaatccggcaagcgcgccatcccgggcttcgaaggcaaggcctgggccgacctgagcgaagccgagcaggccgacgtgctcaacgacttccgtctggcctacatctccaagtccccggtcaactggtgcccgggcctgggcaccgtgctcgccaacgaggaggtcaccgccgaaggcaagtccgaacgcggcaacttcccggtgttccagcgcgaactgcgccagtggtccatgcgcatcaccgcatacggccaccgtctgatcgaagacctcgacaccatcgactggcctgagaaggtcaagctcatgcagcgcaactggatcggcgaatcccacggcgcttccgtgcatttcgacgtcgagaccccgaacggcgtcaaggacatggagatctacaccacccgtcccgacaccctcttcggcaccaccttcgcagtcgtctccccggaacaccacctgcttgagaacgttccggaagaatggccggcggaaacccccgaggattggaagggcggctacgccaccccggtcgaggccgtgaaggcgtaccgtctggccgccgaagccaagaccgccaaggaccgcgtggacgaggcgggcgagaagaccggcctgttcaccggcctgtacgccatcaacccgatcaccggcgctaagctgccgctgttcaccgccgactacgtgctcatggactacggcaccggcgcgatcatggcagtgccgggcggcgatcagcgcgattacgatttcgccgtcaagttcggcctgccggtcatctacaccgtcaagccgctgccggaatccggcgacgacctcgccaactatgagggcaaggcgccgttcgtctcccatgacggcatcgtcatcaactcctctatcgacgcgaccaaggccaagggcgattccctgagcctcgacggcctgcgcgtggatgaggccatcgacaaggtcaacgcctggctcgaatccgccggcgtcggcaagggcaccgtcagctaccgtctgcgcgactggctgttcagccgccagcgctactggggcgagccgttcccgatcgtctacggcgaggacggcaccccgcacctgcttcccgacgagcagctgccgatcaacctgccggacgtgccggactacagtccgaagaccttcgacccggaggacgccgaatccaacccggaggctccgctgagccgcaacgaggactgggtcaaggtcgagctcgacctaggcgacggcaagaagacctactaccgcgacaccaacaccatgccgaactgggccggctcctgctggtactacatgcgttacctcgacccgaccgacaccaagcacatggtggagaaggacgagttcgactactggatgggtccggaccacaacaagaccgccggcaagtccggcggcgtggacctgtacatcggcggcgtcgaacacgccgtgctgcacctgctgtactcccgcttctggcacaaggtgctgttcgacctcggctacgtcgactccatggaaccgttccacaagctgttcaaccagggcatgatccaggcatacgcctacaccgacgaccgcggccagtacgtgccggccgccgaagtggtggaaggtcccgccgacgccaacggcgagccgacgttcacatggaacggccagcatgccaaccgcgagttcggcaagatgggcaagagcctgaagaacatcatcacgcctgacgacatgtatgagaactacggcgcggacaccttccgcctgtacgagatgggcatgggcccgctggccgaatcccgtccatggaacacccgcaacgtggtcggctccatgcgtttcctgcagcgcctgtggcgtaacgtcatcgacgagaccaccggcgaggtgcgcgtcaccgacggcgagcttgacacgaagacgctgaagctgcttaacaacacgatcgccgacgtgaccgtcgagatggaggccatgcgtccgaacacggccatcgccaagctcatcgtgctcaacaaccatctgaccagcctcgacgccgtgccgcgcgccgccgtcgaaccgctgatcctgatgctctctccgatcgccccgcacatctgcgaggaactgtggagcaagctcggccacaccgaatccctggcgcatgccgactggccgaaggccgacgaacgttacgtcggacaggattccgtcaccgcggtcgtgcagatcaagggcaaggtgcgcgccaagctcgaggtctccccggacatcgatccgaaggagctggagaagatggcgctcgaagccgtcgccgaccgactgggcggcaaggagccacgcaaggtcatcgtcaaggctccgaagatcgtctccatcgttcccgcggaatgatcttctgacgagacggcccgcataagaggacgcgggttcttccgcaccatggcgacacgccaggaatgtggataacccgcgttctccgaccacaggagccgtttcggctggacagtatgcccatgcatcctccaatgttggatgcatgggcatatttgcatttcgcggcactcaccccatccgtgccatccacacggcggacggcggcactggcatgccggccgccacgaagcggctgcggggattgggcatgcccgaaaaaccgtcccgacccaacagccttacggccatggaggcgcaatcggacgaaccgtccgcatcgcacgaacccgcacgaccgatgccgcagcggaagacgcatgacgcgaaaccgaccttggcggagctcaccggcgtccggccgacggacaaacccgacgagggggagcggccgaaacgcgacaggccacgattggcgttccgcccgttccacgcgctcatggcgatcctcactttgtcgtgcgcgctgtgcgcgagcctgaccatgctcgtccaacagacgatccactacagcgaactgcagcattcgcggtcgcagatacgctcacaggcccaacagcagccgcaacaggccccgcaaacggaacaaacgccggcaccgcaagaaaacgggctgacgcaggacgcgtccacaccggacagccatgacgggcaagacggagcgcagcaatcgaaccagcttgacctcaacaccgcagacctaggcgaattgcagaccctcaaaggcgtcggaccggtcaccgcgcagcgcatcctcgactatcgaacgcagataggacggttcgacaacgtcgaccagcttctggaagtcaagggcatcggttcgaagactctggcgaagttccgtgaccaagtgtgcgtgagatgacgggcacacgcgattggctgaccagggagcgcgggagccgagactggagactgctgccggccgcaatatgcggttgggcggccagtctggccgcgcacgccggcttcgcatattgcatgtcgcatgacggcatgctcggcgctttgccggccgttctcacctgcatgataccgctggcggtcctggcgggactgcccttcccacgattgccggcgtccgttcgacgacggataacgctctggcatgcgagcgtcacggtctgcgcgatcgctgcgatggtttgcgcggcaagcgcgttgacctatgatttgctgcaatggcgcgacccggcttctcgggcggccgcggaaggcgacgcttccgtcgtcgtcacggcgcgcgccacctcgccgaccgtcatctccgacagacggtctaacgactgccgtgccgacgcgcgcatcacatcgctcaccatcgacggcgtacggcaaaccagttcggcacgagcgcgtatatacgcggaccggcctgaatgcggcaaactcaaacaggacggcacctacaagatcgcgggccgcatctccgaagcgcgatacggtgccatgccgttgtggctgaccgacgtcacgacagtcgaacacgtcaggccgccaaacctgccgatgcgcgccatcggcatgatgcaggaggcgttcttcgtccaaaccgcacgtctttccgaccaagggaaagtgctcgtccccggactgacattgggtgttctcggacaggactacgtgccggccgaaggcgatggcgccgacatcgattccacatacgccgcacaggtggaggacgcgttccaaaggtccggaatcgtgcatctcatggcggtcagcggcggccatctggccgtgaccgccgcattggtgcgttccgtctgctcgttcttccttctgccgcgacgattcaccgcactgctggtcgccatgtcgtacatcatgctgtcggcatgcgtgtttccgtcggattcggtatcccgcgcgcttttgatgggattgtccggcgcggcatgcctgttcatcggcagacgaggccaggcgatggcgtcgttgagctggaccacattggctatgctgatggcatgcccgcacatgtcgcaaagcttcggattcgccctgtcctgcgccgcggtgctcggcatcgtgctgttcgccgacaccctcaacgcatggatggaaccggtcctgccacggttcgtggccgaggttctgtccatgaccatagcggcgcaagtgttcaccctgccgatccaggtgctcatcgaaccggaactgccggtgttctccataccggcgaatctgatggtggcgccgttcgtgggtttcgccacattggccggcctggccagtcttgccgtctcatggctgattccgtggctcggcctgcaactggcccgtgcggcctcctggggcaccgcggtcatggaactgaccgcccttgaactgggttccggcagccaggccacgataccgtgggccggaggcgtcgggggagcggtcctcgtctgcgtggtggaagccgcctgcgcggccgccgcgatcatgacgcaccggctgttcggacgcatgatggtccaggaacccgatctgcccggaaaacgtctgacagccaaccctgtggaacggctgcgcatgtggatggaacgtactcggaaggcattgcgcgaactgcaatgggaggaataggccatgccggttttgtccaccgatacggcgagattgaatggtatgccgaaaccatccgcagccaccacgcccttccacctcgtgtacggaggcgactcgtacctgaacgaccagacggtgcgcgacctcaaacacgaggcgcaacgccggtatcccgacgcggaaaccatcgaactcgacgcggcaaacgccgaccattacgccttcgacgaggcggtaagcccatcattgcttgcggatcgcgccatcgtcatcgtcaccaacctgcagaacgcggacgaaaaactgggcgacgccatggtctcttactgcagacaggcgtgcaaggagccggcggacgcgtgcatcgtcatctgccagcatgagggcggtgtgaagggcaaacgtctggtggagcagctcaccaaggccggagcgtacaaggacgctgtcgccgacctgaagaagcccgaggccaaactcaacttcgtcatgcaatgcttcgaacggcgcaaacgccgcgtcgagccgatggccgcgcagcaactcgtggccgtgttgggggatagaaccggcgagcttgcggccatggtcggccagttatgcttcgatttcgacgacaatcccatgacgctcgaccgcgtcaaccaatatctcacctccaatccgcaggtggatggcttccgtgtcgccgacctcgcgttgtcgggacgtacggcggacgcgatcatcgccatgcgatcgtccgtggaacagggcaccgctccgatcgcgcttatcggcgcgctggccatgaagctgcggacgatggcgaaggcgtcggcggtgcgtgcgggcaccatttccacggccgaggcgaaaacgaacccctgggtgttgaagaacgcgacccggcaactatccggatggacgtcaagcggcatgagcgcatgcatccagatgctcgcatgggccgacgagcaaagcaaaaccaatggctcggacccggtctatgctttggaacggtccatcgaactgatcagccgcaaaggacgtgccgcatgagcaacaccattaccatcacagccgccaccggcgaggacatgcaggcgttgggggagcgtttggcgaagcttgcccgtggaggcgacgtgctgttgctgtccggtccgcttggcgccggcaagaccacgttcgcgcaagggttcggcgtgggacttggcatcggagagcccatcgtctcgccgaccttcaccatcgcacgcgagcttgagggacggttcgcggacggttcgccggcgcatctggtgcacgtcgacgcctacaggctcggcggcaacgcctacgcgcccggacaagacacggtcggacggctattggacgaattggaatcgctcggcttggacgaggaattggaggatccgggcgagcataccgtcatcctgatggaatggggcgagcagatggccgccgcattggctccggaacggcttgaaatccacatcgaccgtccgcttgacgcgcccgccgtgaccgcggacggcgagctgaccagcgcgggcgcacgcacggtgacgttggtgccggtgggcgctgcctgggattcgttcgatttcaccgcgggaaaacgctgaccctgtctaagacgcatccgacgtggccgaccgcaccgcatgccgtggcttccagcgccggttgtacagtggttggcagtttggcacaaggagttttcaagcatatgcagacactggtgattgacacctcatatggttcgaccgtaggcgtggtcggacatgaacccatcgtcgaaacggattcgcgcacccatgtcgagaaactgcaggtgaacatcgcgcaagccgtcgaacaggccggactgcaggcgtcggacatcacccgcatcgtcgtcggcgtcggaccggcgccattcaccggcctgcgcgccggcatcgtcgcggccaaggcattggccttcgccacaggcgcgcaactggtcggacaggacgtgctcgcgccgcaatgcctggcacatactcaagctacggacgatcgccgccatctgacgcttgccgtcaacgacgcgcgtcgccggcaactgtatttcgcgctgtatgacggcggcaccgttgcggacggcgtcggacaatcgcccataacgttgatcgacatggacatcgactatccggattccatcacgatgcgcgtcaatgacgttcttacgaagctcgccgacacgggcaagccgtacgtcgtcgacgtcatcggccatggtgcggtcaaatacgcgcagtcgtggaatgcgattgcctccctcggcgaagtcgacgaccatgctctgctcgacgaaggcgcggaaggattggcgcgattcgcggccttcaccaccagcgaacaggcgttggcagaaccgacccccgtcgaaccgttatatctgcgtcgtccggacgtgtcagtgcccaacccgctcaagcatgtgctcaaccatgccggcgccgaacgaacggagtgacggcacgcccatgatcgtcgaccattcccagattccggaagacaccgccgtcggacagatcgccgcattggaaaaggacctgttcggccgcggcgcgtggagcgaacagtccgtacggcaggaattccacgctccggcacgcacgtatctgctcgacattgaaggcgatgccgtacagacggcggatcccgtcgtccgaggctacgcaggctactggtacgacggcgacgacgcggagatcatgacgatcggcgtcggcagaccataccaacggcaggggatagcggcggcgcttctcgaaacactgatcgtctcggcgcgtcggcagggcgccaaacgcatgcttctggaagtccgcgtcgacaacgtgccggcattggcgttgtacgaaaggttcggcttcacgcggatgggattgcgcaaacgctactaccagccagaaggcatcgacgcgtacaccatgagcctcgacttggagccgcgcgtcgtcggcttcagcgcaacagcggatacagagcacacttcagcaacacacacaacggagcagcaatgagcgaaccaatcgtactcggcatcgaatcgacctgtgacgaaacggcggcggccgtggtgcagggacgcaccctcatttccaacgtggtcgcgtcctccatggacgagcacgcccgctacggcggcgtgattcccgaaatcgcctctcgcgcgcacgccgaagcgttcgtgccatgcgtctccaaagctctggccgacgcgaacatgacgctgtccgacgtcgacgcgatcgccgtatccgcgggacccggcctcgccggctgtctcgcggtcggcgtgtccggcgcgaaatcgttggcatgggccgcgaacaagccgatctacggcatcaaccacgtcatcggacatatcgcggtgacgcagctgcagttcggaccgttccccaaggacacgcttgcgttgattgtgtcgggcgggcacacttcgctgctgcatgtcgaagacgtggcgcggcatatcgacgtggtcggcaccactctcgacgacgctgccggcgaatgcttcgacaaggtggcgcgtctgcttggtttcccgtatcccggcggcccgcacatcgaccgtcacgcgcagctgggcaacccacatgccatcaaagtgcctcagggccttacacaaggcaaggcggggcagcagcatccgtacgatttcagtttctccggcgtgaagacggccgtggcgcgttggatcgaacaacagcaggcggaaggcaatgagattcccatcgacgacgtgtgcgcgtcgttggccgattccgtcgcgacggtgctcgccaagaaggcgatgcgcggttgcgagcagtacggttcgaagaccctgatcgttggcggcggcttctccgcgaactcccaactgcgcgccaaactgttggaggtcggagccaagcatggcgtcgaagtgcgtatcccgcaaatcaaactgtgcaccgataatggcgctatggtggccatgctgggcgtgaacctggtggagagcggcgtgaaaccgtccgaaccggatttcgcaatcgattccgccatgccgttgacgaagatcagcatgtgacggtagtcccgccgcagcaagggagacacgcgcgggatttgcattttgcgttttaccgcgtataattcatgtcttgtgcacagcgcattcctgcgtagctcagttggcagagcatccgactgttaatcggacggtcactggttcaagcccagtcgcaggagccaaggcggaaacccttacgcgagtagggttcagccgcagttgcgggaacggttgcggaagcgtccgaaatggtcattctctccgattctcagacaaactcgaaaaaccagcccaaaaaacacacgaaaaagggttgcgacacgccgtaatagaaaattcgtatgtcaggtgggaaggttcatgaaaccctgagagaacgccatccaaacgtctcacagggcataacagccggtatcatgcggaaccatccaaatccgacacgcccatgccgttctctccaaaatagggagagaacacgatgcatgagccgtccggaaccacgaaggccgccacacggcatagggaaccatgtggcggccttcatagacataaccgcaatcagcaatctcaggaaaacccaatcaagcaggtacaaccccaataatcttctttatttggattgcgttatcatgttgaccgaacacgaggacaatcggctacaagcccaagttcgccctcacgtaggcttctacttccgcattctcttcgggagagccgatggtcagcaagtacacgcctttggttctggtttgagggttgccctcacgtaggcatttaaccagacccttatccattagcttattcatattcttggagattctattgaccgcgttcgtctccttcttctcgtcgcgcggctctccatcgatgaccttgatggactttaggttgtccggcaacgtcataccgaactcacgcgccagtgcgagatagccgtattggtatgtgcgtggcatcaggcgcttatcctgagcggttttgtccagcggccagtcagctgttaccaaggcgagtcgttccaagatgtaagcttgagccatgttaagggttgtcccatcgccatacttggtattgagaccgccttcgcgcgtcagctgatgtacgagttctgcattgcggtatcccacaatatccatctctttccctccacgcctaggggtaagctggtacatggagaatcattgtgttggtttttccattggccctcggagctggtctagagcttcgagggctttttcttacttttgtaccttgttttaaagtatacccaatagccactactaaacatgagtcttagtcatgttctaaaaagagtgtttagtaatcttttaaacagttgatagtcacgttcaaagtagaataaatacatatatatacataagtaacattattcttcatttttttcatagtggattttgccatgcttttgccatgcttttgccatgcttttgccatgcttttgtcataccggacaaaacgttagagggtataagaaaagcccgccagcacgaaaccagcgggcataagaaactatgagtcacattgaactaccgctgactgtaacgataaccagtaacaagaaacacacgccaacagcacaaccgagcacaatccaacaattccgcacatggacagaattgcgagaagcgatatactccaaagcctttgacttcacattccgctcaatggcatctggtgcaggattagttttggcctcaatctcatacaattcacgcaacgaaggattgtcaccatccacatcgtcgatgcgttccaactcgtactgggtacgccagtcaatcaacccagacatgcgaataccattccgtaccgccatttgaattagcagaacgaacactgccgaaccggcgacaatgcctgcgacaacaaatatgaaagccatagttaacctctcgcttctctgtgctttaagtcttacaaggattatccacccaaacaggccgtaagcacgcattaagcgtttctcatacggggtatccccgtaaataccctcgcttttgagacagcacgtatcaaaaccgcgtgtcggattgaaacatgcgttcgagtggatatatcatgcaagtgaaagacgaacacatgttcgattgaggatataaaaaggagggccacgccccgtcctgccagatgaatgcgtgaccctcgaagaacacctacaaggaggtgttatggtctagtctactccttcttatcctttatgccacgaactgcatcaagtagtccgaatgcgtttccgtatcccagagccttggctagattgtccaaatcatccgtagtccaagaagctagacctttgattcgtagagaagcataggactggctcttgtcgatgattcgtccggttttggcctgtgaccatccggccttgtcgatcatcgaagcgaccgtctcggctattagctttgttgcggcactggtttccttgagttcggtattgcgtaccacttttgtttcacctcctaactctattgagtttatttgttgacatatgtaatggtaggaactagagcggtacgacacgccgataaatctgtaaatagctctattgagttgacaaacaataaaaaacgattattcttagtctcagaagttagctcaatagagttaaacaacgaggctgaataggaaaggagcaacgagcatgacgtttcgggaatcaatctcgaaggcgattgaatcccagcgcaaccggctgggaatcacagcgacggagctttccaaacggctcggaatttcacgccagtactattacatgcttaaaagcaacgatgccctgtggaagatcgagcagctaggcaaagtcgcatccgcactggaactcaaatcagtatgggagcttatcgacttagctaagttcgaggattcactgaacaccactatgaacggcgagtccaatgaagcggagcatgagcaatgagcgccgaggtacaacagtttactttcaacggttcagcattccgcgcattgaatgacgaatctggagagtcttggttctcaggtcaggatgtgtgcaacatccttgggacaggcactaaccacctgcgcgaatacctcgatgaagacgaaatcaccaatatccgcaatacggacattgctcaaaacggaggtaaagcgccggtcttcatcagtgagccgggcttgtacaagctgattatgcgtagccgcaagccagaagccaaggaatttcagcgttgggtcactcacgaggtgttgccgtccatccgcaagcatggcgcttacatgactcagcagactttggataaggcgctcaccagccccgacttcctaatccaactcgcaaccaagttgaaagaggaacaggagaaggtcaaggagcttgagccgaaggccaaggcgttggatgacttcacgaacgttcccgatgctctgcttgtccgtgacgcagcgaaactcctaagcaacgattccaacattcagatcggtgagcatgagctgcgccaatggcttgtggataacggttggatttaccggcagcctaaccagtcgtggtgcgcggcgtcaagtcgcgtgaggcaaggccatatggtcatggtgtcctcccgttcccacggaatccacaaggatggcacgccattcgcctatccgccgaccccgaagctgacacgcaagggattggcgcttatccaccagcggttgtctgaacaaagtttcgagcgagtgcttgacgcggaggtggcggcatgacgttgttgaatcctcccgcgccaccgcatgagttcgttcttgacgagggtgggcactgcgtcttccgtatcaatgatcggaaaggcgggtcaatcgttgaaaaagatggactcaagacgagcacattgtatgagattccagaatcgaaactggctgcgttcatccaatgggcttccgacgttcacggccaatcaagataggagcaggttttgacagacaggatggttgttgtcgaagaggagattttcgacaggcaggaagctgccaggttcttcaagcttggaacggccaagttcgacgaactgtacggggggtgcgccgactatcagggcggcaagaccgtcacatacaagaagtcgaagcttctcgaccgttacgaccaggtgtgcgagagtccacgggaggtttcggcatgaacggcactcgacctgacgcgtggagcgtgcagacgggcattgacttggatgccatgcttgccgccaacgcgggttggattgaacgggtcagacgtaagaccaaacgtgactatcagcgggacaagccggtattgcagcgggtgttcgagtcgcttcgcacgaaatacgaggccggtttcagtaccagttcgtatcggattgcggaagacctgcaattggctcagagcgttgtctacagaagtttgcgcaagcttgtttcctatgggcttgcggaaacgtttctgacgcatggaagacattgtttcaggccgacaggcttggaaccgacgaaaggatttgattggaatgaatgacagtgttttggtgaagcttgaccagcttttcgataagttgaagaccgcaagcgacggagacgattggaataccgtgcgcggtctggtcgcacagatcgcatcactcgtcaaagtggatgaaaagccactgcccgaagagccgaaggagcggggcttctatgtcaccgcgaatgatggtcggctcctgcttaaggacatcgatgatgactggtcggcgcgcacatgggatgactgctcggctaatcacatgtggaatggcaatagacagtatgcgaagtggccgactgtctgcgaaacgctcccgcctgaagccttcccactcaagcgagtgaacactgggagcgacgatgactgaccatgattactggcttgaagacatgcaagcaatgaagaagcggaagaagccgaactacccgctccgccgcatcctcttcgccgtcgccagcatcggcctcatctccagcctgaccatcatgctcacatggcatggcggcagcatgaacgccgcgctcatggtggaaggcgtgtacatcgccaccgcattgtggctgatcgtcagattcgcgccacgcgattaaagacttcccgctggctggcagtcccaacaaacaaccaaaaatcgggttgttccgcaggatacccacgttcactcattcgtcggccagtggggaccataactgaatatcgatattatccacgcgcctacgaactcaataccgcgcagcaaatcacgtaggcgcattggccgcacatggttgtgggattcatgccggactccttaagtttgacaactcatgaatcaccttatccatctcgcattcaggttttgacatttcctgttgccgtgatgttggccgtgaacccgttcaggtcgggttccaacggttttgcatcattcattggcgtgaatcctaacaggttcgactcctgttgcggccactgtccccaccggttagtgcgattgccggactggggatttgacgtggattggatgactcggggtctctggttcttcttcccctacgggtcgcgggttcgactcccgcccacgtccgaagccgtcgtgagacggcccgacataattgaaaacccggttgacgggggagcctaaaaaatcatattccaaagtcgatttctctaggcgcttacatacacactctctcccgtcaaccaatcgctggtgcaaggaacgtggccgctgctatctcagtcgttcgatccatcggcggtcagatggttcgactccatccaccagcacgcaatcacagaaaggaaaactctcatggacaccatcaacgtgaatggcgaaacctacacgaaagtaccggacgagatcagcttgttcggacgaacctaccggctggtggaagacgccattccggaaccattggacgtgtcggaccggcatccaatcaaaatcgaaccggattaccgcatcacgctcagggaatacatgacccaacagcatccagaagacgccaagcgtaacctcaccggactgggccaagtcgtgaagaacacgattctgaatgccggtaagggagacttgttggaagagaacagcaatggtgccatcatttacacccgctcattgttcccgcttgtcgaacagggttatgagaagtggcgctaccggaataatgcccacattatggaacggagtgtggcggaagcatgacggaagtgaaattccccagcatggttgacatgccggacaaggagtatttcgcacatccggcaatcgaccagactggtttgaagaagttcatggagtctccaagagcgtacgcatggcacaagctgaaccctctcgacaacagtacgttggcgttcgggaaggccgcgcacagtctcattctcggtagtggcccgaaggtcgaaaggaaactcgacgggcgcaccaaagccggtaaagcacaagccgaacgagccaaatcggacgatctggtaatcctttccggttccgactatgagaagcttcaaaacatggtggattacgcgccggacatgaacagtctcgtggaaggcaaaccggaaatcgccttgttcgccattgacccgaccactggattgcagttgaaaggcaaggccgactggctgcccgaccatcccgacatggacggcgtcatgtggctgtacgactacaagaccaccggccatgacgtgcaggacttcactggttcggcatacaaattcggctaccacattcaagccgccttctacatgatgctgtatcggctcgtaaccggataccagggtgcgatgggattcagattcgtcgtgcaggagaagcaggaaccatacgactggatgatttgggaactatccgaaaacgatcctgaaatctcacttgtcgcggtgaagcagattcgtgaagcgttggataggctcagcttctactggaataaccatattccgttggaagacatgctcaaccaaggattatcgaagacgcctatgcctatcagattcactgactggcagatgaaccatctgattggagatgatgaccaatgggaaatgtgatagcgaagaaccgtaaagcctacggttatgattacgccgacttgggcagtgtggtcaactatgtgaccgaaacgttgaaggtcaaggtgcagcagagcatccaatacgataatctaccccaatatccgaacgggtatggattcgtcgtaacccgctactggaaggatgacagcaagtcttggagcgcgtttgaagctcccgtcccgatcatcgtgggtgattccgcaggtaaacgtgaacagccgttcatgcaacggtatgggagtgcggaaacctatgcgagaaggtacagtctgctcaccctgttctgtcttgctaccagtgatgatgacggccagttggctggctatcagcgtggcaatccgatgaacgaggacttgcgcaggcaggttgccgccttgttggctcaggggaatgttccagccggacgtgagtccgaagccatcggcaatcgcatcaaaatgcctgtgaactatgcgaggttgaccgactggcaagcccaattgttcatcaacagtttcaaaaagaatgaagaagtcaaggaggccgcataatggctggagaaaccgtaatcacgatcattggcaatctgaccgacgagccggaattacgcacgacccgcaatggtgaggccgtctgcaatgtcaacatcgcgtcaaacaccagacaatacaacagccagtcgggccagtgggaggatggtgacacgctttacatgcgcggcacgatttggcgtgacatggcccagcattgcgcccaatccctgcacaagggcatgagggtcatcgcgcaaggccgtttgcaacagcgttcctatcaggcgaaggacggcacgaaccgcaccgtggttgaaatgcaagtggacgaaatcggcccctcattgcggaatgcgaccgcgcaagtgcagaagattcaacgtggcggctatcagggtgccccacaagccggtttcaataatcctccatccaatggattccaacagccgcaacaggccggtcagcagcccgcacagtctcaacagttgggtggagacccttgggcgtcgaacaataatcagccttccgacttcggcagtttcggcggcaacacggacgagttctaatccagactaaaaggaaccaacatggcaaacatcattccatacagggagtttctgaaaagaaaggagctgcgcgagcaggagactggcatcaccgttagcccgcaacagctccacccatccctgttcgactggcagaaacgtatcgtcacatgggcttgcaaagtaggacgtgcagccatatgggccgatacgggtcttggtaagaccagaatgcaactcgaatggttacggcaagtctgcgccggacatgggacggggcttattctagcgccgttggccgtatgccagcaaaccatccgcgaaggcgccgcaatcggcatggaagtgcgttatgtgcatgaccagtcggaagtctctgacggattcaacatcacgaactatgagcgtgtgccgaaactcgacgtgtcgaagttcgatgcggtcgtattggacgaggcttcgattctgaaacagtcggacggcaagacccgcaaaatgctgatcgacacgttcagggatacgaaataccgtctcgcctgtaccgccacaccggcaccgaacgacccggaggaactatgcaatcaggccgagttccttggatacgccacccgtgtgaagatgcttgccacgtatttcgtgcatgacgggaatatttggcgtttgaaaggtcacgcggttaagccgatgatgcggtggatgtcgcaatgggccatcgcattgcgcaagccgtccgatattggcggtgatgatgcgggatatgagttgcccggattgaatcagaccgttgatgttgtcgcctatcgcggcagcatcccggaaggccaattgttcgcagctgaccttggtggcgtcggcgggcgtgcgagagtccgtaaggaaacgcttgttgaccgtgtgaaccgttgcgtcgatcttgtcaacagcgaaccgggcgaacagtggattatctgggctggattgaacgacgaggcggacatgctgaacaggcttatccccggcagtgtgaatgtgaaaggctccatgtcgccggaagacaaggccaaggcgttccttgacttcgctgatgggaacattccggtgctgattacgaagggttccatggcatcgttcggtttgaactggcagaactgcgctcgaatggcgttctgcggtttgaacgactcgtgggaatcctactaccagtcgatacgccgctgctatcggttcggacagaagcgcgtggttgacgtgcatgtggtggtgtccgatttggaacgcgagatagcggagaacatcacccgcaaggaacagcaggccactcatttgagtgacgaactggtaaagacgatgaatgaatcaaactctttcggaaaggccgcatgatggtcgatgaaatgtatatgaccgatgaagccaaaggcaaggattggacactatggcttggcgactcgtgcgaacgcatgacggaaatggctgacaacagtgttgatctgagtgtgagcagcccgccgttcgcaagcctgtacgtgtactccgattcaacccgcgacttgggcaacaatagttcccgtgaagagttcatcgagaattacgggtacatcatccgcgaactgttgagggtcacgaaacctggccgtatcgcttgcgtgcatgtgcagcaggtggtgaccacgaagaccgctgacggcgtggttggattgaccgacttccgtggtgatgtaatccgcgcttacgtggagaacggttggattttccacggcgaagtcaccgtgaacaaaaatccacaggctcaggcgattcgcacgaaagcccaagccctcatgttcgtcacgaagaacaaggattccagtatgagccgtcccgcgttggctgactatctgctgatgttccgcaagcccggcgacaatcaggtgccgatcaagaacgatgtttccaacgaggaatggattgattgggcgcaaccggtctggtggaacattcgagagaccaacacgctgaacgagcgtcttggccgtgaggataccgatgaacgccacatctgcccgctgcaattggatttcatcgaacggtgcatccgcttgtggagcaacaagggcgagcttgtgttcgacccgtttggtggcatcggctcgaccgtgtacgaggcaatcaaacttggccgcaagggcatgagcattgaattgaagccttcctattgggatgcgtcggtgaatctgatgcgcgatcttgaagagaagcttggagaggcgacactgttctgatggttccgctctctgggatgaccgaacccgcatggtgtgacaagcatggggtcgaatattacggccccacttgtcctgaatgcgagtcggaagccgaagactattgggaggatattggagacgcgagcatatgggacttatgaccacctatgatttcgacattccaggcgaacccgtcgcgaagggccgtccacgattctacgggtatcgggctgtgacccctcaacatacgagggatgctgaggaactggtgcggaaccaattccacatgttctaccctcatgccgaaccattggacggggacgtgctgatgattctcatgttttataaggggcgtcatgggaaaccggatttggacaatctggaaaagctcgtcaaggacgcgttgaacggtttggcctacgtggatgaccagcaagtgaaactcacgttgtgcgccatgctggaacccgaccgtatggcatggggacaacgggcgaaacggcttgtcaaacgtcggcagggaatgccgttgacatacggcggcaatccttatgagccgcatacggaaatccatatagaacccttgcatgacattcacggcgggttggaaagtctcgtcagaaacacgaaggagatgataagcgatgtcggaaaccagcctgaataccggtgagatgctgttccaactgcgtgtctgggattacttggcttgggcgttagacgataagcgtctcgaccatgttgagaacctgtactacaagggacaaccgatcagtgtttcgacgttcgccaatccgaacgtgccgatggtgaaatgcttcgataaggctgaactgttggctggtgacattgattctgaatatccgttcgtcatacaagccgatggcatgttcgatgctgacgtgatgggcgagcgtgagtggatcgcgtctcaacccgcgtacacgagtctgagcgtgtgggacaagttcgagacattactaccggccaaaccgtctatggaatgcgttgactcgggcactcgaatgttcatccgattcacgttgggtgaattggcgggcatgttgaacagtgggttgccgctcggaggtggacgatgattcttccagcagtcaacgtcaacggcatccatttgagcagccaacagcatgaggcgcttgtcagcatatggcgtaccggtcgaatgccggaaccccacacaggtcagaaaccgtggctgtggattcaagcgctcagacggcgcggcttggtatccgacaatgcgctcagactgaccgacaagggacgccatatcgtccaactcctccaggacaggaaagcagtcccataccaaagcactgccgacaatccacactacggagcctactgggacgcctactacagcaaccagtcaacctaccggtatcagcccggtttggaaatcatttgcaaaaggaactgtgatgaaacttgacccgccaccggacttggttgaaatcgctgaagccctggacgcgatggcgaaaccacactgggggagcggcatcgtcttcagctgtgacggcctgccggtcaccacaccaagacaagaagcaatctggatggaatacaacggcatcacaagaggggaggactaatggcaaggcgtggttacgtgcagctcgtgaacggcttctacgacaacgacaaggtgcgtgatctcgtgcgcattggccgtgctgactcggtgggcgtgttctgtatggctctctcgctgtgcggggacaggctcacggatggcttcgtgccgcgccgcgccatgctctctaacatcggtgccactcaggagcaggtgcaggcgctggtggacgagggaatgctcgaagaggtcgatgacggttggataatccacgattacaccgctcacaatcgcaccaaagagcaggtcatgcacgcgcgagccgacgcgaaggcacgcaagagcaaatcccgtggtcacagcactgtcacagcagtgtcacagcgtgacatgcgtgtgacatcgggacaaacaccagaacaccagaacaccagaacccaaaagaaagaagaagaatattattcttcttccaaagaaatgacacttgccatgttccaagactccacagagttgacggcggcggacagcatgatgcgcaccgcttacccgaacttggatttacaggatgcttggaacgctttctccgtccgtcactatgccagaatcagcaccgtgggggattggatacgcctatggcgtggctggtgtgagaaccgggcgcaaatgggtggtatcccaccgtcgaagccacacgtccacacttgggcttgcgaacacacgttgaaagccttgcatctccaatcgcaggatgacgtgaccgacatggcgtcagccgtcaaaaaagccaatgagctaaaccagaaggaagaaccctagtgaaatacatcagcctgttcagcggcattgaagcagcaactgtcgcatggcaaacactcggatgggagccagtcgcatacgccgaaatcgaaccattccccaaagcagtactcaaacaccactatccgaacgttccagacttaggggacatgacgaaagttaattggaaggaataccaccatgcagcagatgtcgttgtgggaggaagcccctgccaggcattcagcatcgccggactcaggaaggctctggacgatcctcgcggccagctcatgctcgagtatctccgagcttgcgcagaaattgatccggaatggatcgtatgggagaacgtgcccggagttctgtcggctgaacacggacgggctttccagtcgctccttgaagccgtggccgaactctggcctgatggggggggtgcatggcgagtgctggacgctcagttcttcggtgtggcccagcggcgcgagcgtgtgttccttgtcgtcaacactcgagactggcggcgtgccgcgccggtactttttgagcgcgagagcctgtgctgggatcatacgtcgagccgagagaagaggcaaagccttacccagggaactgcgggaggcgttggagacgcagattcggacgctaggggattgatgttggacttccatcagcaggatggacggttcaaggtcagcgatcatcccgacgtgtcgaatacgctcacctcgcacatgggtaccggtggcaacaatgttcccctgattaaggcgttcaaatggagccagggtgagaagatccggagtctggcgattggcgaagtgagtcccactttgagtactgaccataatccagccgtctaccaaattgagagagagagagtgatgtgtcgcgcggacactcaggcgaatgccgcacaaggattcgatctttctccgacattgatggctcacgccggaaaggatgccccattcatctatccgacaactaataggagagactagtggttttcactttcaagattcgcggtggcggagcgggggggggtaagggattcctcgggcaggacgagctttctgccacgctcagcacgcacaatgaccagtttctacatacggaggattcgatgaatggtttgacggttcgcaggttgacgccgttggaatgcgaaaggcttcaaggtttcccggacggatggacggatattccgtggaaggggaagaagcacgcgccggatagtccacgctacaaggcgctcggtaattcgatggcggttcctgtcatgagatggataggtgagggcatccaattggttgaagacaacaagggattgttccaggagaaccccagtgagcagtgacaatccatccaaggagacgtgccgcatggttgatgatcgtgatggtaggcgttgcgtgcgttgtggccgaagcttgtatgcggttggcggttcccggcatcatcggaaactccgtagccaatgcacgagggtggagaagcatcaagtgcagaatctgattctgctttgcggttcgggtacgacgggctgtcatggtttcgttcacatgcatccgactatcgcttatgagaacggctggtgtgtgaaatcgtttcaagaccagttggaagtgccggtacgaacttggcatggactcgtgtatctcaccacagacggcaaatattcatcgacaaaggaacaatcaaatgactgacaacatcaatccatcgcattacaaggatggcccgttcgaatgcatcgaactgtcccgactgttgtcaagcgactggggtcaagccgtccaatactgcttcaggtggcagcacaagaacggtgtcgaagacctgaaaaaagccttgtggttcgttaacgacgcgctcgtgcatggaattccgatttacgccgtaagtgactgggcggaactcgctggtgcattgttccacactctcgccagagaggattgggctggtcttaagagtgtttgggatgcattcactgtctggcatagaggtgatattccgggactcttaaaagacaagatcaatgaaatcgaaaaggaaggcaagtaatcatggaacatatcgtgcagttcgccatcggcattgacgacaaggccatccagaaccgcatcgaggaatacgcctacaaggacgtgctcgacaagatcgtcaaagaaaccatggacactgttttcgcgcgcaccaacgcgtattcgcgggaaaacatgtgtaagaccatgatggaggaagctttgcaaagcttcctcgaagaacgcaaggacgagattatcgacaaggccgcgaacatgcttgccgaccggttccaacggacgaagaaatatcgggaagccataggtgccgtcatcgcaaaggatggtgagtgatggataagacgagggttgccctcacggcgattatctgcatcacgattgtcttgacttcgttcagcttaggaatggcgcctaatgtcggcacgaatgccaatacgggttttcaaatggaaacggtcaagaccggtgacgtgacatgggcgtgtttgaaacataacagagaatatatcggttgcagcacggtggagacggtcaaatgagtgttttcacaggcaagaccggctacatcgtctggccgcaaggtgagacgggagtgcacacatgccgcgtgtatgactcactggatgaagctgtgggcgcggcacgttccaaagccgacttctaccacagggcatacgtggtgcgtaccgcttatgagagtccggcaagaaccatcagaacaatcctcccaaggagacaccaatgagcgacaaagtgaaagtcggcacgagcaaggtcacgttccgtgtgcgcgcgttcgactatccgcagatcgaactcgcatccgtcgaagtggatgtgccgatgtacacgaagacggacaacaagctcgacaacatgcagcagggacatgtcacggcggacgtgccggacggtttcaacgagaaggtcaaagacgcattgcaggtgttcgcggacactctacaggcatcgttcaacgaagaaggagagtgaaatgttgagaagcattgatttcaaaacaatgccttacctgtttaccgacaaggctggcacttgtctgaccgtggagttcgacgggagggaactggatgacatctacaagcaggtgaaagccatgtacgatcaggcgcactcgtctgatgacatgcccaccgaaccgggctggtatgcgactcgggatggtgaagacctgttgagctacgacggtgacgcttggcacattcacaatatcgactgtgatgcgcaattgttcgctgacggggatttggaaacgatggactggagcgtggtcaaacgcacgttcgatgctgacgctttcccgctgataccagtgaatcttaacgatacatctcgtgcggagcgtcggttgaccaacctcaccaactttttgcacacgctcattcatgaatgtgagacagtgcgggacaacccatcttccgacaagcatacgaaagacatcgagaatgccgtctgcgggacgggaatcaacttcggcaaagacctgctcgcacgattggaaaacggggtgttcgaccatgaacgtgcatgaaagcctatccgactggcggtcgctgcccatgagcatgctcgacgggcatagggcgataatccaactcaacgaaggcacgatcatcgacgggtatctgagatacgtgccgtcgaaactccgcaaggaattacgaggcgcgacggaaggaatctgcgaatcattgatggttgaaggcgtgtaccagccggtcatcatcagcgtgaacgcaggcggaaagcatgtggttgatggcgtgaaggcattgaacatactcaaggaggtgagcgcatgagcgaccaatacgcggtcagcatccgtcatagctacaccatgccggatgagacattctatggatatgagctggtcttatggcattgggacgtgatcgagaacacttggctgtttcgtgcgacacgcgaatacccagtatccaagaccgtctcacggaaacaagcgttggaacaggcgctttacgacgctgaggaattggctcgaatcttccaatgcaaaaactatggaaccaacgaagaaggaatgtggggaggccgtgagtgatgttcgggcgtaagaagaagccccagcccaagagttatcttcgatgcccttactgcggtgacgcgccaataatagttagcggcaaatgcacatatcacaatccacgtcataccgtctaccggtacgagtgcgtattgaagtgtcttcaaggcgaggtctgtcagactgccgaagatgcgttcaactcgtggatacgcgctgtcgcacgctattacgacgccgagagtgcgataagacaattctgcgagcagaagaaggatgaatgatgtgcgtgagactcggcttcattaaacccggttatgcagaggtctactgcgcccattgcggttattgcatcggatatgtccaccgcgaagaggtgatcgtgtccacgaacctcgataccgggcggcaaaccactgtgaacaggtggtttccggaaacgaatgatggcgacgcatggagcagggcgcatggcggcggcttcgcggataggaccgatgaagaatccaatcgactgttcacgtccggctgggccactcgcggtgaggctgtgagaatgctcaaatgcttggactgcgaggagaagacaacatgagtctggatgatgtttgctggaatatttcaagcgtgttcatcgtcatcaccttgggagtgatagcgatactctgcgtactcacgctattaggcgtgttcgtatgcatcttcgaccatgacgataagaacgataagagcagtaaggaataacaatggcgacgaacgtgactgagaaagacaagacactgcatgaggtcatcgactttctgcaaaaagagtgggatgcagctaataacgcttctgataatccagacgaagaagtgtacgacttttacgacggaatgacgacggcttacgagcatgtaatcaattactgccgtcacatgctcggctattccggcaccatgccttccgaggtacccaatcaaagcgaggacgcgaaggaatagttatgtggttcaaacgcagacgcaacgaatatgggtgtccaatgtgcggcagactaccagtaatcaaggcatcgcaaacggaaaaataccacgagagccgcaaagtaaggacaacactcacagtctaccggctccaatgtccacgtggacatatctctaccagctggttcagccacgccgcactcgcaagcaggcagtggaaagaactcgtggacgagtacaaggggaaggatacgaaatgagcgcgtatcagcctgttcttgaccccgcctgcggcggccgaatgttctggtttgacaaatcggatgatcgggtgctttttggtgatgtgcgtgatgagagctgggaattgtgcgatgggcgtaggttcgatgtcaagccggacatgctgatggactaccgcgacctgccgttccccgactggacgttccgcatggtggtgctcgacccgccccacctgcgcaatgcgggggaaacgagctacatggcgcagaaatacggttgcctcgaccaagagacgtggaaagctgacctcaagaccatgttcagcgagtgctatcgacaccgcgttgaccgcgtacgagcagcaggtcgaaccactcctcaaaaagtaaggaccaagtattatgaaatcgttaccatcggaagaaaatggaatttcggttattgttccttcgtttcagtccaatttggaacaactttgccgatgtctaaaaagtatttctaatcaaatagctgataatttaaatattgaatgctatgtcatttttgatggtgaaccgtttaaaaatattcaacatatattagatatatatccaaattttcattttatcactatcaagcatagtggagtttctattgctcgcaatgagggcattcaacattcacattgcaggtatctcactttcgtagacgtagatgatgaattgcctgatcatgcattaaaaaaaatgtatgattatgctgaacagaattcttgtgacattgttcaaggggcatatgaagcagttctttccactggcaaagagttgcattcctataaaaagcaaagacagctttatatacgtaatgatgagttgatggcttttagaaaagacgttcttcatcctgattctggaacgagtttggtgtggggaaaattatttcgcagatctcttattgttgaaggggatatcgaatttgattctgacatggaagtaagtgaagatacggcttttgtttttgatgcatgcagtaaggctcatgtgattggttttatccctgatattgtatatcgatattatagaagcacttcttctacagtatcttcattccggaaagactatgaaatacgtatccttaacgcaattcagcatatgtcggagcatgtcaattcgttttcttgcaaaaatgagtatgctgattcttttaatagctatgttttattccatctgcttcttgttcagcagcattttatatttaataaagctgctccgtggaatgaagcagaacgacgtcgaatttataataaaacaatccaccaaagcatttttaaaaatgcgcttaagttagttagttatagagattttcctttagttaagagaattgctcttttttctttaaagaaaaaaatgtataattttagtaaacttatttcatatatacgatatattcagttcataatataatttcatgttgatattctaagtcaaggtatattttatatggggaaatataaagaattactgttaaatacaggattatttgcaattagttcgatttcgtctaaattaattagtttcattctcgttcctttatatacatattacttgtccacctctgaatatggcgtaacggacatgtctgtgatagtcatctctcttatcacaccgttgtgtacaggatcgattactgatgcggttttgagatttgctattgatgataggaaacagtctgcaaaatatatctcaataggtttgcaagtcactatattcagtattctgatagttgggttattactccctctgcttgatttgccttttttgggtggacttggacagtataagcttttatttctgttaaattatatcgtaagtatcttacagctttttttgagtaatgtggcaagaattaataatcagcttaagttaatccctattagttcagttatctcatctttgagtaatatgttttttgcatatatatttattgttttagagaatctgagagttaatgggtatttttattcaatgatcctttctggtgttttaggtattattgcctttatttggaataagaacatgcatataccgataattttggataaaagtaatattcagctgttaaagcgtatgtttgtttttgctcttccactagtacccaatgcggtattctggtggattggaaccagtgtcaatcgttttttaattaccagtatgattggtatcgcctcttctggtctattcgcagctgcaagtaaaatacctaacctaattacaatggtctatcaaatatttcaacaggcgtggaatctttccgtgttccaagaatttagacattcagggctagctagattttatgaaaatatattcaaaataattttatctattttgtctgtttctgcgtctgtgttgattgtttcctctaaacctatcgcggagctttttttacaaaaaaatttttattctagttggacattaatgcctttattgattgtagcggtttattttaattcgctaaattcttttctggggacaatctcgaccgcttgcatgaaaacaaagaatcttcttgtaactacattttttggtgctttgttaaatatttgtttcacttggattcttattccaatatgtggattatatggtgcatgtattggaatggtgatcagtaattttgcaattctggttttgagatttattatttcacttcgtttattaaaatttcatatcccatgggtgtctatggctatgttatttgctggattgtccttacaagctatactgaagatatattctggttttccctctttgttgattcagatttgtttgatattcgttatttgggttatttctatcagcatgattgctcccctggccaattatttaaatttcaatcgtcgaaaaggatagtatctaaatgatacaaaataaaattagctggtctgatttacctgtagactttctgttattgaaaacagaaaagaagattcttgatttaattaatcctaagccttggccgattcaatgctttggtaatttatatcaaagtctgaatgacaaattatctgttttctattcagactttttcaaaaccgagttatccaagtttactgcgtgtgctgagagtgctgaaccgtatcgggggagcaaggcggagacggctccaatttggatgctttggctgcaaggcccatcaaatgtgccagaagaattattgatttgtattaattcaatcagagcgcattcttgcggtcatcctgttaacctgcttagtctttctgatgcgaaagaattagttgacatacctagctatttaatttccttatatgaaagtggccaattgcgccctgctttactatgtgattatattcgtgctgctttgctggaacggtacggtggaatatggttagatacttccgttttattaattcacgatcttccctcttggattcttaatgttccattctggtcagttaaaggtcttgattattttcctttttcacctgtagtgccagatggaagacgatggcaaatctatgcaatggctggacagccgcatgctttgttctataaagcgttttgcgaactattccttgaatatgtccaaagaattgatacatccatcgattattttatgtcgtaccagatatcttatttattgagagaaaatgtgcctgcgattgcggcatcatatgaacgtgtgcccaataacaacagtaaatgtgaatctttgcaagcatatttgcaaggatatcagcccgttcgttctcgaggtatacagtcagtctttaacgatgatactttcctttacaaattatctcgatacgatgctggactgattcagaatgcggcaggaataatcgacgatctcaaaaaaacgaaggatttaatattatgaaacatgcgtatttgattattgctcatgataaaccagatgagcttatgcgattactctccgcgttggattatagtgaaaacgacatttatgttcacttggatcgtaagtcaacctgcttttctattgaaatacttaaagaacaggtatgcaaaagtgacctgtattttgtgccaaggattgatgtaacttggggcggacaatcgcagatacaggcggaacttagccttttttctgaggcctttgcgcatggcggttataggtattatcatctcctttctggtattgattatccagttaagtcgcaagaatacattcataattattttaataggacagatggtacaaattatatctcgttaaaagatatcgatgatgaatccaaacgattcaaaatgcgttttgaacaatatcatttattccatgaacgatttgtagggaagaagcgtaatatttggaaatatgtagattttgcatgctgttatttacagaaaataatcggcatacgacgttttaaaggccaatctatgaaacgtcatagcaattgggttagtgttaccgacaaggttgtccagacgatagtaagaaacaaagatcgtatccttaaagaatatcgctggacttattgttgtgatgaagtttttttattgtcggaaatttgggatacacctttgcggaaaacgctatcttcaaaaggaaatttgaggtatatggagtgggtgcatatttcgggaagagattactcgccacggcttattaccgaaaaggatattgatattcttgctgatccgaatattttatttgcaagaaagtttactcttccacaatcaaaaaagatttatgactatctagataaaaatattctttaaaaaatgttttgcacaaattgtgtatggaatgagaggtgtcgttaatccgttgattaacgacacctctcatcgtggcagaaattattttttaattattttgttgtggccacgcagttcggtgtgatgtcagtgatggcctggccgccggagacggccgcggactcgcccttcacgtcatacagcttcccgccgttgtcatcggtcacggagccatacgagaacgacaggccggtcttcacggagcccgcagaaggcaccgaggccttccaccagccgccgcacgccttcgtcatctccataccgccggtcgagtccggggtcccatacacgcgccactgcagacgcacgcgcgactgaacggacgacggcttgtaccacaccgtcaacggctccgcgctacggaacgcccacctctgcgaggtggagccgttcgacgaccacacctgcacgttcgcgccgtccttcctcgaggcgccggccacgtccagatccaggccatccgccaacgcggacaccagcctgtacgaggagccgtccctcaccgcgacccacttctgggaacgcgagccgttcgacgcgtactgctgcgcgttcgcgccaggcttcttcgaaccgcccgccacgtccaggaccttgcccgacctcacggccttcagcgtcacatagcccttcgagtcatgggacacgacccacctctgcgaggtggagccgttcgacgaccacacctgcacgttcgccttgtctgacttcgaaccgcccgccacgtccaggaccaggccgtccttcaacgcggtagacaccacgtactcgccgtccgccagatccgacgcgtgggccttcgccaacgcgtccacctgcgcgtaccgcgcatcggagaacgcccacctctgcgaggtggagccgttcgacgaccacacctgcacgttcgcgccgtccttcctcgaggcgccggccacgtccagatccaggccatccgccaacgcggacaccagcctgtacgaggagccgtccctcaccgcgacccacttctgggaacgcgagccgttcgacgcgtactgctgcgcgttcgcgccaggcttcttcgaaccgcccgccacgtccaggaccttgcccgacctcacggccttcagcgtcacatagcccttcgagtcatgggacacgacccacctctgcgaggtggagccgttcgacgaccacacctgcacgttcgccttgtctgacttcgaaccgcccgccacgtccaggaccaggccgtccttcaacgcggtagacaccacgtactcgccgtccgccagatccgacgcgtgggccttcgccaacgcgtccacctgcgcgtacggatcctgcgggccggagaccgtcaccgtgacggacgcggacttgccgcccgcggtggccttgatggtcgcggtgccggccttcgagccggccgtgaccacgcccgtgcccatcacgttcgcgaccgagctgtccgagctcgtccacgagaccttccggtccgtcgcgttgtcgggcctgaccgtcgcggtcaattgcacgctcgcgcccgccttcaggctcagcttgccgtccttcacgccgtcacccgagatcgagacggacgtgaccgggatggtggtctcgcactcgaccgcgcccagggccgcggaggagccgtcccacttcacgatgccgccgttgtagtctaggcccggctggcgggatcccggatactgctggctgccgccgtcgttgaagatcaccttcgcgccggacgcgaggttgtccggcacgacgtacttgtacaggccggtcttgccgcagccgtcggtcgcgctcggggcggccatctccacgcccggccaggccgcgttgttcaccgcggtcgcgccgtcgccggtgtacacgtacgcgtagatcttgccccagccggacggcttcgaagcgtagacggtgttcttcgcgaccgggtccggaggaagctcaccggtcacggtcacggtgatcgtcgaggtcttggtcccggacttcgcggtgatcgtggccgttccggccttcctcggggtgaccacgcccttcgggctgacggtcgccacgtccttgtcggacgagctccagctcacggacgcgcccttcggatcggtcgtggcggtcaactgcttcgtggccacgccattggacaggtccacgctgtaatccgactgatcaatcctcacagacttggtttcgaccggaggctcttcgccgccgatgttggccatcttcacgctgaacatgtcgtcatcggacttctcgaaggagttgttcacctgagaaccggtgtccggcaggtcggcattgtcgttcattgccagatcgtacggcagggaatccatggcggacagaccgaaggtggctgccagttcgatgccgatgccgctcgaggcaatgcggtcagcggtggtgccgatctcttccagcgggatggcgatctcgtagtgatcatccatctgagcggaattgtggcccttctcgttgaagttgacccacttggccttgttctggttctcggccttcatatcgccgatgaaacgaccgttgttttcaccccagccaccgtcgatgccgatgacatccttgcttagaatgccattgccatagccgaacttgatgttcgacttcttggtgttggtggcggcgttagcagccggaccatacgcagccttggagttcagaccgctctcgtcgcccttgtaaatccacggcccgttggaaccgttggtggaaatggtcaccacgttattgagcttctgctcgccaccccaagtgatgttggatgcccacagggaaccgccggtctgcagaccgccgttgttgccgatgcaggtgctgtcatccttggtgtcgatggcgatgtggaacggcaggttctgggtctgccacaggtggccttggctcagggggtagtcgtcgccagtgtcgacgacatcctgcacgttagtcatttcccacatgaggtacaggttgtcgtcatcgtaggcgccatacaacgcatacagatcgatcggaacctcatacatggaattcgggcggtacacgcgcgggtcgtcgttggcggcgccctgcgcgatcagcatggagctgtcccagtcagcgatgctcgcatccttcccggcgttgaagttgatggtcttcttgacgcccatgcccaccttgttggtactgtactgcgcggcaaggttctgcttcgggacctccaccttcttcacggtcacggaagcgctcagcgcctgacccttcttaaccttcttgccatccttggcggcggtgccggtcaccttgacggtagcggtctcgccgatggaaagagttttaccaacggaaatgacctttccgtcagtgaaggagccgctctcgccctcggtggtggtgtacttcagattgtcggcatcctgcgcgcgcaacgtgaccttgacattgtcggaggagaattccttggaagccgcttccacggacacgttcggatcggattcgcccttcacgtagaagacgctgaccgcgccgcccttggcggtaccggaaacgatcttatggttggagaccacaagctggccgccattgacctcatccgggtaggtgccatcgtcaagtgtggtttccatgccggaaaggctcttgtcgccacccatgttggcaatgaccacaccatcgttctgaatgccatcagacgtggagcgctcaatcatcaggcaggacttgtcgccgcagttctgcaggttctcgcccttgccatccatggcgttacggaagtggttgactgccgcgacggacttgttcttccacatgtcgtcaccggcgtcacccagctgggactgctcggcgaactgcgggttggtgccgccagagcccttcggacggttgaagtacagcggagcgccggccctacgggaaccaacgaccgcccagcccatcatgatctgatagtcggtgaggccggtggattccttgtcgccgttggcgtagttatcgtgggactcaacccaggtgaccagctggtcttcgcttgcgccgccggtatcgatgttcttcaccatcttgacgtcaaggttgttcgagccgacagcggcgcgaatggtcttgccgtagttggaagcggtgttgccgccgccatcggaggaattgtcgcggaacatgttggcgtatgccttgtagtcaaggccggaatcgccctgcagcacctcgccgtactggaactgggagccgttcttcagaatggtgttccagtagttcgactgcttattgtcgaagacttcggtcggcagctcgacgtgctttgccgcatcgtaacggaagccgtcaacgccgtccgccacagcggtcttcaggaacttctgcatacgatcggcaacagcttggttctgcgtattcagatcccacaggccaagcaggtggcactgcgtcaccttgtaacggttggaataatcgttgatctcgccgttggggccgtcgcaaccggtacgcttgtggaagtagtccttgttttgccaatcggggtcgatggcgttccaatcggaggtgaagtggttggcgaccacatccacgatcacacgcacaccatacttatgggcggtggcggtcatttccttcaggtcggcttcggtgccgaccacgaagttgccgatggaggtgtttgccggctggtacacgtagtaccagttctcggtgaacttcttgccgttggcggcgacttccttgatcttgctcataggctcggtctgcacggaggtgtagcccgccgcggcgatctcaggcatgtgctgcgtgatggtcttgaacgaccacatccatgcgtgcaggatggcgccgttcttcatgtgcttggtcagaccgtactggttacgggccgactcgaaagaaggatttccgatggtgtcctgatagctgtcacgatcggcggcaagtgcggtggatgccacacccataccgccgaacaatgtggcgaccgccaccgttcccgctgcgaccttcttccaggtcttgacggcgcgtgctttacgggccgcgcgtctgcgctccgcacgagtcatcagctcaggctgatcctcatgaggaggctcttttctggtgagtgcgttcgccatacccgcgaacgtatgagtgctaagtcgcactttaccctccctgcttccttgcatcttcgatatgataacgtttgccattagcatacgttgcgttaaaaataccacatttttcctttgaaaaatgagtgatttttactgaaaaacagcggttaaaacgcaattgttttctgctctgttgcaaacgctgtcagcaacagatacacccataccagcaccccgtaacacccactatcgtcgcaaattcacatatgcaaacgtttcagaaaattttccaaccaataccaccttgcaacacaaagcatcctcgcctcaccccaagccaccgacagcccaaccccaacaatcctgaaattaatctttcaagagatgctcaaaaagggcttctttacctcttatggcatgcaacatgccaatcaaatcaaaatatcaataataaaaaatgggtgaatatcacaaacacgctcggactcaaaaaaaagagtagggccaagctatggtgaatcaatccatggacctaaaagaattatcaggcaacgatttgggagcggatgggggcgggggttaccgcacggtgtttgcgcatgcttttcaggattttgcggatcgcaccgttcgtctgttcggcggcgacgcagaacatgctgaattcgcggccatgcgggtcggcgatgtccttcggctggggaatcatcggacgaatcatcgaggacttcttgattaccgactgaagacgttcctggatggtcagtccggcaatcatattgttgcgagcgcagtaatcgcacatattcgcgaaatcgtcaagcaggaacgtgtatcgtacggcggctggcgccaacgtgacgatttccttgcgctgctgcttttcgaagcagaggatcaggtcggcttcgtcggccatctgtcgggtcagtcgtcgggaacggaagccgctcgactcaatgccgacgctttgcataaggcggccgctcgacggatcgatcggatgcatcggcaaaccacgcgtgccggcgcttgacacctgcacggtggtgccgttcagatagtgggtcatcagaagctcgcccataggggaacggcaaatgttgcccgtgcagacgaacatgatgtgcatgcctaaaccccttaaccgttcttccaacgtttcgtgttgcggttttgcgaaatccaccatggcttccgcaacccgccaaacggaaattttagcgcgaggcgttccccgcatgcggcaaatcgtccaatacgcgcagaatcattgcagaaattcggcgcgggcggtggcggtcagcgaatagcggatcgggcgggagccgtggaactcgagcaggttcctgttcaccagttccgcgagcgcggtgttggtcttccgctcccccacgccaagccattcgcgcattaggcggcgcgatatgggtttcggagcatcgtcgaaaagctcctcctgcagcaggaagtacagcatgttccgctgcagttccgtaatgccctgcgttcgcgcataatgttcaagcctcttccgcgcggtgtcaagcagggttttcttctcgccgagcacagagatgatgttcttctgggcggtggcgataaaacggatcatccgatatgagaacagcgagacgtcagaacagttcagcggatgctgcgcatcatcaaacgccttgtaataccggcctttcgcgtcggcgataaccggactcaggctgatcgccgtcggtatggacaggtgcttgctcagctgcagagcaagcaggaaccggcccgtcctgccattgccgtcatagaacgggtgaatgcattcgaaggcgtaatggcacatcacagcccgcagcagcggaggaatcgcctcatccgaaagcaacgccagccatttggtcaattgcacttggatttccgattccggccatgcgccttgatgaatctcccggtcaaagccgtcacacacagagacttgcttggctctgaataccattccgtcaggcttgtcttcctcccgtagttccccagccatcacctgatcgtaaatattacgtatgtcatgcaacgttttcggtagttccaacgttgcggaattttcgccggagagtccgagaaagagtttggcaagctcactcaaccgcttgtgcggcccgtccgcgaccgccgcatccaacgcgtctgagatttccttgcgcgtggtgtgcacggcttctatggagttcgtgctctgcatttccgcgccgatgagttccatcagatacgccctgcgggcaatcggcggcaatgcggcccacagcgattcgacctgcacttccatgccacggaccgaatccatgacgttcaacagttccctgaacgccacggcgaacatctcatgaccttcgaattcaatacctgaccggtatgttgaatagccgttgagtcttttttggtattcctcctcagccgcatccttcggcttggccgtggatgatgacattgccaatgtctgccgtatgcttttgtactccataaccatcatccttataaccgtcatttgtgcagaatatgcaggttcggggtgaatatagactattcctatacctacataatgtcaaaaatgtcgatatagcagcaggcgtgtttgcggctattggtacgttgaggggcatatgtggggatacgtgcggatatgtttgctatgcgcagatatgttcaagcgcagattaggtgcgggtcaggcgacttcgagggtggcgaggagggcgcggtggtcggagccggggatgtatgcagttttgaggttgcctacggtcacgcctttgtcatgcacgatatggtcgatttcggcgatcggcattatggccgggtatgtcatgtgcaggccttcgcccgcctgctggccggaatccaggaagcggctgccgagcaggtatcggaagctggcgtggtcccatgtggagttgaaatcgcccatcagcacgtacagattgtcgtaatgctgcagttgggcgagcgagtcgagactacggttccacagaccttggttgcgggggcgcggcgagaacgggtggacggagccgaagcgcaccttgctgccgccgaaatcgatcgtcgcggcggaaacgctgcttgattccacgggaatgaggttctgtttggcgttttccatcggcgcggcgctgtacagcacgttcacaccgccgttgtcatgccacgtttgctgcgcggccacggaatacggcagataattggcgattccggcgccgttgagccggttgagcaagtcccatgacacttcctgcagcgcgagcacttccacatgctcgtttttgacgatttcgacgatccgattggcgtcggcatgcccttccttggtgttgaaggtcatgatgcgggcgtaccggtcggacgtgttgggcaagccgtcggacgagacctgcgtgactgcggtgctggccgcgtcggaaatcgtttgctgcggcctgatataaccccaatgccagccgatttgcacaaccacgcacaccacgctgacggtggcgagtaggacgcgttcgcctattgcacggacggctatcgcggtgatcgcaataatcaaagacagtatgcccagccacggcatcagcgcgacgataagcggcacgtaccgtttgccgtcgaggttgttgggcagcatgcgcagcagcatggccagcaggatgacggcggtgtccagccagagcaccgcggtcagaaggtgtgttgctgcggtacggcgggtcatgccatgttgcgcgcggtcgagggggcggctggcgcatgctttgtcgagctgcgcgcccagatcctcgatttcgctttcgcttgtgcgttcgcgttcggcatcgttattgccgccgttctcacgctcgctttcgcaggtttgccgcatggttgcctttcattacgttcccgttcaccatacgcaacacggcacgggtgcgccacctccttcccgcgaggttcacagtgcttttacgtgcacccgtaccgcatgccactatgcggacatttctctctcatttcctgctgcggggaatggcggcacttgagcaaaccacgctcaggacatgcctacggaacggcgaaaatgcgggtatgggcgagtaggtcaggctaggcggcgtgggggtggacgcgattgagggcgcgctggacggtgtcgcgggtggagccggcgccgttgccgcggacgccgaagaagaccatgaccaccatgatgaagcagatggtggcgctcacgcgcagcgcccactggatgccgaacacgttcgccacggcatacatgttcttcgcgccgccgatcgcagcccagcgcagggcggtaaacgtttccatcagaatcaccagcacgggtgcgccgatggcaccggcaatctggcggaccgtgttcgtaacggccgagccgtcgctcacctcctcaggttccagacagttcagcgaccacgtggtgatcggcataagcacgaatcccatgccgatctggcgcacgaactgccaaatcgacacccaccaaatccatgaggtcatggaaatcagactcatcataatggtgccgaacagcagggtgatcgagccgatcagcgccaccggacgcgcgccgaaacggtcgagtgccttgccgccgaagaactgcgcaatgcactggccgaacgcgccgggcaacatcaccagaccgctgatcgtggcggaatagcctcggcaatcctgaatgtagagcggcatgaccaccatgatcgaactgaacgcgaagaacgacagcgcggcggtgacggtgccgacggtgaagctcttgtttttcagcacgctcaggttgagcagcggaggctgcttggacgggtcggcagcctgcctgcgagcgccgtggatctggcgcagcacgaaccagacgatgccgaccaggccgatgagcatggcgagccacaccatcggatgcgtgaacggatacgattcgatgttcgtgaagccgaacatgaggccgccgaagccgaaaatcgacaggccgacggagaagaagtcggctttggcggacgcgtcgcacgtgccgaaattacgcaagccgaaaatcgcaagaagcagcgaaataacgccgatgaccgtcagcgtgaggaaaatcgatcgccagccgttcaaatcggtttgcacaccacccaaggtggggccaatcgcgggcgcgacgctcatggccatgccgacggtgcccatcgccataccgcggcgggacagaggataaatggagaataccgtgatttgcaggaccggccacatcacgccggtgccgacggcttccagcagacggccgatcaaaaccagtacgaacgatgagccgagccaggcgaacaccgagccgagcgtgaacaccgccatcgacgcgatcacgatctggcgggtggagaatcggcgggtcaggtaggcggtgagcggcaccataacgcccatgacgagctggaaaatcgacgtcagccattggccggtcgtcacggaaatgccgaaatcggacacgatggtgggcagtgcggcgctcaactgcagctgagtgaagttgccgacgaacgtgataaaggtgagaatggcgatcgatacgaacgcggcatgcgtcagatggtcgtttttatacgattcctcgccggtaagcggctgggacaggccgtgggtgcggccctgtttcgcgtttattttcttttccggcttcacttccgacctcttctccggtttcgacggcaaaccgaccgccctccatcactcatccgcgcatactcgcagcgtattgcgcaactcctgcaaaaacagactcaaaaagtctagtactgcgggtggtcgaacgcgagatgaaactattcgaacacgttcaattccaattcaaccgagaaaaattggcaaaacttcgtatttgttcatctcggggtggtatacatatgcgttggcagtaacggcacgatacagggaaggaatacgccgcgcagggggttaggaagtatgaccgtagtcacgttattcaacatagcgatggagctatggggcgttctcatctgcatcgtttgcgcaggtggcgtctacgtgggcgcgatacgtaggacgcggcgtacctatacgaaagtttccatgcagcttctatgtgcgctgatgctgctggccgacgtgtccgcctggtatcacaacggcggctgcgacaagcttgacttctacatgacgcgcatcggcaatcttggtgaatacctgatcaatttcatcttcatcgcactgttcgccaactatatctggcaaaccgtcagcggcgacgacatgcttgaaaacgtcagcccgcacgagtggagggccagaacgagcggcggagccaagcgtaatcgtaagaaccaacgttcggccaacgcccaatccaagccgaaaaagccgcgttcgaagaagcttgacgtcatctacgcagcgtccgcgctcggcatcgtactgacgattgccacgcagttcaaccatatggtctactacatcgacagccagaactactaccgccgcggaccactgttcgctatcccgcagatactgggtctggtagagctcgcgctgattgtgatgctgatcatcgaaaaccgcaaaaacctcagccgaccgctgttcgtcacgtcgctgtcgttcttcgtgctgccgattgtggcaaccatcgttcagattctccattacggactggcgttgcaggccatcgcgatcacgatttccatccagttcacgttcgtggtcgacaccatcgaaatgaacaagaaaatccgttcgcaggatgacgcctatcagaaggtcagctacgaggcgcagcacgatggtctgaccgatttgtggagcaagagcgccggccgcgagcagattgagaattatttcgcgcacatgcaggaaggcgaccaggctgttctgattttcgttgacatcgacgatttcaagcagatcaacgatacgtacggccataaagtgggcgatttctggattcgtgaagtggcgcagacgttgaagcggctgtaccggcatgatgacatcatcgtccgtttcggtggcgatgagtatgtggcgctgataaagaacaccgcgaacgagcgcgtgatcgaaagcacgctggacctgttccgccgccagttggcgcaggcgtccgcgcaatacgggcaggacgtgcattgcagtatcggcgcatgccgcgtgctgtccggcaagaacgtcgatctgaacctctgcttgggattcgccgaccatgcgttgtaccagtccaagcgcgaggggaagggcatgtacaccgtggtcgattatgacagcgggaaagtgcaggcagcgtaggtttcgtggaaaaatccgcaggaaatctgcgggaaaaaccctagaaaatcagctgagaaactacgaaaaaagcgccgcaaatccgccggagatcgacgtaaaaatcacggaaaatcaggctttgccgagcattgtcagcacaatcagcaccacgttcagagcgacgatcagcgcggcgaccgcgatattgacgacgtgcttgaccggaccgtccacatactcccccatcagcgtgcggtcgtgcgtgtagcgcatcagcggaataatcgcaaatggaatgccgaccgacagcacgacctggccgacgatcaacgcttccgtcggattgttggcgaaccatagcaccaccagcgcgggtaccagcgtcaccactcggcacgcccacatcggcgctttgatgcgtagcaggccgtgcatgatttcgctgccggcgtaagtgccgaccgacgtggagctcaggctcgacgcaagcagaccaatcgagaaaatcgtgccgatcaccggcccgagcacatgctggatggcccgttgcgcgccttcgatggtgtcggtgccggtcatgccgtacagcgagttcgcggcgaggatgagcagcgcgaggttgaccgaaccggccagtatcagcgcccaggcaacgtcgattttgctgccgtgaagtagctttttgatgctcggcttcgcttcgccgggggcgtaatggtcgttgacgagcgtggaatgcaggtagatggcgtgcggcatgaccgtggcgcccagcatggacgtggccatgagcacggtatcagtgcctttgaagcgtggaatcaagccggcgacgacttctttcggatttggcggggcgatgaacaggccggcgatgaaaccgaacgtaatcaccagcagcaggccgatgatgagtttttcgaaaatgcgatgcgtggcgcctttttcgaaaatcagcagcaccgtcgacaccgcgccgatgatgcagccgccgacgaacagcggcaggccgaacagcagtttcagcgcgatcgcgccgccgatcacttccgccagatcggtggcgatggcgattacctcagcctgcatgaagaacatgaaacggcccgcgtcgccaagccgttcgcccaagatttccggcaggcttttgccggtgacgatgccgagtttcgcggactggtattggatgagcacgctcatgcagttagccaacaccagcacccacaccagcaggtagccgtagcgcgcgcccgacgtgatgttcgccgccacgttgcccggatccacgtatgcgaccgccgccacgaacgcggggccgaggatgccggcgagcgcgtggccgtggtggtgggacggttgggagtggtggtgcgtgggttgctgggctcctgcaggccgtgcgtccgtgctctccgcgggccgcacgtccgcgctctccgtactcatagtgccgtcttcttcgttctctgtatccgacttcatatccaaatcgttcttcatatccgggcaacgttatagcgcgtccgcccgcacggaattgttacgtctgttacgggaggttgaataatcgttggatatgcgtctggtgcggggtaagcgcagggctccagtgcgggttgttggtgcaggttgttgacgcagactgccgatgcaggttgccgatgttgcggacacaggttcaggcgggctgccacgcacaggttcaggcgggtcgcggacacaggccggacaacctacgagcgcaacagccgctacactggtgcgaagaacattgcatttcgactcaaggggttgttccatggctgttttccacactccgatgatcacgcttcccgacggcaatctgattccgcagatcggcttgggcgtgctgcgcatcgacgacgagggcgttacccccgtggtcgagagcgcgctggaagccggttatcgccatatcgatggcgctgcggggtacaataacgaggctggcgtcggacgtgcgctgcagaacgcgggcttcacgcagggtgagaatcgcaagaacctgtgggtgacgacgaagctgcgcgattcggaacaggggtacgattccgcacgcaaggcgttcgaccgtcagcttgacctgctgcagctcgattatgtggacatgtatatgctgcattggcccaccccgttcaattggcgttccggcgaaacgtggaaggcgttcgacgagttccgcgcggagggtcgcgtgcgtacgcttggcgtgtgcaatttcctgccggagcatcttgagcggctgcataaggaaacgggcgaatatccggccgtcaaccagatcgaactgcatcccacgtggcagcagcgcgaggtggtggcgtattgcaaggcgcacaatatcgcggtcgaggcgtattcgccgatggcgcgtggcgcggatctcaatgccggcgatggtgtgatcgaacgcatcgcgcgggcgcatggcgtcaccgaagcgcaggtgattctgcggtggcacatcgaaaacggcacgatcatcattcccaagtcggtgcatgcggaccggcagcggcagaatctcgacctgttcggtttcgtactcagctcggccgagcatgcggccatcgatgcgctcgacgggccgacgcgcgccgggcacgatccgatgacgttcacgtacgcgtgagactgcttagggtgcgatgacaaggcacggatcgcgtgacggcacgcattttcgtaagaagctgctcaatgccgacgggccggtggaacgcatactgattctgctggtgatcgccgtggtggcgggcgtcaccatcggcctgctcatgccgaaagcaaacccgaccgtcggcgaaataacaggcgaatacaccgcgtccggcagcgccgcgcagacgctgcagcagctgacggtcgacgataatcagcggcacgccggctacgatcgcgacctgttcggcttccgccaaaccgacgacgacggcaacggatgcgacgtgcgcgaagacgtactggcgcgcgacctgaccgacgtgcgctaccggcagcatggatgcaaagtggaatcgggcacgctggccgacccgtacaccggcaaaacaatccacttcgtacgcggcgcgcgcacctcgtcggcggtgcagatcgaccatgtggtggcgttggagaatgcctggcggtcgggtgcgaaccagtgggaccgtacgaagcggtaccggttcggcaacgacatgtacaacctgctggcggtggacgggccggccaatcaggagaagggctccgcgtcggccgcgtactggctgccgacgaacggcgcataccgttgcgattacgtggcccgtcagatcggcgtgaaagccaagtacgggctgaccgtcacgacgaaggagaagcgggcgatgctgtccgtactgcgtgcctgcccggcgcaggccgtgccggaaaagtaagggacgatcgcaagtacggtctgttcgccgacgtaacagggtacgctaacgaaacatggagcgcaggcggaacgcacctcaatcgcccatatatagcaacgtttgcacgcttacatgcttacgcgtctacgcgcacgtggtggcgcgggcgatcacgcgggtctgcgtggtgatcagttccggctgaagcacgcggctgccgctgatgcggtcgatgatgcgactgaccgcggtcggcgctatccagtcgaggcaggaatccatggtggtcagcggcggctggaaatacgcggattcctcgttgttgtcgaagccgatcacctgcacttggtcgggcacggaaatgccgttggccgccaacgtcgacagcgcgcccatcgcaagctggtcgttcaatgcgatcactccgtcgaacggcacgccggaatcgatgatgcgctgcatattgcgcgcgccagagccgatcgaccaatcgtggccgacgttgggcatcagctcagtggcaagcgcgatattgcggtcacagcacgcttcgaacacgccgcgcatacgaagctgcgcgttgccttccgtagcatcacgcaaagtcgaaagctgcgcgaaatcagtgcgcgagccgaccaccgccggcctgctgacgccacggtcaagcagatattccgtggcgagacgcgcgctttgcacgtcgtccggtgtgacgtggtccgccttgtgatgcgtgaatcgcgcgcccacgcaaaccagcggaaaatccacagacaggtcttcgggggtaaggtcctccatttcggacagcgacaggatcatgccgtcggaaacggtggcgttgaagttgcgcaggagcgaggcggcgccgcgcgacgtgccctcggcgtacgtggtgacgtacacggagtagtcgtagatgcgcgcgatgtcgatcacccgattggcgagccccgcaagatagggggcggtcaggcatggcacggcgagcgtgatgaagccggtccggccacggttgaggttgcgcgcggacacgttgacgcggtagccgagccgatccacgactttctgcactttttcgcgtgtggcgtcggtcatacggccggtgtggttgatgacgttcgacgcggttttgagggacactccggcctcttcggccacgtcacgcaaagtgacgcgcttcttttctgatggcgatttgccggtttgagacgcgaaaggtctcgcttcgctcatggttcccccgatacgcttcgaaatactgcccagtatccctgctacaggggcgattctagcgcctcaccacgagaaccccgttgcggcgcacggtatacgagccgttttcctcaccccgttccgtctggaacaggacgaccggctcgccctcgacgccctgcaattcgacttccttcttgccgcgcggcagatagaaatcgaacgcggcgtcggcagacttgcgcacggtgtgcagaacgtcggtattagcttgcgattgctgcgattgtgccggtgccgcaagatatgtccgaatcagcttcgtcaaatcggccacgtccaggtcacaaccgacgaaatacgcttcgcccgcgccgtacggattgcgggtgaccgcggccatgccgtcgagctcccattcgtcggcctcctcgcctgcgtacatggcgaggacttgcgtgcgatcgccggtaacggtcacgtcgttctgccacaggcgggtcgtggcgccgttcagcgcggctgcatcttccagcgcaacctcaccgccggcacccagccgaatcgcctccggctcgccttccacgccactgccgaggatgttgaattcctcgccgcggatgcccagcatgtcgcgcagcaggccgttgccggcacccgggtagccaccgagccacgtatggaaattctcgtcgatcaggccggtcgcgtaaccgaccaccaccctgccgccggcggccgcgaaatcggccaatcgccgcgtatcgacggcgctcagcatcaggacggtcggcaaaacgacggtcttgtaatcgctccaatcgtatttcagcggcataatgtcggcgcgcgtgccggcatcgaggaacgcgcggtaccagtcgcgcacgtcgtgccaatggttgagtttcatgctcggcaacgtttcggaacgggtggcccattccgattcggcgctgaacaggatcgccgtgtcggagcgttccagctcactaccctgcacacccgcatcggccaatgttcgcaacgtttcgcccagctcgcacacttgacggaatagcttcgtgtcttctcccgcgtgcggaaccatggcggagtggaaggattcggcgccaaatgcggacgcgcgccactggaagaagttgatggcgtcggcgcccatggcaacgtgtgcaagggaatcgcgcaccgtctcccccttgcgcttgcgcatgttgagcggcttccactgcaccgccgaagtggaatgctccatgacataccaaggcttgccaagcgcaaacgaatccatgagagcgtcggagcacgccagttcgtcaaggtgcatctcacccccttcgtggaagtagtggtcgttcgagacgaagttcacttcgttggcccagtcggcatagtccatgcagcactggtccgtggagaccatgaagttcgtggtgaacggcttgtccgggcagatttcggcgatcgcgtcgcgttcggccttgtagaagtcgagaagcatgtcgttgccgaatcgctcgaaatcgagcttctgaccggggttgaccatggaatcggcgcccatgaaccgtgggatgagcacttcgtcgaagtcgttcatctcctgaccccagaaggtggtgccccacgcctggttgagcgcgtcgatggtgccgtacttgcggcggcaccatgcgcggaaggcctcgagcgcattgtcggagtagtcctcgcggttgttccagccgtattcgttgcccatatgccaggcggtcacgtacgggttgctaccgtagcgttcggcgagtttgcggcacagggtcagcgcgtattccttgaataccgggctggtcggactccaggactggcgcgatccggcgttgacctgatggccgtacttgtcgcgcggcagcacttcggggtgcttttcgtacagccacagcggcgcggtggccgttgcggaggccagatcggttgcgatgccggctttgccgagtttttctatgatgcggtcgagccagccgaaattccaacgatcctcggtgggttggatgcggtcccagctgaagatggcgagggcgaccgtgttgacgccggctttttccatcaggcggatgtcgtcgtcccagatctcctcaggccattggtcgggattgtagtcgccgccgaatgcgataccgcggccgttttccgtcagcagtttcggccatgcgaaaggctggcgattgggggttgcggtgggtacggcgggtttgccggtatgaatctgcacgtcattgcctttccgaacgtatttggtacaaccgtgtaccatttgatatttttaatcttaaatacttttgcgattctgtcaaatccagacatacgcatgtatttgcgatcgactgcgaccggctggcattcgctcgcgattagttacgctcatttgcgatcgactggcgctcgactggcagaatcgccctcattcgatatcgcttttcgcacacatccggacgaaagtcaattttccgcaagacgtgagcgaaagagggtggtgcaggacgggagaacacccccatccgctcacggaacgacgaaacgggacgaaatcgcaggacgtgagcgaaaagcctctccttcaaaaatcggaatcgttggaaaataaaggaaacagcaacggacaaaccgaagcggaatgcacccttccgttcacaaacgaatgaaacagacaaaaatcgcaagacgtgaaagaaagagggggccataacacagaggaacatacccccatccgctcacggaacgacgaaacgggacgaaatcgcaggacgtgagcgaaaagccacgaatctcataaaaacagaaccagcaataccctcatcaaatgcagaggaaacagcaccccgccacacaggatcacgagccagcataggatgcgccaaatcaccaatgcggcagcctcgacataatcagcctttcaagccgcgaagagagcatttctaccaggaaaccggcgtatgcaacgcaaccggatgacccgatttacgcgcacgaatcatggcgacgttcatggcgagcgcggcacgatgcggttcatccgacaaatccagttgggtgaccgcgacaatcgtccatcccatactttccagttgacggcgcttccaaacatcgcgacgccactgcatcttatccgtacggtggtggtcgccatcatattcaatgccgatcttcaattccggatcagcgagatcgagcgtgaccgcagccccattctcaaacgaaattcccgaaaccacgtatccaacagcgaaaccagacagaccatacgacagtaagcacaatcgcaattcggtctctttgggcgaatcactgcccgattccaccagcaacaatgccaattggcacttgcgacggccacgaaaggaatttccctcgaggaaaacggcaagtttttccttcgtcgtccgtccatgacgcatctgcgattcagccaattcgaccagcatatcaacgctcaacgtttccgccattgaagcccatgtcggctctggagcaagcacgtcgatgccgtcttgcgtatgacagatatgttcttcggacagccctttccatacatgcgcgaccactcccggaataccttttcggcggtttcgcgcggtctgtaccacgacatgaaccacgggaacaccatctgccgtccgcgccgaatccatcgacggatctggcacaccccacattgcgatcgcggagttccgcgtcagcacgccatacaactcgttacgatctttcaacgcgcggcatacgttccacacctcctgctgccgttgcgcgatcgactgcgcctccaacggcttatagtgctgttgtccgttcggaccattcacatcgttgataccattcatggtccgaaggtattgcttccgccgattcgatgtccagctgcaccggggttgtggtcggagaacgcagaaaatacacatgttcggcgtgtcttcggcgtgtcaggcggggataacttgcgattatggtagatgctttgtgccggcacggcacgctgcggcatggagtgtgtataaatcagtggacaagcggggataggatttctgtgcgattccccgcatttctgcttgtgtatttcgcttggacgttccgtttatgaacgggcggaatgggcccggaacgcaagacgtgagcaaaagagggcgtaaggccgtacgggacgatacccccattcgctcacgaacagacggaacgtgcgaaaatcgcaggacgtgcgcaaaatcacgtcaaacgcaaaatcgaaatcgttggaaaatcaaggaaacgcaaacgaaaggaccggcgcgccacaccccttttcgctcacgaacggccgaaacgcatgaaaatcgcaagacatgagcgaaaaagggtaggaaaccatacggaacgaatccccctttcgctcacggacgaacgaaacgggcgaaaatcgcaagacgtgcgcgacgagccggaatctagagactcaggaagagctcgtgaatgcgggtgtcgtcggtgagttcgggatggaacgccgtggcgagaatcttgccttggcgcagaccgaccacattgccgctcaccgaggtctcaacggtcgcggccgacccaacctcggccacaaacggtccacgaatgaacactagcgggaaatccttcagcacgatggaatcggaggaaatctcagtagtcgaacccgcgcccgacgcggaatcagcgaaccccggcacacgttcgcccggctcaaccaaaacggcggaatcgccagtagcagagccgaaatcggcggtggcggcgaacgagccaagctgacggccgtacgcattgcgtcgcacgacggcgtcaagcgcgccaaagtaaatgttcgaatcattatccagcttgcgggctagcagaatcatgccggcgcaagtgccgaataccggctttccggcggcgatgtgcgctgcgatgggttcgaacaggccggtcgatcgcagcagcttgccctgcgtggtgctttcgccacctggcaggatcacgcgatcgatcgaatcgtcgaaatcctcggccgcgcgcagcagcttccacggcgcgccgaggcgatccagcatggcggcgtgttcggcgaacgcgccctgcacggcgaggatgccggtcacgccatgtttcgcggcttcgacgccggccgattcttccttcgaaatgtattcaactgctacaaccattaccgttcctgtgctttcggatgtgccggctccgcggtgcttctcgctgcccgcggagccggcgtcacgcatgcgccgtgcgggccgtcactcgccgcgcgccgccatgatggtttcgatctcgtcctcgttgatgccgaccatggcctcaccgaggttctcggacaggcgcgcgagcagatcggggtcctgccagttggcggtggcctgcacgatggcggcggcgcgcttggccgggtcgcccgacttgaagatgccggagccgacgaacacgccttcggcacccagctccatcatgagcgcggcatcggccggagtggccacgccaccggctgcgaagttgacgaccggcagacggccattgtcgtgcacgtacttggcgagatcgtacggcacggccagctgcttggcggcctcgtacacctcgtcgtcgcgcagggagacgagttcgcggatctgcttgttcatggtgcgcatgtggcgcacggcctggatgacgtcgccggtgcccggctcgcccttggtgcggatcatggacgcgccttcggcgacacggcgcagtgcttcgcccaggttcttcgcgccgcacacgaacggcacgtcgaactggttcttgtcgatgtggtacacgtcgtcggcaggactcagcacttcggattcatcgatgtaatcgatttcgatggcctgcagaatgcgggcttcggcgatgtggccgatacgaaccttggccatgaccgggatggacacggcttcctgaatgcccttgatcatggccggatcgctcatgcgggaaacaccgccggcagcgcggatgtcggccggaatgcgttcgagcgccatcaccgcgcatgcgcccgcgtcctgtgcgatcttcgcctgctccggggtggtgacatccatgattacgccacccttgagcatctgtgccagattcttgttcagttcgttcctgttgttggccatcgccagcctttcgtcgaaaataatcgtttgctatcgatactaacgatttcccatttcgatttcacgcgaactgaatcttataacctaccaaaaagtcggttttgctaaatttgcaaccttattttcatgattgtttcattggcttatgatttcgattccgtcgacatttcgtcggtttcgtccgtttttcttgctttacctgcgactatggctttcgattcgtccgcttccgtacgccgtcgcgcgcgctatacgaaacacgaatgacatgcgattttcatacgaccacattgcggacgtgcggcgcgtccgtatgcggccgcatgggcatgggcacctaccaggccccgcattacgccgattcacacgctagttcgcacgcatcggctcgccgcatcagttcgcaatccgcacgcgccagctcacatgcgcacgatgcggtccgcgatgcgcatggtggaatcgcggtgcgagacgagcagcaccgcgctcccctgctgcgccaacgcgtcaatcgattgcagaatcacggattcgttgtaggcgtcgaggcgactcgtcggctcgtcgaacaacaccagcgacgcgttgcgcaggaagacgcgagccaggccgatgcgttgccgttcaccttctgaaagccgccctcccaactcgccgacgggggtatcaaggccctgcgggagcgagtcgaccagttcaagcgcggaagccttggcgagcgcggcgcgcagcacgtcatcaccgacagaaaggggcgtccgggtggaaagcgcggaatcagcggcattccacgaaacgggaggagcgggcggggtaagaagcgctctgccggaagtcgcggaatcgtccggatcgccagcattatcagccctatccgcaccgcccatatcgcaggccatgagcaggttttcacggatagtgccgtcgaacaggtaggtttcctgccccatcatcgtttgcacgcgacggcgatgatgcgcgtcgatctgcggcagtggcacctcggacagtgcgactaagccggattgcgggtcccagtaacgcatgagcagcttcagcagggtcgatttgccgcggccggacgggccttggatgccgaggatgccgtgttgtggtatgtcgaacgagacgtggctgaggattggctcggcggacgactcgggggcatccgcatcgcttccggaagttggagcctcgcccgaattgccgtagccgaacgtgacgtcgtgcatggacatgccatggtagcgcggcaggaaatcgccccgctcctccactgcgggggtttcgtccatcagcgcgaacaggcggcgggcggcggcaaacgtttgcgtgagattggccggcagcgcgctcaacgcgagcgtcggaccgaacgagctggccagcagcacgaaagcggcggtcaggcgggcggcgggcgcggaaatgacggtttgaatggttgcggcggaagcgatgggcatcgtcgtaccggacgtgaccatcgccagcaatgccgcgatggcagtgaacagtacgaccagcaccgcgccgaagcctgcgaaatcgccattcttggcactcagccgggcacggcggctccagagcgagcgcgtgcgtgacgcgatgccggcaagccgcgcatggccttggccgaatcggatgatttcgtcgagaccgcgcatatcgtcgagcatttcgtcatcaagttgtgcggattcgcggcgaatatccccaccgagaccgcctaccgccgtggcgaagagtttcggcagcacgatgccgacggtcaggtgcgcgatgaccagcgtgacagcgatcgcagggctcaacgtaagcaatgcgaccgtgtaaagcacggtggtcgcgatggcgatgacaaccggcgaaatggtgtgcgcgaagaagatttccagcagttcgacgtcggtggtgaccagcgcgatcaggtcgcctttgcctttgccggacagtttggcgggcgcgaggcgacgcagcgcggcaaacgttttcgaccggaacagcgcgagcaggcggaaggcgacattgtggttcatgtactgttcggcgtagcgcatgccgccgcggatcagtgcgcagataatcatggctgcgattgccgcaggaaggctgagattccagacttttgcgccagctgcggcgaacagcgcggcgacgccgaaaaccggcaggaacgtggcggcgaggtggccgaggatgccgcacgcgcaggcgatggccatgggtttgcgcagtgggccgacttcgcgcagcaagcgggcgatgacttgggttgttggcatgtccgatttggcgccactggcgttcgattcggcggaaccagacatccgagacacggcaaacgcaccagacgcatgagtcatacgcgatacgcgcggcgcgacgcgaccagacaatcccacccgttccacgctttcctgcgcccggaacagcttggcatacgtgccgtccgcggccatgagatcgtcatgcgcgccctgctcgacgacgacacccccatcaaacactacgacacggtccgcgtcggccgcgttcgccatgcggtgcgtgaccatcagcacggttgcgtcggcgtcggcgagcgcgcgaatcgtttgcaaaatcaacgtttcgctgtccgcgtcgacgctgctggtcgcctcgtcgaaaatatagacggccgacctgcgcaacagtacacgggcgatcgcaatgcgctgtttctgcccgccggacagattcgcgccgtcctgcgtgatcggcatatcgagtcctcgcgattgcgcgcgcacgaaatcgtcgatatgcgcggcttccagcgtctgccacagctcgttgtcggtggcgtcggcgcgggccatgagcaggttgtcgcgcagggtgccggcgaacaggtggctgtgcgcggagacgatggagatttcgcgggtgagcgatgctgcggtgaggtcgcggatttggtgcgatttcagggtttcactgtcatccggcgccgcactgcttaacatagcgcccagcacttcgtcctgcattccggatggcatttcggacagcagcacatcgccttcatatccgacaagcgtgccggcaagcagctggacggctgtggacttgccggaaccggatggcccgacgatcgcagtgacttcgccgggcagcgcacggagggccacgttgcgcaaggcgtagcgcgtttcgcgcgcgtcacccgcgccgccgccctcatcaacgctgtccacatccgcgttccgcatatcggaatgcgatgtggacgatatacgacggggactcgcaacaccggcacccgcagacccggcagcgtcaggccccgcaccagcagcacccccagcatccacatccgcgtccgcataccggtacgaaacaccacgaaactccacgccgacaccacgcccggaagccccgaattccggcagttccttgctgccatgctccggttcgggcgcgtcgagcagcgcgaaaatacgtttcgtggacgtcatgccgttcatcgcaacgtggaaatacgagccgagctgtcgcagcggaatgaagaaatcggcggctagcagaatcgtcagcaataccgcggcgatcggcgtcaaaccaagcggcagcacgccggacagcgcgaaaacgccagacggcgagagcgagccggatacgaatcgccataccgcaacgccgatgccggcggccgcgccaccgtacgccacggcatccatcgccgtgagcgaacgcagttggatctgcagcacgttcatggtcatcacgcggaactgttcggccttctcgtccatgactcgtgcggcgcgctcgtccgcgtcgaaggttttcagcgtctcaagtccctgcagattgtcgaggaacgcggcgcccatatccgtgtatttgccccagtatttcttgaatacgcgggcagcacgcatcgccaccatgccgacgatgagcacgatgagcggcgcgcaggcgagcagcgtcgcggcggtgggcaggtcgatcggcgcaagcacggcgaacagcgtgatgggggcgagcacggcgtagcacagttgcggcaggaacagttcgaagaagctttggatttgttcgatgccttcgcccgcggactgcaccacgccggcggtgcgcacgcgctgcgcgtaggacgggccgagcgcgagcatcttattgaacagtttctcacgcagcgcgagtttgacgcgttcggcggcctcgctaccgaaacgtgcggcggcgcgaatggtgacgaatcgcacgaccgcggcaataagaataatgacgatgcagggcgcggtggcggacggtacgggcgcgaacagcggttgcagcatacgcaccacagccacggcgaaggcgatgttggccacgaggcccagccattggcaggcgactttcgccgcgatcaatcgaccgacgccgtcagccaaggaaaacagccgcttgtcgaacatcatgccccttttccaatcgtttgcaatcccgccatccgctccaagcgtatcgggcataccgacgaaaggcaatgacggaacggcaatcgcagaaaatcgtcggaaaaatatagaaaaccatcagaactcgcaagcaaatgcacaacagcaaaaccacagaaaaccaagggaacggcgaaaagtgaggcggctgaatgttcgccgttgagcaaacagcctaggcgcaaggggtagttgcgccaaacttgagtgtacacggaacatgttgtggttcgcaacgtcactccgcccagttttgccgcattttccaccgttttcgcccgtaagggccacccctctcgaacccgtcgcgcaacccgttggacaccctgcgatcgaacgcgtcaaaccttttttcgagatgatgcatccgtgtaccaatcccccgttccgttgacgtttcgtgccactttgtcagttcaaacaaacccgtcgccgtatttcttgttgtttcttacaatgcggacttacgtcaccgtaacttacgatatgcgaggcgcgacacaggacgcgaaaagcacgtcaccgatcaccgcaatcgcagcgatcgcatatatcgcaaaacccacgaaaaccgcggaaacgcaagaaaagagaacacttcatgctcaccgagtacacgaccccgggcgcatccgtcgaagtacgcgacgacgaatccatctactccctgcttaccgaacgcatcaagcgcaccggcgaagacaccgtgatcgcggaacgcaaaaccgctccgggccagtggaccaaggtgacgaccggcgaattccacaagaatgtgctctccgcggccaaaggcctgatcgcgttcggcatcggcaagggggatgccgtcaccctcttctccaccacccgttacgagtggggcgtgcttgatttcgcactggccgcaatcggcgcggtcaatgtgccgatctatgacaccgattccgcggcgcaggccgaacgcattctcaacgattccaacgtgaagctcgccatcgccgacgatcgcgaacgcttcgaccgtcttgattccgtgattggccgctgcccgtctctgaagcatattctgatgctcgacgccaatgccatgggcgcgctggagggattgggcgtcaccgtgtccgacgaagagctggacgagcgtatcacgtcggtgcgtgccgacgatctggccaccatcgtgtacacgtccggttccacgggggcaccgaagggtgccgagctgtcgcatcgcaatttcgtgtcgatcacgcgtgccggcagccttgcgctgcacgagatgattcttgaagaccatccgcgtctgctgctgttcctgccgctcgcccactgcttcgcgcgcttcatccagtacgcgtcgatcgcttccgatgacggcgtggtcggctatctgccggacaccaagacgctgctgccggatgtgcgttcgttcgagccgacgtacctgctgggcgtgccgcgcgtgttcgagaaggtgtacaacgcggcttcccgcaaggccggcatgggttggaagggccgcctgttcctcaaggccgccgaatccgcgcgcgactggtcgcgcatgcagcaggctggcgagaaaccgaccatgaagcagaccgccgaacacctgtcgtatgaggcgtccgtataccacaccgtgcgtggcgcgttgggcccgcgtatccgttatgtggcgtgcggtggcgctccgctggacgtgtcgctggcgcatttcttcaatggcatcggcctgccgatgatccagggctacggtatgacggaaaccgcggcgccgtttgccgcgacccgcgtcacggacaatgtgatcggtaccgtcggccagcctgcgccgggatcgtccgtgcgtatttccgacgatggcgagctgcaggtcaagggaccgaacgtgttcatgggttaccacaatctgccggagaaaacggccgaggtgttcaccgaggacggttggctgcgcaccggcgatcttgcgtcgatcgacgatgagggtcgtattacgattacgggccgcaagaaggacatcatcatcaccgccggcggcaagaacgtgtcgccgattccgatggagcaggagattgcgaagtgtccgattgtggagcatgccgtggtggtgggcgataatcgtccgttcatcggcgcgctggtcacgctcgatccggaaggattggcggcctggctgccgtccgtgggcctgtccgcggatacgccgcttgaccgcgtggcggctaccgccgccgttcatgacgagattcagaagtatgtggacaaggcgaacgcgacggtttcgcgcgccgaatccgtgcgtaagttcgtggtgctggatgcgcagttcacgcaggagaacaagtgcctgacgccgtcgctgaaggtggtgcgtccggcagtgaaccgcgtgttcgccgacgtgatcgaccagcagctgtacgccggcaagcgctgagccgcacataggtaaacaaaaacagcacggcggggaacgctgcgtacaaaagtacgtcaacttccccgccgtgctgttttttaagcgcaccccgtatcgctgagataacgcgtgcggtaacagtgcggcaggaaacgccggcgtacgaaggtacgtcaagtttcctgccgtgctgttaacgctccgttatttcagtgacggttgttgaggcggtggtacatttcgctcagctccagctccttctcgaactggcgggcgttggtgttctcgtcgatgacggcgagttcgacgccggcgatgcgggcgaagtcctcccaagcctcacgaccgacggacgtggtcatgcaggtgtggtgggagccaccggcggtgatccagcactgcacggcggtcttcaggtccggcttcggcttccacacggcgcgggcgcacggcaggttcttcagggagccctgcggttcgacgatggtgacctcgtccatgagcaggcggaagcgttcgcgctcgtcggccatggagaccacgacggcgtcggccggcttgccggagaacaccagacggaccgggtcggacttgccgccgatgcccagcgggtagatggccagcttcggcttggcgatggtgccgatggacggggagacttccagcatgtgggagcccatgtcgaactcgttgcccggcacgaagttgtaggagtagtcctccatcagggaggcgccaccctcaaggccgtagcccatcacggcgccgatgcgcaccagcacggaggtcttccaatcgccttcggcggagaagccccagccgtactcggacgggaagcgctgcgggccgacgcccggcagctgcggcagggtgccgaggtcttcgaagttgtcgacgccggcggtgcaaccgttctcacgcatcatgttgaccatggcggcctcttccttggctgcgatgaacagctcatcgtagcgggaatcaagcagctcgggggccacgtcgtacttggccttgtagtcttcgatgaggtccttgacctggctgtccttgaccttctcgtaggcggcgacgaggtcgttgacggcccaggtgttgatcgaagcgccgaacacgcgttcggcttcggtcttgtcgccttcggtgacggccacgttgcgcatgttgtcgccccaacgcatgaccttcatgttctgggaggcatcccagccggcgcaggcgcgagcccaggtgccgaccttttcggcgacttccggatcggtgtagtggccgacgacgatcttgcgcggaatgcccagacgggagacgatgtagccgaactcacggtcgccgtgggcggcctggttcaggttcatgaagtccatgtcgatggtctcccacgggatttccttgtggtgctgggtggccagctgcagcagcggcttggtcagcacttcgaggccgcggatccacatcttggccggggagaaggtgtggcaccaggtgatcacgccgatgacgttcgggttggcggaggcttcggtcatgaaggccttgacgccgtcggaggacttcagggtcggcttgagcacgatcttagccgggatcttgccggtcgcgttgaggaagtcgaccatctcgccggtctgctgggccacctggcgcagcgcctcctcgccgtagaggtcctgcgatccgacgccaaaccagatttccttgccttcaaatgggttttccattgccatgttggattattccttacttcgttgttgggtttgtcgtttcagtttccgtcgcgtcagtgctggccgtagacgttggtgtagcggtcgttaaggctatcgatgtcttcctgggagatcgggatgatgtctccgagctgcttggcggcccacatggtgtgcgccacctcttcggtcatggcggcggccttgacggcggcttccgcgtccttgccgatggtgaacggaccatggttctgcatgagcacggccggggacttcggatacttcttcagggtttcgaccacgccttcgccgatggcttcggagccgatgaggcggaacgggccgaccggcaccgggccgccgaactcgtcgcccatcatggtcaggccgcacggaatgttctggccggtggccgcccatgcggtggcgtaggtggagtgggtatgcaccacgccgtacacgtcgggcatgtggcggtagatgtacgcgtgggacgcggtgtcggagctcggcgcttcggcgccgtcgaccacgttgccgtcgaggtcgcacacgaccatcgagcttggggtgaggtactcgtaacgcagtccggacggcttgatgaccatcaggtcggcggtgtgcaggcgctgcgagacgttgcctgcggtccacaccaccagattccacttgatgagctgctcgtgcagggtggcgaccacttcgcgcacctgcttgacttcagctcgtacttccgggccgtaatcagccaacgttgccatattgtgttcctttcgtcaggcttgctgttgttgcgatggacggttatttggtttccagcgggatgctttcgatggcggcatgctcgatcggcagccccttgcggaagcggtcgaagaaggcttcgaagccggccacgtcgttggcgtccggcgcttccgtggtggaggccgcgtcggcgaagacgcgggtgtcgaggtagtcggcgagcggctggtcggcgtgccacagatagtcggcgagcacggccatgccccacgctccgccttcggcggcggtggccatgaccttgatcggggtgtcgaatgcggcggcgaggatcttctgcgcgaccttcggcgtggtgaagatgccaccgtggccgacgagcgagtcgacggcgacgccttcgtccttggtcatcacatccatgccgatcttgaccggcgagaaggcgctgaacagctgagttctcatgaagttgccgaggctcatgcgcgcctccgggctgcgggcgaacagcggtcggccttccggcaggccagccaggaattcgccggagcggaacggatagttgagcagaccaccgcagtcggcgtcgacatcgtccgcgatcgcggcgcggaacagcgtgccgtacagcgtgccggcatcgaccggctggccgatcgcggcggcgaactgtccgaacaggccgacccaggcgttgagatcggaagtgaagttgttggcgtggctcatgccggccaggtcgccggctggagtggtgacgaggtcgacttccggatgcaggcgcgccagcttgtgctcaagcacgaccatggcgaaaatcgaagtgccggcggagacgttgccggtgcgcacgcgcacggagttggtggcgaccatgccggtgcccgcgtcgccttccggcggggcgaggacgacgcccggctgaagggtgccggtcgggtcgagcagtttggcgccttcggcggtgagcgtgccggccggggtgcccgccacgagcggacggggcagcaggttctcaagcttccacggctgcgcggcgacttcctcgatcgcgtcgaatcgcttgatgaactcggtttcgtaggtatgggtggccgggtcaatggggaacatgccggaggcgtcgcccacgccgagcaccttctcgccggtgagcttccagtgcacgtagccggcgagtgtggtgatgtagtccaccttggagacgtgctcctcgtggttgagcaccgcctggtagaggtgcgccacggaccagcgttccggaatgttgtactggaacagctcggaaagcttctcgtgggcttcgtgggtgttggtgttctgccaggtgcggaacggcacgagcagttcgccggacttgtcgaaggcgaggtagccatgcatcatggcggagaagccgatgtgccccacgtgggtcagccgttcgccataggcggtttcgacatcgccggccatccgggcgtatgcggtctgcaaacccttccagatttcctcctgggtgtagctccacagcccgtcctcgagatggctggcccactcatagtcgcccgccgcgatggtgtggtaggcgtcatcgatgagcaccgccttgatgcgggtggagccgaactcgatgcccaggctcgtcttgcctgcgcggatcttctcggcggtcactgcgacctgctcttgcgtcatagttcacgaactccttgcgtccgagcgcctcgcaaccactctgtcaactgaatgttagcgctcactgttaacgctcactattgtaggcacaaacccgtgacgcaccaaatccgacgtgtcatcggagcaatgaatatacgagcaaatcgaaaagaagcagcgccttagcggcggcggacaggacccagggagctgcggttgaccatctgcgccgacaccagtccgacgccatgctgcgatgatccgaaggagttctcctcccccgcgcccagcaagtacagcgtctcacgcatggcggcgacacccagctgctcgaagccgggacggaccgtggtcagcggcgggaacatattgtccatggcaggcatgtcgtcgaaacccaccaggctcacatcctgcggaacgcgcacgccatgctcatgcagcgcgcgggccacacccacggcctggctgtcgttggcgcagaccatgcatgtcggcagattgccgccggtgcggccgatgttgtcgaggatgtggttcatcttgccgtacgcttcggaggattcccaggtctcgcactgcaccgtcacggaattgaccgcattggccgcgcatagcttgttccatgccagcaggcgcgtcgccgcgtcgcgccactccttgggaccggcgaaatacagcaccgaacggtgcccgtattccacgacgagatgcatcacgtcggccatcgcggaccattggtccatgccgacgacggatacgcggcggcggtcggcggacttcatcagccgcaggccgtcctgcacgccgatgccaccgtgcgtggatgtgacgatcacacgaggctgcgcgatccgcgtccggcatgccgcggagaacatgacatcggtgggcgtgaggaagatgaacgcgtcgacgttcatctcgtcgaaggtgcggcacaggtcgtcgaattcctcctgcgagcacagcgcctcatgcaccatgctcaccgtcacgaacaggccatgctggcgggccatcgtctcaatcgcggaaatcgtggagatcgggccatagaaatgctggccgccggcgatcaggccgatggtgcgggaccggtgcgaggcgagcgcgcgggcggagttgctgggacggtatccgagctggtcgatggccctctgcaccttctcacgggtggcgtcggaaacgtccggcgaatggttgatgacgcgcgagaccgtctggtggctcacaccagccagtttcgccacttcgaacatcgaaggacgcttattgcccgcattgcgtttgcctgccatgccccatcgcctttcgcacacaactgttggtacgttcgcctattgtacacgcaacttcagttagcgctaacagccgtcatgttccaaggatgcggcacactgcacgcaggctaccgcacggccgccaaagcacgcagacgcgccgcgaagttaggccaatcggtgcgcatggcagtcagcagcttgcggttgggcacgtcatcgaccggcacccattcgatctccatgctttcgtcgtcgttggccttgggttcgacgcggtgccccggcttttcgaaggcgaacaccgtggtgtacgaccatgggccgtggtcctcgcagtacgatccgaccacgtcgatgtcctccggcgtgatgttggcttcctcgtacgattcgcgcagtgcgccctcgatcgggctttcgccatcggcggtggcgccgccgggaatgccccacgtgccgccttccgcgctccataccgcgcggtgctgcatgacgacgtgcgtcacctcaccggtcgtctcgctgcggcgggccaagagcacgccggacgcgccgttcgtaccccaatgcttgcgaccgcaggcgcagtcgacccagccgtctcccggctggtgcacgttctccttgggcggcagcggcttcgcggcacccgttttcgcatcatattcggcgtccggcgcgaggtcggagcgcgtgacgttccacagatcggtccattcgacgcccaattgcgccgccagacggcgcgccaacggcaggctcaggccgatgatgccgtgcggatcgccttcgatcgagtcgatgaacgcgccgccgaaaccttccaaagtgaacgatccggccacttccagcggctcgccggtggcgatgtagcgttcgatatccaggtcggaatattcgcagaagtgcagggtcgctttgctggcgccgcgcaccatgcggcccgacgcgaagtcgatgaggcaatggccggtccacagctcgccggtggcaccgcgcatggcacgcagccgttcgcgcgctacctcttcgctatgcggcttgccgtagcattcgccgtccagcaggaacatggaatcgcagccgagaatcagcgggccggccttcgaacgggtcaggcttggacggccatccacgaaatcggcgatcggctcggcgacggtgggaatggcgatgccggagaaatcgcgggtcttcgtctcgtcggcggactgcgcgctgtccgtgcgtgcggctgtgcccgccgaggatgcgtcgcgatcgtctgctgcccggagcgggaagccgaccacgcgctccccgcgcgcgtgcgccgcggtatcggcgatgttgcgatacgcctggtgcacggcctcggccttcgccgtggcgagaatcatcacacgctgttcgacgctcaggtcgttcacggtgacgccaagcgcggccgcctcgcgttcaagcgcggcaggctcgtcgacgtgcgagacacggatggtcgggcagatgccggcggagaacagcacgtcacggcgtggacgggactgggaggcgagaatcagcgggatgctcatgcgcgttccacctgcacacccttggtgtcgaccgcgagatgcagcacacgccaatggccggatgccagctcttcggcggcgatccgttcgagttcctcgtgggcgtcgccatggtgcagcaccagcacgcatgggccagcgccggacacggtggaggcgaagccgtgggagcgcatcttctcgatcagcgcccaagacggctccatcagcgaggcgcggtacggctgatgcaggcggtcctgcgtggccgcgaacagcagtgcgttggcgttctgacgcgagccggaggccagcatcgcggggttcatggcggccggcagcaggctcacacgggagacgttgtgcacggcgtccttgaacggaatctcagtcggcaacgcctgacgggccttttcggtggacagctcgtagtccggcacgaacacggccgcggtcagatcgtccgccacgcggtaattgatggtgtggaagccgttgtgcatcggctcgccgcctggaatcggcacggatccgacaccttccgcggtctccatgtcccaggacatggtcaggccgccgtacacggccggggccacgttgtccggatggccttcgatggcagcggccagctcgaacacggcgtcgcggttgaggtcgtcgtcctgcgcgaaggctgccgcggcggcgatgccggcgacgatggcctcggcggaggagcccatgcctcgcgcctgcgggatgttgttgtgcgcctgcaggatgaatccgacgcgtcccaggccgaaggtctggcatgcgcggcggaacgtggagaccaccaggtgcgtctcgtcacgtggcagggtgtcctcgccctcgccttcgatcatcacctgcgccgcggtgttcaccgggtcggcgctcagcgtgaattcaagctcgtcatggtaatccaaagccaaaccgaccgtatcgaaaccggagccaagattggcgctggtggccggaaccttcacacgcaccttgcgggtaactggagtcatctctcgtcgtccttcgtcacatcttcattacaaatcaagcaccgtataccgtggcagtgccagagtcaaatttcagggggaaccgcacccgtgcatcgtattcgggcccatgacggcggcttggcatggcttgcatgccaatcgcatcatgggcccgaatcgcatccgatatcagttcagcacgcgcaggatcgacggctctccgcacacgcaatccagctcgcacacgtccttgacggtttcgcgcagggtgagctcgtcggtcatgtgggtgaccagacgcagctgctgcagctcgccgtcatagcccggatccttcagcgtcggcttcagatcctggttcacgccgttgatggacacgccatggtcggcgaacttggctgcgatcgcggcgagcacgcccggattgtcgtgaatcacgaaacggaccgcgaactcggccttggacgcctcgatcggagccttcttcagatccttgtacagcgggatggacggaccggtgcagccctgtgcgatatggcgggcttcggtgaccacgtcgccgacgaccgcggaggcggtcggagcgccgccggcgccgcggccgtagaacatgaggtcgtccgcggcttcggccttgacgaacacggcgttgaaggagccgtgcacggaggccagcggatgggtgttggagatcagtgccgggtagacgcgcgcggacacgccggcatcggtgttctccacgacggcgagcagcttgatcaccttgttttccgcggtggcggcggcgatgtcgtcggcggtgatcttggtgatgccctcgacggagacgtcgtcgatggtgacggaggtgtggaagccgagggtggccatgatcgcggccttgttggccgcgtcgtagccctcgatgtcgccggtcggatcggcttcggcgtagcccttagcctgcgcgtccttgagcacgtcatcgaagtcgaggcccttggtggtcatctcgtcgaggatgtagttggtggtgccgttgacgatgccgagcatgctcgtcaccttgtctccgacgagggattcgcgcagcggcttgaggaacgggatggcgccgcccacggaggcttcgaagtagatgtcgacgcccttggcttcggcggccgcgtagatctccggaccatacttggccagcagcgccttgttggcggtgaccacggaggcgccggattcgatggcggcgagcacgaacttgcgtgccacgccggtgccgccgatcagctcgatgacgatgtcggaattggtggccacgctcatggtatcggtggtcacgatggccttgtcgatccacgggaacggatcggtttccaccgggtcgaggcaggcgacgccggtcagctcgatcggtcgtccgatacgtgcggcaagctcgtccttctgctcgaccagcaggcgtgcggtctgggaaccaacggtacctgcgcccagcaatccaacgcgaatcggcgcaacatcttcctgtgccaaggcatcctcccttgaatgtgaagtattggtgtgaccttgcttattgtacggtctcaatatgacgtaaggccgcggaatatcaagaaaatggacggtttccgaagctttccccgcaaggaagcccgaaaaccgtccataccgtgagacgcaatcgtggactattcgctgacgtcccagctcagcagatcgtcgatcgtctgccggcggatcatgacgtgtgcgccggcctcgccgacgccgaccacggcgggaatcagcgcctggttgtagttgctggccatcgtgcggccgtatgcgccggtgaccggcaccgcgaggatgtcgccacgcttgatgtcggcgggcagccgcacctcgttgacgacgatatctcccgattcgcagtgcatgccgaccacgcggcacagcttggtctgcttgtttcccttgcggttggccagacgcgcggtgtagtcggagccgtacagcgccggacgaatgttgtcgctcatgccgccatccacggacacgtacacacgttccgtcaccggattgcctgacttgtccttcgcctcgccggaaagctcgaccggcttgacggtgcccacgcggtacagcgtgacgccggtgggggccaccgtccagcggcccggctcgaaggagatgaccggggccggcatgccgagcgcgcggttcacggtgctgaccgcgtcggcgagcctgccgagctccacgtcgatgtccatggaatcctcgccgtcggtgtaggccacggaataaccgccgcccagatcgacctccggcagggtgtacgcgtcggtggcgtagaaggtcttgcgcagcagcatcatgcgcttggccgcctggatgaaagcgtccgcgtcatggatgttggagccgatatgcgagtgcacgccgaccagttcgagcacgtcctggcggcggtagatgtccttgagcacggcgagcgccggaccgtcggccaccatggtcatggcttcggcgagcctgcggtcgccttcggagaccttctcgtggctcaggtcgtacgggtatttgacgtcgtactggagcttgcgttccgcgtgggcggagtggtcggagccgtcggcggaagacgcgttctcccccaatcgtgcgttcgaccctgccggcgtcacgtcggtcaggtcgtcgagcacagcaagcttgcccgcgtcggctccggcgggcagcagggccacgccgaacttctggtcctcgtgggcggtggacacgaattcgtggccgccggcgtgaatgccggaggtgacgcgcagcatgacgcgggcgcgcttgccgagccgcttggcgatcgcggcgatgcgtgccggctcatccggctcgtcgatcacgattttgttgaagccctgttcgatggccagctcgatttccgcatcggacttgttgttgccgtgcagcacgaggcggcggcctgggacgcccgcggcgagcgcgatgcgcatctcacccatggtgcaggtgtcgatgagcatgccggattcggtgacgatgcggcagatctccttgctcagcagcgctttgccggcgaagctgacgtgggtgacggtgttgttgaacgcgttggcggccgaatgcacgaatttcgtagcgcggtcacgcacctcatcggtgtcgatgacgtaaagcggcgaaccgaattcgtcgagcaggcttgcggcggtgcggccgtggaaggtgatctcgccttcggcgttcacggccgatccggccggccagattgggcttacaggcatggtttgcgtatctccctttttcgtggattcgcttcacatcttgtccggagcggtgacgccgagcaggtcgaggccttcggcgatgaccgtcttgacggcgtcgttgagcttgagtcgggcggcggcgtgggccggttccggagccttggcgatgcggatggcgtcggcctgttccccgcgggcctccggatcggtgagttccatcggcacgacgcgctccacgttgtaccacttgtggtaggtggcggcgaggtcctccaggtagtgggccacgcggtgcggggcgcgcaggtcgcccgcttcgcgcagcagggcgggccactgggcgagcgcggcgagcacttcgccgtcggcggtggtgtcgagcaggctcacgtcggcgccttcgtaggtgatgccggcggcggccgcgttgcggtccacgttgcaggagcgggcgtgcgcgtactgcacgtagtacaccggattctcgttggaatgcgaggacagcaggttcaggtcgatgtccaccggggagttgtagtcggtgcgggccagcgaatagcgggaggcgtccacgccgatggcgtcggtcaggtcgtcgatggtgacgacgttgccggcgcgcttcgacatgcgcacggccttgccgtccttcatgacgttgacgagctggccgatgaggatctgcatgttctcgcccggcttgtcgccgaaggcctcgcacatggccatcatgcggccgatgtagccgtggtggtcggcgccgagcatgtaaatcgccacgtcggccgggttggtctcgcggtggcgcttgttgcggtagtaggcgatgtcggcggcgaagtacgcgtagttgccgtcggacttgatgatcacgcggtccttgtcgtcaccgtgcttggtggattcgaaccaggtggcgccgtccttttcgaagatgtcgccgcgggcgcgcagatcggcgatggcctggtccacttcgccgtcggaatacaggctgttctcgtggaaccacacgtcgaaattgacgcggaagttcttcatggaacgctggatttcgtcgaacatcatcggcacggcgcgcttgcggaactcctcgcgctgttcggaatcgccttcgccgagcgggttgccgtcctggtcggcgccaccgtcgacgcgcggcaggctcagcacgtccacgccgtccgcgttggcttcgtcgatgacacgcttggcgatttcgtcgatgtacgcgcccttgtagccgtcgatcggggtttcctcgccgtgggccgcggcgacgagcgacttggcgaagcggttgatctgctcgccgtggtcgttgaagtagtattcgcgcaccaccttggcgccgttggcctcaagcacgcgggccatggagtcgccgacggccgcccaacgggtgccgccgatgtggatcgggccggtcgggttggcggatacgaattcgaggttcagggtcttgccggacaggtggtcgttcttgccgtagtcgctgccggcttcgagcacggtgtccaccactgcggccgcggatgcggagtcgagcgtgatgttgatgaagccggggccggccacttccacggacttgatgccgtcggcattggtcagttcggcggcgaacagttcggcgagatcgcgcggcttcatgccggccttcttggccagctgcatggccgcgttggacgcccaatcgccgtgcgcgcggtccttcgggcgcatcacggcgaacttggcctgcggcggaatcagatcggcggtcagggtgcctgccttgccttcggagacaagggtgttggcaatgttgaaaatcagttcactaagggcttctggactcattcttccaagaataccgggcacgctgacagaatcagtcttcctgtccatcctcacgatggggttgcgatacgtcctgcggaacgctttgcaaggcgttctgagcatcgtcctacccgccatgccgtttcgcacgccacgccacggacgcgtagtagcccgtgtagcacagcgccacgaacggaatcatgtacagcagcgtggagcgctgcgacggatcgcaaatcaccagaaccagtgcgccgacgcacatcacgatcgcggcgatcggcacgaacgggtagccaggcgcgcggtacttgagctcgccaaccgtatgtccctgcgcgagccattggtggcggaatcgcaagtggcagacggaaaccgacgcccacaccaccagcgtggccaggccggagacggccaccagcgccaggtacacggtcgaggcggccaccacggaggacagcagcgccagcagggagccggccatgctgaacatcaccgcgaaaacgggcacgccgtggaagttcgttttggcgagcttgcgcggaatcataccctcctgcgcgagcgaccacaccatgcgcgagcacacgtagaggccggaattcgcggcggacagcaccgccgtcagcaccacgaaattcatgatgtcgccggcgaacggcatgccgatcgactggaacacgagcacgaacgggctggtgtcgacgcccgacttgcgccacggaatcagcgccgccatgacggcgatcgagccgatgaagaagatcgccagacgcagcacggtggtgtgcacggccttcggaatcgccttggacgggtccttcgtctcgcccgccgcgacgccgaccacttcggtgccggagaaggcgaacacgaccgtcagcagcgtggagaaaatcggcagcacgccgttgggcagccagccgtcgctgtagaagttctcgaacatgggcgcgtggtcatagccggcgatcggaatcgcgccgaacatggccagcaggccaatgatgatgaacgcgatgatggcgaacaccttgatggacgcgaaccagaattccgattcgccgtacaggcgcaccgacaggatgttgagcaggaacacgaccacgatgaacgcggccgaccagacccatgcgggcgaatgcgggaaccatcgctgcatcagcaggccggcagccgtgaattcggaggcgagcgccaccgcccaattcagccagtagagcacggcgatggtgaacgcggtgccggggccgatgaaacgcttcgcatacaggtggaagctgccggcgtacggcatggccacagacagctcgccgaggctcagcatgatgaagtagacgagcagcgaaccgatggcgtacgcgatgatcgcgccgagcgggcccgcctgatggatggtgtagccggagcttaaaaacaggcctgtgccgatcacgccgccgagcgagatcatggtcaggtggcgcgtttccatcttgcgttccaggccgccctgttcgacgttctgctgggcttgcgccgtgggatccgcggcggttccggtcgctggctgcggctgccgttccttcgtccgcgtcggttcgccggcgatctgcgcctgtgcctgctgctctgcttgcgattgcgccatgcttgcctccggcttcctgcgcgtttggttgggtgcggcgtgtgttttggctggccgcacaatcgcaatactatacggcaggctcacggcaatgcgcgagcatcgtcggatcgaccgcgagcggaggaacgcccggaacagcggcggcccgcagccgggaaggcatgcgggccgtcgatcgcgctactcgcggtatgcgcgaaatgctcagagcgcggcgatggcgtcgatctcgacgagcgcgcccttcggaatgtcgttgccgccaaaggccacgcgggccggcttgacggagccgatgaagaccttggcgtatacgtcgtcgacctcatggaagtcctcgacgttcttcatgtagatggtggcgcggcacacgttttcgatgccgctgcccgcggtgtcgaggatgtgcttgatgttcttcagcgcctgcgcggcctgctcgcccgcactctcgccggccagttcgccggtggccgggtcgatgcccagctggccggagacgaacacgaatccgttggccttcacggcctggctgtaggcgccgagtgctgccggggcttcggaggtggccactgcttccagcttttcgctcatactgttctcctttgtcgtaaggtatgttgccgcaaggtatgtaaacgcgcgccaagtatgtgccaatatgcccgtacatgcgctatttgcgtcgcacctgaaatcatacttttccgatgggtggaagcgggaaaaaccgttcacagaacgatatggccggagttggcaccacacggcgcagcaggcacgaaaacggcggaatcgcaaggaaaaccgcggaaaaatacaacaaacgagcaacaaaaaggctccagccgttcgactggagccttgcccggtgggcttgatggggatcgaacccacgaccttctgttccggagacagacgctctatccgctgagctacaaacccatgcaacgcactactgtacacggtctgcgcccgtttgcgacacgattcggcgaaaaacgtgacgcagaccttgcaatcgttgggaaagtcagtacgcgcgctcaatgcatcagagtgctcggcgcaaccagcacgcgctgcacgctcagtacatgagggtggcgaggcgacgacgtgcgcgcttcagacgctcgtcggtcggctcggggatcgtgaagtattcgagcagacgctggcgcaccggctcgatgtcggccttgtggcccgccgccacgaaatcaagcagacggtcgaacgcgtcctggatctgcccgccgatcatgtcgatgtcggcgacggcaagctgcgcgtccacatcgtccggcttgtcggcggcagcggcacgcaccacgcgcacgtccgcattggcggaacgggccagcagcagcgccttcgcacgttcgcgggcggcgcgcgtatcgttcggatcggcttccaaaaccttctcgtacgcggcggcggcaccggcgtaatcgccctgctgtgccagcatgtacgcttcctgatgttccggcggcacctgatcctgcacactgccggcggatgcggaattggccgcgtcggaatccggatcgcccgaatacggagcggtgccggtcacgccggcctgctgtgcggcggcgataagcttcggcacgaccacgtctgtgatctgctgcagttcctcgtcggacggaaggccctgcagaatcggcatcggacggccgccgatcaacgcgaacagcgccggcgcgccctgaatctggaacgcctgtgcgatggagggattggatgcgatgtcgatgcgggacagctggatctggccgttgagcttgttcaccgcgtcacccaatgcgcgtgccatggcgaacagacggtcgtcggtcggcacccacaggaacagcagaatcgggaacgtggcggaggtctgcaccatggcctggaacgtgttctccgtggtgtcgatgacatatccgccagccgccggagcgccgcccgcctgccccggctcggccttcacctgatgcttgagcgcttccagatcaacggctcccgccaatgaaacacccggatggaacgcttgctgctctgccatacttgcctccaaaaacacgaaatcgttgctggcaccaactataggtgccaacaacgatttctcggttttcattcccacggatgcgcgataggcggaaaaccgccgacgatgcgcgtccaaggacccgtcgttttacagcgcttcgaccttcaccggttggcgttcggaaccgaccgcggtgattttctgcccggaattcgccggcggaacatacagcgcgatgacgttcacatagctcgtcttcatggtgctggtggccttgccattgccgaacagcgccttttccgcgtcagaggccggctgcgattcacggccagcgccggcggaacgcgtccattcggagttgatctgcgccaccaccagatcgccgccgtccgcggaacgcatgacgctgatggctccattgaccggttcgaaggtctgctgctgcgtgccttcgttaagctccatggccttctgcacctgggcagtcagatcggcaagcttcgatcgcagatcatcatccgcaaatttgctggcgtacttgctgttcgccccgttctgcagcaggtccgcatacgcgtccaccgccgctttcggcgtcatgaccagaccggtgtccgtaggcgttccctgcgcgctgccggttttggagatttcgaaactcggcatcttcacgccggagaacagtcgcgccacaccccacagcttgtagttctggcgtgcggaatcctgcctgaacaccagcagacgcttggactgctggtccttggttgtggacgtgatggagaacacggaccgtggccagccggcatcagtggagatcacggcctgggccagatccgtggggatggtggtcttacggtcaagattgcccgtggctttcgctacgttcagctcgctggtgcggatgtccagttccggaccttcgagaatcgtcggcaacgtatcagtgtcacggttctgattgcactggtcgagcgttttgagaatcctcgtgcggaccttttgctcctgcttggcgctcaagttcggcgcatcctgccgggtggtggctttcggggtcggcagctggccttcgcaaccgcacatgccgacggccattcccagcgcgagcatggccgcgataatcgcctgactacgcttcctcatcactggtcctcctcttggccgtcttcctgcgtttccgtctgaacctcctcttgggcaagacgagcgaaatacgcggcaagctcatcctgcgagatcacggaagtcgcctcgtcgtcaacagacgattcgcccgccgtcgattcaaatacggtcgattcggacacagtcggctggctttccgcaatcgtgttctgctggtcggcgaccaggttacgtgccacaggatcgacgatgacgggctgttgcgtttcctcgaacgacgacgtacgaccgccggtgcgatgttccgcatggcgacgcctgccgtgacgcgacctgctccgtgccctgttgctggcggcggtttcggcgttcttcacccaagccgaaacctcgttctcatcgccttcgttgacgccaacgccttcgaccatggcgaaagcgcgcttgttgcggcgcttatgcggcggcatggcgaatacggaagcggaaagcacggcgagaatcgccagcagtccgccggcaagatacaacggcatggcgaaattcggcaggttacgacggtcccaattcagagtgaccgtgtctcccttgcggttgccgaaatcaatcaacgccacaacatcctcggcgttattgctgttcgatcctttgacctgcatatcaacggcaccgtcattgcacttgatggtgcgccacatgtcggagtccttgaaagccacctggttctgggaattgtccgcggttccctgcgcggagaccttcatggtggaaagcgtcgtccaatcggacagaccggagacgcgcatgtacttgcttcccgcaatccatccggcaacatcgcgcgcggaacctatggcgatgcacacattggatttcttgtcacgggatttggccgaaatattgacgcggctgtctaccagctgcagcacgttcggatcggtgaccacgtattccgaaccgttcaccggagcggcggcggtgatctcattgtccggtttccagacggttgaattcaacacgccaaacacgacgcatgcgatggcaagcaagccgaaaataggcgtgacgatgccacgcatgatcttcgcatgccgggtagggcccgtctcgatctgcggcttctcttgttcttcctgcaatacagtcatagcttttccattctacagtgtccgtttgcacaagcctgaaaaaaacatgaaaatcatgctttgccgctatggttggccctatgcgtaaatcacttctttccaaggccgtcacggcagtctgcgcaacggtcatgtgcctgggcgtcactgcgtgcggcggtaattccagcgcgaaatccgacaagtcgaactcggattcctcctcatcttccgaaaaaatcggcatgcaccagatcgccggcgtgaccgccaagggcgagctcggcaagaagccgaccgtctcgttcaagacgccgatgacggtcgaggacaacagctacgtggtgctgcagaagggcgacggagcccagatcgaggacggcgaccgcgtctgctcgcagggcatcgccatcagcgtcaaggatggttccgaactggccagcacgtgggagaagaacacccccgactgctccaccgtagtcacctcggataccagccagatgaccgagaactactacaagatcttcaagagcctcaagctcaattccaccgtggcgttcggcgtgaacgactcgaattcctccggcacctcgtacctgatggtactcacgctggtgtccaaggacctgaagaaggccaccggcgagaaggtcgccgacattccggccgacctgccgaaggtgacgctcgccaaggacggcaagccgtcgatcgacatgaatggctataagggctccgattccttgatttcccaagacctcatcaagggcaagggcgctgtggtcaaggatacgcagtccgtggtggcgcactacaccggctggctgcttgacggcacgcagttcgattcctcgtgggaccgcggacagtcctccgccttctcgcttgacagcgtgatcaagggctggaagcagggtctggcaggccacacggtcggttcccaggtgctgctggtggtgccgccgagcctcggctacggaaacaaggatcaggagaagattccggcgaattccacgctggtcttcgtggtcgacattctcgccgcctactgatccagccggtctaaccgcaaaaagcctcccacccgggaggctttttcattagaagagtcgtagagagtcgtcttcggtgcccttcatctcctcataatcgagaatcaggcatttgaaaccgcggtcctgcgcgagcacgcgggcctgcggggtgatggtctgcgcggcgaagatgccgtgcacggggaccagcagcgggtcgcggttgagcagatcgcagtagcgggtgagctgttcgacgccgtcgatgccgccgttgcgcttgatttcgatggccacgtgctcgccgttgccgtcaatcgccatgatgtcgaccggtccgatggctgtcgggtattcgcggcgcacgagcttcgcgcctttgccgatgcgttcgatctgttcggccaggtacttctgcagatggtcttcgacgccgtccttgatgaggcccggatcctcgccgaggtcgtacgattcgtccgaatagatgtgctgcaacgtcacttccagcacgtcgttcgatttgtcggccgacgcgcggatcaccttttgcggcacttcagtatcaacgtcgtcatcggcgtggtcgggggtgatgtccctgatgctgcatggcgcggacatccagttgagcggcttgtatgagccgagttcggagaagatcagcaggctgttgtccgccttgatgagcagcacgcgcttggcgagcggcagggaggcgttcaatcgtccggaatattcggcagagcagtcagcaacaataattcgcacgaggcactaccctaccatgcgcgtcgccgtacgtacggcatacgtattcgcggcggcggaaagccacgtaaaagacaaaagcggcccggtaatcgcaatacaaaaacatattgcgattaccgggccaccttacgtcaagcggaaacggcttattcggcgcgcttcacgttggttccacgctcgaccgcgacggtgagcttgttcgaatcgaaggagatgaagccgtcagtcacctcgaaggagaggcgattgccttcaggatccaccacaacgatggttccttccttgatcacggtcagcacaggctcgtggtcgggcaggatgcccattccgccttcggaggcgggaatggtaacagacttcgccgtgccgtgccacacagggtggtcagcggcgacgatgttcacctgcaatgtcgatccggccatcacgcaccgtattccttctgcatgtcgtgccacttcttctcgagatcgtcgatgccgccgataccggagaatgcctgctccggaacgtcgtcatacacgccgtcgcagatgcgggtgaaggcttcgatggtctcatcggccggaacataggagcccggacggccggtgaacttctcggcgacgtagaagttctggccaaggaactgctcgatcttacgggcgcggttcacagtggtcttatcttcttcgccgagctcgtcgatgccaatcagggcgatgatgtcctgcagctccttgttacgctgcagaatcgccttgacgcggttggcgcactcgtagtgagcctggcccacataacgcggatcaaggattcgcgaagtggagctcagcgggtcgactgccgggtagatgcccttggaggcgatgtcacgggacagctcggtggttgcgtccaggtgggcgaaggtcgtcgcaggggccgggtcggtgtaatcatcggccggcacgtagatggcctgcagcgaggtgatggagtggccacgggtcgacgtgatgcgctcctgcagcgcgcccatctcatcggccaggttcggctggtagcccactgcggacggcatacggccgagcagggtggatacctcggaaccagcctgggtgaagcggaagatgttgtcgatgaacagcagcacgtcctggttctgtacgtcacggaagtactctgccatggtcagtgcggtcagcggcacgcgcagacgggtacccggctgctcatccatctggccgaagaccagtgcggtcttctcaagtacgccagcttcgtccatttcgccgatcagatcgttaccctcacgggtacgttcgccgacgcctgcgaacacggacacaccgccgtggttctgagccacacgctgaatcatttcctgaatcagcacggtcttgccgacgcctgcgccaccgaacagaccaatcttgccaccctgcacatacggggtcagcaaatcgatgaccttgataccggtttcgaacatctgggtcttggactccagctggtcgaatgccggcgggttgcggtggataggccaacgttcggtaaccttaacggtctcgtcggccttcttgttgaggatgttgccggacacgtcgaatacgtggcccttggtgacatcgccaaccggcacggagatcgggccgccggtgtcgtacacggtggcgccacgcacgaggccgtcagtcggcttcagagcgacggtacgcacggtggaatcgccaagatgctgttcaacctcaagggtgatcttcttggtggtctcgccctcttcgtggacaccggtgttggccagttcaacggtaagtgcattgtaaatgtcgggcaggtggcccaccgggaattcgacgtcgataaccgaaccctggatacgcgtaacgcgtccagcggtcggctctgcagccgtctcgggagccgctgtggtctgattctcagccatatgcgttcctactcttccttcttgttcagcgcatcagcgctgccgatgatttcggtaagttcctgggtaatcgatgcctgacgcgaagcgttgagcttgcgagtcagttcatcgatcaggctgcgagcgttgtctgtagccgtgtgcatggcgttctgtcggcttgcagtctcggatgccgctgcggtgagcaggcattcatggatacgggactggatgtacttcggcagaatcgcgtcgagtacttcgtcaacgcttggctcgaacgcatacagaggagtcgcagcatcggcatcggattccggcacaggaccggattccggctgttccggaagcacgagctcaacgggtagcatgcgcagcacacgcaccttctgaaccaccatattcacgaattcggtgaacacaatgtagagttcggagactccaccttggtccgccggcttcatataagcgtccaacagtgccttcgagatggactctgcgacttccacgccgggctggtcggtatcgccttcccaagtgccggcaaccggacggttgcggtacttgtaatacgtcacaccgcgacgaccatacacatacagttccggctgcttgcccttctcgtcgagtcgggccaacagcgattccgtttcgcggatgatcgaggaggtgtacggacctgccataccacgatccgaggtgagagcgaggacagccacgcgagggttgtcctcgttctttttcacgatcggatggtcgatatgggtatgggccaccagcgcttgcacggcgtcgaaaatcgcatcggtatacggcttcgcgttcaaggccacgtcacgtgccttggcgatatgcgaagacgcgatcatctcctgcgcgttgaagattttctccagcgacgcggtggaggcgatcctagatttcaatgcgagttgcgagcccatgaatcacttctctcctgcgacgatcttttcctgctcgaccggagtggtgtgcttctcgtcaggcttcttctcgaccagcggcttgcccgcgctggtcacgaaggtctcacggaacgcttccacggccttgtcgagggcagcctcggtgtcggcggtgaagtcttcggtctcgcgaatggtcttgaggatatcggtgttgtgatccagataatccagcatgcccttttcgaacggcaacacgtcgctgattggcaggtcatccatcttgccatgggtgccggcccacacggacacgacttcctgttccatcgaatacggggagaactgcggctgcttcaggagctcggtcaggtgggcaccacggttcagctgagccttcgaagccgcatccagatcggaagcgaacatggcgaaggattccagcgaacggtactgcgccagcgagatcttcagcgtgccggagaccttcttcaaggccttcgtctgggcagcgccaccgactcgggacacggagatgccgacgtccacagcaggacgctggttcgcgttgaacaggtcggactgcaggaagatctggccatcggtgatggaaatcacgttggtcggaatgtaggcggacacatcgttcgccttggtctcgacgatcggcaggccggtcatcgagccgccgccgaggtcatcggaaaccttggcgcaacgttcgagcagacgggagtgcaggtagaacacatcgcccgggtaagcctcacgccccggcggacgacgcagcagcagggaaatcgagcggtaagcctcggcctgcttcgacagatcgtcgaagacgatgagcacgtgcttgccgttgtacatccagtgctgtccgatggcggaaccggtgtacggtgcgatgtacttgaagcctgcggaatcggaagccggggaggccacgatggtcgtgtactccatggcgccggcctcttccagggactgcttcaccgatgcgatggtggagcccttctggccgacggccacgtagatgcagcggacctgcttcttcgggtctccggattcccagttgcgcttctggttgatgatcgtatcgattgcgatagcggtcttaccggtctgacggtcgccgatgatgagctgacgctggccacggccgatcggcgtcatcgcgtcgatggccttcaggccggtggacagaggctcgtcaaccggatgacgatgcataacgtcaggtgcctgggcctcgagaatacgacggccttcggtcttgatctcgccaagaccgtcaatcgggttgcctagcgggtccacgacgcggccaaggtagccgtcgccgacgggcacggagagcacttcgccggtacgacgcacttcctggccttcctcgataccggtgaaatcgccgaggataaccacgccgatctcgcgggcgtcaaggttgaacgccaggccaagcgtgccgtcttcgaaggtcagcagctcattggccatgcaaccaggcagtcccgtcacgtgcgcaatgccgtcgccagcggtcgcgacataaccgacttcctgggtcggcgtgtccgacggcttgtacgactcgacgaactcatcgagcgccttgcgtatcgtggtgggatcaatggtaagttctgccatgatcactccttattgttgtttttaaattcagtcaagtcttgtttcaggcttgttcaccgtgtggcgtgccgtcaggcggtcgccttcaccgtgcgctgaagatgttgcagctgtgcgaccaccgtgttgtcggtgacctcgtcgcccacctggatgcgcataccacccaggacggtcggatcgaccaccgagttgatgtgcaccggatggccggtcttcgccgaatagatggcgacgagcttcttgacttgctccttgctcagtggcgttgccgtggtgacggtgaccatcgattcgcccatatgacgggagaacttgttgatcagccactgaatggtctgcagataacggcggttgcgcagattgcaggtcgcatgctcggccagacgcttggtcaccacattgaagtcggcattgccgatcaggctgtacagcagcttgatacgggcttcggcggggacggttgcgtcatacagcttgctgcgtacgaccggaaggttgagcagtgcggaatgcagctgggcaagctcgatggagacctgcagagtagcattcgtgtggtccgcgtagtacatcatgccatccacaccgaaatcctcggtggcgttggcgatgtcggacacgcggctccaacggcgggccaccagatcggacatgatttccatcgtcaacggatgggcctcatctccaatgagggtcttgactaccgcaaccttgtcttcgactgggcgcgacgggtcggtgagggcacgttcaagctggatgttgtggtcgagcgcgttggtgatcgtgaacagttcgttcccgatgcgccatgcgtcctcgccgctgtcacgcagcctgggggccagcgagtcacgcgaaacgcggtctgcgatacgcgatgcttctcctcgcattggtcacctccctttcttgaaggtttcgatcacttcttgtcgctgtccagatcggcgatcatctggtcgatcatcgtcgactgcacgtcgtcgctctccagcttgctgcccaggatcttgccggccagtgccgttgccagcacgccgacctcacccttcaggctcaccagagcctgctgctgctgggattcgatggaacgctgggcggtggcggtgatctgcgccgcatcagcctcggcacgggtacgtgcgtcggcgatgatgtgcgatgcctccgcgcgagcgtcgtcgcggatcttggaagcctcgacgcgtgcgttgctcagctgggcatcgtacttcgccttggcttcgtcggcatccttctgggcctgttcggccttggcgatgccgccttcgatcttggctgcgcgctcatcgaacacggcctggaacttcggcaggaagaacttgtagaagaacacggcgacgatgatcagaatgaccaacgaccagaaaatgtcgtagcttttcggaaggaacagttccatctcgctagctgcggtcaccatagtgtcttcctcctttcacgttcgtttgcgtcttcggtgtttaccttggggatcaagtcttacttgatgaaggcgagcacgaagccgagcagtgccagcacctcgacgaatgccaggcccaggaacatgagggtctgcagacggctgccgagctcaggctggcgagcggtgccttcgatggtcttgccgatcaggatgcccagaccgatgccagggccgatggcggcgaggccgtagccaacgacgttcaggttgccggcaacctcagcgagggtaacgatatccatgattgtttcctttctggttattgcttgacaagaagcaacacttaaaaagccggcggtcagtcgatctccggatagctcatattgatgtatgcggtggtcaggatggcgaagatgtaagcctgcaggcaggcgaccagcgcctcgaacaggaacatgaacatgccagccgcgaaggtgatgatgccgaacggcatcatcagcttgttcaccacatcaacgaggaagaactgcgtggccgagaggcacaacgcaaggatcaggtggcccgaaaccatgttggcgaacagtcggatcgtcaacgagaacgggcggataatcagcagctcaagcagctgaatcggggacagcagaatatagatcggggccggaacgcccttcgggaagatctcgtccctcaggaagtggccaaggcccttttcacggatgccggcaatccagtactggcagaagcaccacatggcgaacaccagaggcagcgtgatggacgcgcttgccgcgatgttgaagcccgggatgatgccgcacagattgaagaccagcaacgtgcagaacacggtggtgatcatcggcacataacgcttgccacgcagctcgcccatcacctgatagacgatgttgtcgcggacaaactcgatcagccattcgactgcgccctgccaacggccagggatgagctttgcacggcttgccgtaattccgagaaccagcagcatgatgacggtcgcaagaatacgaacgaggatgatgcggttgatggcgaacggcgtgccttgaaaaacaaacggatcgggaaggaagtcattgatgctcggcatctctggaccatcggcgatggtcatgatgccctctcccaatgcactaatcattcacgcctcctgctcttgtgtcagctgttagtctagcccaacagctgagtcgaatgtgacattccggttaccaaaccagaacatccttcgggttctatgttaacgcgcccataaacgcgttcgcataccagccccgaatggctgcaaaggattatcagcccgtggctagacaacatgccgcaccgggagctttcccctactaccgtatagcgaaaaccggcgtttcgcacgttgcggggactattagacacaaccacggccgttgtcgattcggcctatttcacccccattcacaccaaaatagacatcgtttacaacactgcttgataaaacgttttacttaacatatcgcaccataatatatgacagcgaaaatgaaacgatgtcgcagcaggcaacaaaaaccgcgcaaaaagcccacgacaccgcgcaaaagcggcaatcgtgggacaatcgccaatacttgtcagtactcgccgatcttcgtgaaatcagccgcgaatgacaccgtatccatcgtgcgagaatggcgtgaacgcgtcgacacgcggagaaccgggctcgtgccggatcgaacggtcggtgccgaggcgcttctcctcgcgcagctgcggtacttcgctcaaatcgtatggcgtggtctgatagacccagttgagccagttgcgccacagcaggttggcgtgggcgcgccaggcgaacagcggttcgagcttcggatcgtcgtgcgggaaatagttttcggggaacggcacgttggtcatgcccttcttcatatccctctcgtattcctcggcgagcgtgtacttgccatactcccaatggccgagcgcgaacacttcggagaagtcgcgcgtggcgatgagccccgggccggacttcggaccccacgtgagcacctgcagctcgggattatgggcgatatcaccctcgttgacccccgccaggcgggaatgcggttgcaggcagatctcgtcgaaaccgttggtgaggaagcagtattcgtcctgcagatactgggggaacactccaaagagcttctccggcagcaactccttgcgcacgccgtaccgatagttgagcgcgcccatcgcgccccagcacaggtacatggtggagaagacgtgggtggatgcccagtcgagaatctgcttgaactcgtcccagtagtcgacctgctcgaaatcgaggtgctcgacgggcgctcccgtcaccacaagaccgtcgtaatagttgtctttgaacgcatcgagcgtctcgtagaacttcaccagatggtcggcgctcacgtgcgtggcctcgtgggtggaggtcttcatgaagtcgacctcgacctgcagcgggctcttggagatcagacgcagcagttgcgtttcggtctcgatcttcttcggcatgaggttcaggatcaccagcttgagcggacgcacacgctggcgctccgcttcgggcttttcaagcgcgaagatgcgctcggagtcgagaatgtctctggccggaaggccgctgggaatcttgataggcatgtttcctattatggtgcggacccggatatggcgtattcggcggttttcatcgacggtccgcagcgttatacgaaaaacggataacgcgttatcggatatgcgatttcactagcaacgcaatatgcgacacgccgatttgacttattagccaacatccgtaaagtagttagagctgcctcaatgaaggcaagccgacgcggggtggagcagctcggtagctcgctgggctcataacccagaggtccatggttcaaatccatgccccgctaccaattgaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgggctcataacccagaggtccatggttcaaatccatgccccgctaccaattgaaaggctaggaatcatgtggttcctagccttttctcgttttccatcacgtcttcgcgagtcgtggatctggacaaattctggacaaatccaccaagtgcaatcacacggaatcaacacgtcaacctattgtccactgctttgaaggttgctgtatctctcccaatcatcttgcgtaggattagctaaatgcccacgccgatcattcaccgcaagtatgggatcgatcaacactgagtaccgataatgactaccgtcctcagacataattcgtttgtatcgtcgttccacatcttgatcaatatcgattttttcttctttcaactcatcgtagataccgcacattccaagaacattggtttctagataatcaaacttgctttgatacatagccttaaccgatatgccatatctgtcagcagtttcgggcaacttatatcgtggccaattctcaacaatgttttcaacttcgtcaacgtagtgttctagttgggcggcacgatcgacttcaatttcttggatagcggagccgctaacagattgacgaaagtcaccatctagctcaaaaccgtttttttcgtccaaaatgaatgcacgcaactgtttttcacaattgcttgaggctttttgtccggtcgcccctccattgattttttcccaatcagcatgcactgattgaccattgcgataaatccaccccatcttcttcattgcccgtacagccgtcacaaagtccggtgcgattggagcaaagctaatcagagctcctttaatctctgccgaacatatccagccattccttagcacccaccattccttatcatccataacatctcgagcaagttcactcaacggttcatggtcattcgtctgcatagcagatccttgaatacgacgaggaaacatcatcacactctcattgacagcatcaatgatgtcactacttctgtcgacgtctactattgctcgacgcaatctccagtatgggagatatttcttcaatcgcggtaagtcgtattgcggatccccaagaatacgcaacacatcatcaccacttagccgagttcgaccggtaaacacattcttggctttatccgcactgaagcccagtcggcgtccaagttgtttgtatgtcattccctgtttcagggcagatttctttaatgcttctacaagcatttcagaatcaatttgcataattctccaaatcctcaaaacgttgctattccaacagaaagcaaaacctaaagtgtaaattctacacctttctgaatgcatgctttcagacatgcgattggatggaattacacacgcaaacgcaacgcagaaaggaggtgatgaaatggcagacgaacagacaccacggctgcacgcggaaatcgtgcagggtatcagcaaagccggtaaccgctacgagtgcatcgaagtcctgctcgacggaatgtcgatcggcagaatcttccccagcaagctcgaaatggccatgatcaagcagaccctcggcatctgacatatagcgctggaggacgttgtcggacgccctccagccacatccacaatccaaacccttaagtccacgaggaggacaaatggacgcactcatcaccttagtacatcaacatccggctgccattcttgcaatcgcctgcgttattgcagttatcggggtcgcagcatacgtggtatccgctctacgcaatagtctcatggcatccgcactatctgctaagccgatgtccctcacgaaagaacagatcaaatgctgctccgtggaatggcgctggaacccctcacgaatcactttcacaattccagccgcttacacgagcgacgagggaatcaacaaatgggcggacgaagtagctccacgattgggaatgagattccagcccaccgaggtccggatcattccacgcaggctcttccgatcagcgcaatacaaggtcaccttcgcaaaactgaaggagctccgataatgcttcttaagaaacaaaatgccgttcaacggtatgagctaggtgcagaggtatcgaggccaaagcaaatggcctcgataccccgcaccgcccacctcgccatcatcggtgaatccaattccggcaagggcagcgtcatcgcaaacatcatcaggcaagaagtggaggctggcggggaagtctggttcattgatttgaagtccggcatggaggccgaaaactacgccgccgtgctcgataacaaggcttactccttgcaagaagcaaaagatcttctctccgctttcaacacggacgtggatgcacgagccgaacgttggcgtgggcaagtccgcaccgtcgatgatcagcgcgagcggcaccgcctgctcgtcattgatgaggccgccgatctcatccgttccggttctgataagaagacttcggacgcgtgcgtggagtccatcagatcggcactgtctcggtctagagcattgaactgcaccgtggtcgtggccacgcagaacccacgcgtgagcaccagtctcccctatcgcagtctgctgcttaccacgttagcgttgcgtctgaattccaagagcgaggctgtgatggcccttggcgaggacgccgtgcagcgtggtgcccgtccatggcagatcagttataaccgcccaggcgatggctacctttgggatagcgaatccaacacggtgaagtatatccacgtgccgtttatgacggatcaggacattcagtcactgcgacgcctcggcaatgatgacgaacgggcgaagcgacagcgagagcccgctcacactcaacggacaatttgtgggggctactacgacgacgcccccacaagggatgagggatgagggacaaaatgactcatcagagaaaagccacgagcgaaaaaggccggtactgggctggtctaatctatcccgatagttgtcccgacgattgggaagaccggatgaagatcagcggtctggaaatcctcgtctctcccgtacatgatcaggacattgccgacatcgccaccggcgagttgaagaaaccgcaccgccatgtgatcgccatgtgggccaacacgaccacacgccagaatgccgaaaggttctttgaacagttcaatggaccaaaggttatcctgcggctggagaacccccgaggaatggcccggtacctaatccacatggatgatccgggtaaggccccgtatagccccgaagacgtgctcgagttcaacggtgcggactggaagaagatcgcactaatcgagggtaatcaggccgacgccatgtccatcgtgaagatggtggaggaagagaacattcacggatacttcgatcttctgaaggcctgcgaagccgactaccccgatctgctcgagttcgcaacaaaacaagtcagtttctgtcgggaagtcatctggagctattggaattcgtatttcgcattgcctaaggaggcacgtcatggaaaagcttgaaccagacatacagctcaaattcctcgatgtcgcagctctccaagccatgtttggcgtaggccgttccaaggcccgtctaatgatggatgcgctgccatcaatccgagtgggcaacaaggactatgtcagccaaaaggctttgaccgactacctcaccgtcaatggcggtatccccatcagctggcccaaacgtcgccgataaaacttcggcccggttttcttcttaggcaaatagccagaaggaggccgggcctttctgcgcacgacgacgggaccggttatccttaaccacatgagtgaaaccatcgccgaaatacgcaacaaagccgccactctgctttctccagaacagcagcagcaatgggaacagtttcttactcccatgccagttgccgaacaagccgcgagtctcttcactcactctgataagcccgttcacatactcgatcttggttccggcaccggcatcttaggagcggtgactgcacgtcaagcagcccccggcagcagcgtcttagccattgaacaggacgacaagctcgcctctgcttccgagctctctctcgcccaagtttgcgataggacaaaggtcatccatacatcggtgtttaacgttttactcaatgctgagttcgatcgggttatccttaatcctccatacaaaaagatccgtccaatcaccattcctaccagtagaggcgaattgaaaatcactaacctctatgcagcttttttagtgattgcagttcaggcgctttccgagggcggggaatgcgtcgcaatcattccccgttcgtggatgaatggtgcgtactttaaagatttccgaaaatggctactcgatgaatgcagccttgacgtaattgcggtatacggttcacggcaggaacactttaaggacatgtctattcttcaggaaatcatgctgcttagggtatccaagcgtccccaaacacgcagtgtcactatttacggcaatatcacgccagttcgctcattagggtcacaaccatcagtgcaggcttccctagactcaatcacccttggaagagatcgcattctttgcatacagcagcaagattctcgtctatccgaatttaagtctttggaagcccaaggactatgggtatcgactggcaaattggtgtggttccggaaccgtgatctactgtcggaaaacaaacccgtggacggatatcccctatactggtccgataatcaaaatgggctgaggacccaacatcctatcgaatgtgaccgagagcaatgggtaaccagtagcgcaaccgatcgcaatgtcttgcttccggctggcgactattgtcttgtcaatcggttctcagccaaagagcagcttcatcgcattcatgcttcgtgcctcagcagcgacgtagaatttgcagccgacaataagttgaattacattcatcagggcacatcgcgtaggacaatgcctctggatagtgatgtcgcacgcgggttaacgctctggctatccacaactatcatcgacaactggtaccgccagatttccggtagcacccaagtcaacgcaactgatctacggcaactcccctgtccatccaaggaacagcttatccagctttcacgtctgctacctactgatatttacgcaagccaaagcctgattgatcaaacggttggaggtttattttcatggacaaaagccagctgattgctgatgccattgacacattgcgcgaacttggagttggcaaggaccaacaaaatgagcgtagcgcaatgacattgctcgccttacttcagctcaagcccggagacaactggcagcaggctaccaatcccatgttgggaacccgcgccatcatggattggattagagactactatgaagtggactacaaaccaaatacccgtgaaaccatccgcaggtttacgctccatcaattcgtaatcgccgaattagtggaggagaatgccgatcgacccgatcgcccaatcaattctccaaaatggaactaccgtataacaaatgacacgttgaatatgctgctgcatcgcggcgagtccgagttcgaattgattctcaagagattcctcgagcagcatgaatcctatcaatctcttgcagaggaacggaagaatatgccaaaaacacctgtgattcttccttcaggtgctgccctgagtctatctccaagtggtcagtctcttctgattaaagcaatggtggaggaaatgctgccacgctttgctcccggatgccaagtcgcttatatcgacgatactgaccataagcatggtgccgtagaccccgcattgttggatgaacttggaatcagtcttaaggctcgcgagaaagcgccagacgtcatcgcttgggatgcaaaacgtggctggctatttctcatggaagctgcaagtactcacggcccggttgacgtgaccagaaagaatgaactgcacgaactgttctccgagcagtggggcaaaatcgtattggtctcatgctttcctgatcgcaagaccatgcaaaagtacctcgccctactagcatgggaaaccgaagcatggtgcgccgacacaccagatcatatgatgcacttcaacggatcccgtttcatgggaccatacggagagtaggtcactaacattggctgcgaagcagctctcccataaagtcagctgccttgcggtcgttttctcctacctcctcagcatagatattcaacgtcgtgttcaggctctcgtgaccaagacgggcttgtaccgttttaggatccacgcctccggcaacaagtagtgtagcctgagcacgacgaagcgcatggaaattaggaccgacgtagccagtctgtttcaccctttcgactccgcgcttatcaacatatcgagtctcattggcatagtgcgccaaaccttctttgacgtaaaattttcgacgccaacggctgaagttgtcaggatccaagaagccgcataattcgttgctgcataccggtgaatcatcttgctgttcaacacctgctgcgctgaacatgtcatgttggcgagctttccactgtttcagaaattcaactgtctgtttatcgatggaaatggtacgtcgagacttggcagtcttgggatccttcagaatcttctccttgccgagctgtttgcgtatacgcagtcgtgcgttgtctagatccacgtcttcccacaccagcgccaatgcttcgccacggcgaagacctgtggccacgcccaaccagacagccacgattcgtccatcctgcggctcttgcttgatcttgtgaacgaacgctaaggcttgctccttggtgattcgcgtttccctacgcttctgttggctcacctttggacgtttgatgccttccaccgcatcacatgggttgcggttaatcagttcatccaagaaagccttgcgcatgatctgggataatttcatatggaccttgtgaatggcgtctggcgaagctccatcctgttccgacatgcgtaaataggcattctcaatctgctgcgaggtaaggtcgattacccttatctctccaagatattttttgattcggtcaatctcatgttggtcccgctcaatagtgagtacagaaaccgtaccgagagccttgcgattggactggaacatgtcagcgtattccgctaccgtcacgttcttgccggaacgctcatcctcgagttcctgcttgtaggcaaccatcgctgctgtggcctcggctttgttcccatagaccttacgcgactttgaccagtgccaagacttatgttcattgtctggagcgagacggacacgaatcgaatacttccgtcctcgctccaattcggtgatctgtccggatgtttcccgcttcgtcatatcgcctactccttcaacagttggttctatgctaccaaatttggacaaatctggacacaaataatctggacaaaagttggacaaactcgccaatcacaaccaatacggaacaaacaaaatgccgtgttttaagccattgtcgcactatataatagacaataacaaactagaacaatatgagagaacgtgggctcataacccagaggtccatggttcaaatccatgccccgctaccaattgaaaccggaaaccttttggtttccggttttttgttttccccaggacgtttcgctccttttatataaagtccccatacatatcgaacgcaaccggcacacacaacgtatggtcatgccgctgtagccttcataatcgaacataatcgcaaaccatgtattaaaacgctttaccaaaagtatttgaagaaagtacttgtagccgcatcgccgtaatcgttacgaaaaagggaaatcacaaaaagaacacaactacctctataatcggctatatgaatgaagcaacatcatcaagcgcgacaccgcgcacaaaggcaacagcaaagacaacagccaaggcagcggccacaaagacaacgaggacagccgcgaaatcaaccgcaaagacgacaaccaaaaaaccaaccaccaagcgcacttccaagccgaaaaccgcaacgaagcgaaccgtcggcgaaactccagcacctatcatcaaccgcaccagcccggaacagttcggccgcgtaaacgttcttgacatcactccgtccgccgaaaacggcctgtacccggctcgcgtggagcttggcgaggcattcaaggtcaccgcgcaggtgttcatcgaaggccgcaccaaggccggtgccaccgtgtccgtgcgcaacacgcgcggcaccgagaaggcccgcttcccgatgacctgcaccaatccgggcctggaccgctgggaagcgatggtcaagatcggcgaccacagcgacctgaagccgtgggaagatggctatgccgacgtcaagaagcagctcggcgaatggcacatcgtggtcgaaggctgggaggatacgtacgcttcctggctgcacgacgcgcaaatcaaggtcgaggtcggcgacgatgtggagaacgcgctggaatccggcgcgcagctgctggaacgttgggctggcgcacgcgattccaagctgaccgccgacgacaagaagacgctgcgcgaagcggcgaaggccgttgccgacaagtcgctcgacgcgaccgcgcgtcttgccgcagcgaccaccgacgcaatcgcaagcctgcatgaaaccaatccgctgcgcgacggcctgagcgcgtcgaatccgcagcgcttccgcgtggagcgtccgaagtcgagcttcgccgcatggtaccagttcttcccgcgttccgaaggcgcgtatttcgacgccgacggcaagatcgtgcagggcacgctgaagacggcgctgtccggcctcgaccgcgcgaaggccgaaggcttcgacatcgtgtacctgccgccgatcttcccgattggcgtgaccaaccgcaagggccgcaacaattcgctggtggccggaccgttcgacccgggctccccgttcggcatcggctccgagctgggcggccacgacaccgtcgacccgctgctcggcaccatggacgatttcaaggcgttctgcgattacgcgcacaagctgggtatcgaagtggcgctcgacttcgcgctgcagtgctcgcctgaccacccgtgggtcaagcagcatccgaactggttccgcaccaagccggacggaacgatcgcattcgccgagaatccgccgaagaagtaccaggacatctatccgatcgatttcaacgccgacatggaaggcatcgaggccgaggttgaacgcatcatggacctgtgggtcaaggctggtgtgacgatcttccgtgtggacaatccgcataccaagccggtgcggttctggcaggatgtgatcgccgcggtcaccaagaagcatcccgaggtgctgttcctggccgaggcgttcacccgtccgggcatgatgcgcgcgctgagctatgccggcttcacgcagtcgcactgctacttcccgtggcgcaacaccaaggaggagcttgaggagtacttggaggagaccaacggcgacggtggtttctaccagcacaacaccttctggccgtccacgccggatatcatgaccgcctacctgcgcgacaacggtatcgccggtcacgcggtgcgcgcggtgctcgccgcgatgggctctccgagctggggcatctacaacggctatgagctgatcgagaacaagcagcgtccgggattcgaagagcaaatcgacaacgagaagtacgaagtcaaggtgcgcgattgggacgaggccgacaagtacggcatctccgagctgctcacctcgctcaacaaaatccgttccgagcatccggcatgccgcagctaccacaacctgcacgtcctgccgagcgacgacgcgggcgtcatcgcgttcctgcgccagaccccggccgagcttaccggtaccggcaagccggatacggtgatcgtggtggtgaacctcgacggccacaacgcgcatcagtccatcgtccacatcgagctgccggacttcggtttcgccaccgacaagccgctcaaggtgcatgacgaactgaccggccgcgacttcgaatggggttacgacaactacgtttcgctggcaccgtgggccgacgtggcgcacgtgctgacggtgatcgaggactgagtgagtttggatgctaggcactctgcctagcatccagccagcgcaaaacacatagatcaaagccgggttgaagacgtttctcacgttttcaacccggctttgtgcattccgtaggtggttttttgattccgtaggtgctctccggtcaatccacgcaaacagaatggctgaaatcaagcctttttgccgcagggataccagagccaaccacctacggaagagcaaaaccacctacggaattgttcttccaacgttccaaggcaggatagtcaatcacaatcggccaaaaagatgttgaccagcgagcgcatcacgccttatctccccagcactgagcaccattcatataggtatccggaaaatggtgccgacatggcgcgaaagcgggtatcctaagtaacgaactactgctgatcatatcgatcaaggagaaaacaatggcagaaacctttaacgtcgtggtggagatcccgcgcggttccaagaacaagtacgaagtggaccacgagaccggtcgcgtgttcctggaccgcaccctgttcacctccatgggctacccggatgactacggctacatcgacggcaccctgggcgaggacggcgatccgctcgacgctctcgtcatgatcccgaactccgtgttcccgggctgcgtggtggaatgccgcgccgtcggcctgtaccacatggtcgacgaggccggcggagacgacaaggtgctgtgcgtgccggctgacgtccgcttcgacgacatcaaggatgtcgaagatgtttccgagtaccacaaggctgaaatcaagcacttcttcgagcagtacaaggctctggagccgggcaaggaagtcctgccgggcgattactggaccggtgccgctaaggccgaggaggaaatcgtcgcagcccgcaagcgcctcgctgatagcgagaagtgatcgcttctcccctttttatgtcaaagcccactgcccccgacagtgggctttttctcttttccagccagtggaggccaggtgccgttgcggggagtccaacggaccaaagcgtccgatttcttcgtaccgcggtatagtggtctcttgtaattttcggcatgcgaacagtattcgctgaattcaaagcccgctggacgtcacatatcacatccgcgtgcggcagttctgtgtcggtactcctaggcgtaggcggaacgcaatccgtcgaggcccatcccgtggggagaccggcgggatgaaccttttcaccagctatgctcattcagattctgcttattggcgtgtccgtgtccatggacgcgttcgctgtctccattggcaaaggcctgaccgtcaagaagcttcgcggcgtcgatgcgctcaaaaccgccctgtggttcggcggattccaggcgctgttccctctgttcggctatttcgcggccagcacgttcagcaaatacgtgaccgccgtggaccattggatcattttcggcctactcgctctgatcggcggcaatatgatgcgcgaagccttcgaagaagacgaggagaacgccaaggagaccgcggaattcgattggcggcacatgttgccgctcgccgtggcctgcagcatcgacgccttcgccgtcggcgtgagcttcgctttcatgacgctcaacatctggctgtcggtggtcatcatcggcatcaccaccggcctgttctccgccgccggcctgtatatcggccgcgcgttcggctcgcggtggcagaagcccgcgcagatcgccggcggcatcgtgctgattcttatcggcgtgaaggtgctgttcgagcatctcggattcctcggttgactgccaatccaacataataaaagcccgtaatcattgcgattacgggctttgtcattagaacagccgtttacagcacgacgatggcgagcgccgccagaccgactgcgagaccggtcagcatgaccggcagcagtgcgaggccgatccacggcgaacgcgcatccggctcggggtcggcgtcgcggtgccagaagtacgagcacacggtgagcgccacggccaccaataccgtcacgatcgcggcgacgacccatgtcgtggtcacgttgctgaacatgtccaccgtggctccggaggcagcggacatggcggcggccttggaatgcgttgtcggcaggagcaccggcaggaagcaccagcccgcgctggcgatcatcgcaacgccttcgaccacgctgtgcgacagcgagcggatgaggtgcgtgcggttttcgcgggccatctggcgtccgaaggagatcacgatcagcaggatcagcaggccgccgacgccggcgatccagccgtcctccatggagaagtccttgccgccggtcgcgtcggcggcgaaaatcgcccgtccgagcgtcatcgtcgtggcgcacaccaccgacagcaggccggcgatgacggcgatcacgtgtccggcggtgccgtcgcggaacgggctgaacactaccagcagcgcgatcatcgccagcgatccgatgatggtgaacggcaccacggcgggattggcggaatcgccgtatgcgatgccgggaacgagcgcgagcgccaccaataccacgtacgcgacgatctggatcgccaatactttgccgaaagcgaccttcgacgggttttgctgggaaacggcctgcggagcggtcatctcggacccccttttcatattgtggtcaatacgtatgcaatatgaataaatgtagccgtatgtgtccacatacttcagttacaatcgatgaaacgccgataatacattttgcgtgtacaatcgcggcatcagtttagaacaaaagggagctgacgtgacggatcttacgcttatgacgttcgctagcgatccagctaccgttctcccctcgttggtgctactttcccaccgcgtgcgcgtgttgccgatggatgcggccagcctggtgaagatgccggagaacaccattctgtttcttgatgcgcgtgacgacctggccaccgccaaaacgctgtgccgtctgattcacgcgtcgggactgtccacgccgatcgtgctcattctcaccgagggtggtttcaccgtggtgaattcgcagtggggcatcgccgatgtggtggtggcctccgcttcccccgccgaagtggaggggcgtctgcgtctggtgtccgaacggggcaatgcgccggccagcacggccgctagcaccggcgagcagggcgtgcagaacgaggatggtctgatccgttccggcgatttggtggtggatacggatggctatacggccagtctgcacggccatccgatcgacttggcgtacaaggagttcgagctgctcaagtatctggtgcagcatccgggccgcgtgttcacgcgtgcgcagctgctgcaggaggtgtggggctacgactattacggcggcacccgcactgtggacgtgcatatccgtcgtctgcgcgccaagctgggtggcgagtacgagcatctcatcggcaccgtgcgcaacgtcggctatcgtttcgatccgccggaagaggatgagcatgaggccgcggccaaggatgcggctcacggcgaatccggcgaaagctgactttttcttgcgatcattccgttgatgttcgacgggttccgtttgttttcgttggcctttcgctgatttcccgttgttttttcgatggattttcgctgtttttgccgattgcgacgtttccgcaggtttcccgcgttcgtccgcatgcgaggggtaggctgggaggcatgcctcgggaatcgaagaaggcgcggatcgcgcgcatgcatcaggaatacgagcagttgtgcgtggagattcccgatccgaaatgcgcgttgaacttcaattctcctttcgaactgctggtggctacggtgttgagcgcgcagaccaccgacaagcgcgtgaacatggtcacgccggaactgttcggcgaatatcccggtccggcggagcttgccgccgcgaatcccgagcacgtcgaggacatcatccgcaccatcggcttcttccgtacgaaagcgcgcaatatcatcgggctgtcgcatgagttgtgcgtgcgattcgggggcgaggtgccagccgatatggcttcgctggtcagcctgccgggcgtgggccgcaaaaccgcgaacgtggtgttgggcaacgcgttcggcgtgcccggttttcctgtggacacgcatgtgattcgtgtgactgggcgattgcggtggcggtccgactgggcgagcccctcccctgacccggtggccatcgaacgtgaggtcaccgcctgcttccctcccgaagaatggaccgatctgtctcaccgtttgatattgcatggccgcgccatctgccatgcgcgaaaaccggattgcgccgactgccccctcaacgacacgtgtccgagcgcgttcgccgcgtgattccgacgcatgccagccgccgcgccggcactccgtcgaatcgcacccggccatcgggcgtgtagcacgcgtcaactagactcgggtgcatggatgaaaacgggcggaaacgtaatctgaaagccgaggcgacgcgctggctgatcttcttcggcgtcgcgatcgtgctcagtgtgctgctgtggctgggactgtcgctgacaggccgcaagaatcccatcacatccttcggcacgctcgtctccgactcgtcggtgaccgtcggcatcgaaggcaatgcgccgaaatcgcttgacatccgcaccgaacaaggcaccgccgtggagcaagcgctgctcggcaacgtatacgaaacgctggtgtcacgtagcgaaaccaacaagctgcagccgggaatcgccagctcctggcaggcttccgacgacggtctcacgtacacgttcacgttgaacggcggcatgacgttcgccaatgggcacaaactcgactcgtccgacgtggtctggtcgctgcagaacgccgtcaacaaccattacgtgggagccgaccagcttggtgatctgaaggaaatcaccaatcccaatgcgaatacggtggtcatcacgctcgccaagccgaatccgcggctgttgcgcgcgctggccggccgtgcaggcgtcgtgtacgacgcggaaagcaaaaccaactatgcgaaatcggcggtcggatcgggaccattcaccgtgtcaaccgcggaccaatcgcaaatcgcgctgcaacgcaacgactcgtattggggcaaaaaagccgcatcatcgcaagtgacgctctactactacgccaacgaggaatccatggccgatgccatgaaagccggcaaaatcagcatggcgctgccgctgagcgcttcaaccgcctcggaactgggcaaaaccaacggtattaccgcggacagcggcatcagcttcgacaaggtgatgctcgcgttcaacaacgacaacaacagccccttctccgacgagcagatccgcaagatgacgcgatacgccatcgatgcgaagaccatcgccaagaacgcgcccgacgcgtacgcgccgctaggagggccgatcagcccgctggaagacgggtatgaggacctgagcggactgtacctctacaacctcgaacaggggcaacggatgcgcacgtatttcggagtgaactacatcgcgccaatcgacattctggtgccgaaggaatacgaaagcatcggcaacgacgtgaaaaccgccatcgaaaacctcaacatcaacaccaatctggaagtgctcgattccgccgcggacgtgacggaacgcatgaacgccggcacctataacatcgcgctgaccaccatgagcgacgaaggtgacgcaagcgtcttcgacaacggccagtccgtgttccatttcgagaacggcgacgcgcagcaggcttacgccaatgccatggccgcgaccaacgacaacgattatcaggcccgcatgcgcgattacgcgcgcgccgtcagcgagaacgcggccagcgactggctgtacacgcgcaagaacttccttgccgtttccgatgggctgcaggggtatccgaagaatctgaccgaccgtctgctgccgttgaacagattgacgctgcactgatttttccacggttttttatgtggattttccgcgatttgcctgcgattccggcattcggttcgataggcgctgatacgacggcagttgtcacattcgctttctagactagcgactatgactgaaagccaagataacaccatcaacgcgaacctcacgccgctgcccgacagggtcggcgtggacggtctcgaagacaagtggcgtggcgtctgggacgagagcggagtctacaagttccagggcacccgcgaccgcaaggccgtctattccatcgataccccgccgcccaccgtttcgggccacctgcatgtgggccacgtgttctcctacacgcataccgatgtgatcgcgcgtttcaagcgcatgaacggctacgacgtgttctacccgatgggctgggacgacaacggcctgccgaccgaacgccgtgtgcagaactattacggcgtgcgcgtggacacttccctgaagtacgatccgaatttcgtgccgccgttcgaaggcaccgatggcaagaagatcgacgccaaggaccaggtgccgatctcccgtaagaacttcatcgaactgtgtgaaaagctcaccgcccaggacgagaagcagttcgaggcgctgtggcgctccctcggcctgtccatcgactggtcgcagacctaccacaccatcggcgagcatccgcagcgcgtggcccagaaagcgttcctgcgcaacctggctcgcggagaggcgtatcagaaggacgccccgggcctgtgggacgtgacgttccagaccgcagtggcgcaggccgaactggaatcgcgcgaatacccgggcttctaccacaagttggccttccgtttcgaagacggcaccccgatctacatcgagaccacccgtccggaactgctggccgcctgcggcgcgctgatcgcgcatccggacgacgagcgttacaagcagtatttcggccagtacgtctactccccgctgttccatgtgaaggtgccgattctggcgcataaggcggcggaaatggacaagggcgccggcatcgccatgtgctgtacgttcggcgacgtgaccgacgtcgaatggtggcgcgatctgaacctgccgctgcgttccatcatccagcgcaacgggcgcatcgtcatggacaccccggattggatcgaagacgaggaaggcaagcgtatcttccaggagaccgcgggcaagaccacgttctccgcacgtaaggtcatcgtcgacgagctgcgcgctgccggcgatctggacggcgagccgaccccgaccaagcgtatgacgaacttctacgagaagggcgacaagccgctcgaaatcgtcacctcccgccagtggtacctgaagaacggcggcaccgacgagaagctaaacgccgagctcatcgcgcgcggcaaggagctgaacttccaccccgatttcatgcgcgtgcgctacgagaactgggtgcacggcctcaacggcgactggctgatctcccgccagcgcttcttcggcgttccgttcccgctgtggtacccggtgaaggaggatggcaccgccgattacgaccatccgatcaccccgagcgaggatcgtctgccgatcgacccgaccgacgatgtgccggaaggctacaccgaggaccagcgtgacgtgccgggcggcttcaccgccgagccggacatcatggacacctgggcgacttcgtcgctcaccccgcagatcgtgacccgctgggaggagccgggcgaggagaaccaggcgatcttcaatgccaccttcccgatggacctgcgtccgcagggtcaggacatcattcgtacctggctgttctccaccatggatcgcgcgcatctcgagaacaagtgcctgccgtgggccaacaccacgctgtctggctggatcctcgatccggaccacaagaagatgtcgaagtccaagggcaacgtggtcgtgccggacaagccgatcaagcagttcggcgccgacgcggtgcgttactgggccgccgccgcccgtctgggtctggatgccacgtacgacgagggtcagatgaagatcggccgccgtcttgccatcaagctgctcaacgccaccaagttcgctctggccatcggacgtgaggacgagaaccatcacgtgggcgctccggcagtcgccgcatggaacccggccgacgtgaccgagccgatcgaccgttccgcgatgtccaagatggccgccgtggtccgcgaagccaccgacgatctcaacaactacgagcattccaaggctctggaagtcatcgagaactacttctggcagttctgcgacgactacatcgagctggtcaagaaccgcgcctacggcaccgccgattccaccggcaacgtgccgagcgaggccgcggtgaagtccgcacgcaccacgctgggcctgggtcttgatgcgttcgcgcgcctgctggccccgtacctgccgtatgccaccgaagaggtgtggagctggatgcatgagggcgagggctccgtgcaccgcgccgcatggcctgtggccgacgtgtacgcggccgccgccggcgacgcatccgccgatctgcttgctcatgccggtgaggctctggccgcgctgcgtggcatcaagtcgaaggccaaggtttcgatgaagaccccgatcttgtctgtgacgcttgccgttgccgacgatgtgcgcgggtccatcgaggccgcgctgggcgatatcgccgaagctggtcgcgtgaccggaccgatcgccttcaccgcaccggctgccgccgagggtgagaacgaggccgccgatgtgacggtcgccgaaagcgagctaggcgaaccgccggccaagaaaccgaagaagtgagtctctgaggtgagccgccagcggcttttgtagcgcagccgctcacttcacccacatacgaggggcctttcctttgcatgaaggagaggcccctcgtatatcccgtcactgtctgcaactaaccgtgcccccttttgctcatattcagtcaaaatcgcgggaaaaatgctttcgtgagcgaaaaggggtataaatcgcaggcaaaacggtcgaaatcatatccccttttgctcacgtccgtgcagaatcgccctaaatcgcaagacgtgcgcgcatagaaccgtccttatcccgttctcggctgttctcagcgtacattcctgcccctgcgcacaaacccgtacgcgaaaaatggtttttatgggcgtaatctcaacgaatgcacaagcggaggcggaaatcgcaatcaaaaaccccgaaacgtaccacgtaagcaacggagcactatcggatttagtgcaccacaccaaccgcgtgctctacaacaccggaacggacaggaggtactgcgggccagcggacgaatttccggaaccgttcccacccaatccggcctgcagcgcatcgtcgaaaacttccgcagcggcggccaattcgaccgtctcgtcaatcaaatcgccattatccggcgtgaaaccggttttcgccaagccatagccggcaaccggcaacgaactggacatcgaatcggcggaagaagaggaatcggaaccgctgttcttcgaagagccgtccactcccccgactttcgccacattcttcgacgtggtgtccgctgcggcgccgaacgacgggcgtagtccgcccgcgtagctcatcacatcatccatgctgatggcgttcttgtcatcgaccaagctggtcgaatcggcggtgttgttcttcgcctgcgcgcgttcggccttgcgttgcgcacgggaccgccgtttctcggctttcgcgcacaacgattggctggcggaggcggaacgcaacatgtccagcacagaagcgtcatcggcagcgcccgattcggacgtgtcgtcatccgaatccagctggtcggcgaatcgcagcacgatctggtggaatgcgctggcctgtccggtgtgctcgctggcgtccgccaacgcggtcatcgccgcggacaccttgtcggacgcggttttgagcttctcattgtctttgatgccggcacgcacgtcggcgatcgcctgggtttcgtagctgccagccgtgcctgcggtggcgcccagttccttaagccgagccgtgtatgcgtcggtgaaatccatcgaatacgggatcatggccgcggacagctgcgattggccggcactgtagtctttggagccgcgctgttgttcctcgccggcgcgcttggtgagctcgttcaccaagccggatgtgccgcgctgttcgatggtgcgaatcacctcgtcgacggcgtcggccgcgccgatatgccggtatgcggcgctcacgtcgttgacggcgttggccaggtctgccacggatttagctacggaggtatcgccgttcagttcggacgcggtgccgagaatggcgggaagctgtgtggcgttgccgatcgaaccggacagatgcgtggtgtatgagcccacgtacgcgtcgatgtagccgtcgaacgcctgatcgtgcgctttggaacgtacggcgatggtctgtttggcaagcgctttctcgttgtctctgagctgttccagttgggcgatgagcttgcggttgcgttgcgagccgacgttggtcagaccgtccaccaaggtggttgcgcgcttggtcaggtcaggcagtgattgctgaacgttgccttccaccgcggcgatggacagtgagctcatggtgaagtgcttcgccgtcacgtaggcgttgaaggtcaggtcctcgcccggtttgccgaccgcagccaccagggtcgaggtgttgtcggatgagacgagcacgccgtcatcggcggtcacgtcactgccgacgcgtccgggaatggtgaaggcgacgattggcgtcagattggcggtcacgtcgggtttcgtggcatgcagggcgatgcgtatgccgatcatgccggaagcgccggaaacgtcggaaacgcttacgtcgggcccgttgagggtgaaggaggcggatattttccacggcaatgcgacaacgcctttgggaacgcgtttcgacgtggaggatccgctgttggtcaggaaaaggcggcctggtttgtcgatggaggtgtaggcgctcatcacgtcatcatgcgatgcatcggccgcgtactgcccattctgttgcaaggccgatatcgcgtcgttcacgccgactgccgcgacgggagcggcggtgatgacggcgaccgcgatcgccgcggcaagcgggcgtcgggcaccggatggacggttcgcggtggcgtggcgcatgccggacctctcaatcgcaatcgaaacaactttccaaggcatttaatgtagtgcccggcatgcccgtcggcaatggacgttcgcgcggggcgcgcggaaaacggacggctcaggcgaaaacgtcgagtacgcccgggtctcccccgttttcggcgatgcgcttgtggcggcgcttggcctcggtcaccacgaattcgcggtacatttcggcgatttccggatccagtccggcttcgtcggcaatgcgatgcagacgctcgatctgggcatgttcacgctggtaatcggccggcgcgaagcccgcacgcgccttgagcacacccacctgcgacgtgtatttgaaccgttccgccagcagcgagacgatggcggtgtcgacgttgtctatcgattggcgcagcgaggcgattttagccaccacatcggccacttcggggttgttctgcgcggtgcgcgcgtcgatgatggtttcggattcggtttcttcttctggccgaagccagtcatgttcgctgtcgctcatgggtataagcctaccgcgcaccctaccgcggcatctgccgaacagcggtcacttcgcgaagtaacgctgcagcacgatggtggtttcggtgctgaccgacaccgtgcgatggatgaggttcaacagctcttcgagcttgctgggcgattcgacgcgaacggtgagcatgaagctgggcgaaccggcgacggaatcgcaggacatgatgccgtcgatgtttttgagcttgtctggaatctcggcttcctgggagtaatcgatgggcgtgaccgcgatgtaggcgttcaccgcaaggccgcggcgctcgtcgtcgataaccgccttgtagcctcggatcacgccgcgacgctcaagcttctgcacgcgcgactgcacggcggacacggacaggcctgtcgcctcggaaaggtgggacagcgtggctcggccatccttttcaagcatgtcgaggattacgccatcggtcgcgtcgagctggctcgcaaccgtacgtgcgtctaccggaccattgtcactgttggtcattcataccccttttccaacaatccactgcaccggccgcaatcgaccgtccccactgcagttccatgttctttttcttccttaccatacccactaccgcgcacataccgtcgcggaatcgccgcagtttatccggacggcgcaacgctgtcatgaaatatctttgttttatttagctcatacccccatatcgaccatatatattttccccatttatcttttctcgtcgtatttttacctattttttaattgacaacgttgtccaagaagtggtcaatttcacgaaattcgtcgaaacgtacgcataggaaaggggctacacggcgattgccatgcagcccctcaaaccttcagattcgcttgcagccgacgactcagttgccgttggtggcgttgccgctctgctggatgagcgacgccatgaaatcgcggttggtcgctgtcttcttcaggcgtggcacgagcgtctggtaggcctgttccggctcgaggccgcccagcaggcgacgcagacggtagatgatcggcagttcctgaggatcggtgatgagctcctcgcggcgggtgccggaggcgttcacgtcgatggccgggaacaggcgcttgtcggcgagctcacggctcaggcgcaattccatgttgccggtgcccttgaattcctcgaagatcacctcgtccatcttggaaccggtttccaccagcgcggaggagatgatggtcagggagccgccgttttcgatgttgcgggcggcgccgaagaacttcttcggcgggtacagcgcctgcgcgtccacaccaccggacaggatgcggccggaggccggcgcggcgatgttgtaggcgcgggccagacgggtcatggagtcgagcagcaccaccacgtcctggccgagctccacgagacgcttggcgcgttcgatggccagttcggcgacggtggtgtggtcggaggccggacggtcgaaggtggaggagatgacctcgccctgcaccgtgcgttccatgtcggtgacttcctccggacgttcgtccacgaggacgaccatcaggtggacttccggattgttggtggcgatcgcgttggcgatgttctgcagggtgatggtcttgccggccttcggcggggacacgatcaggccacgctggcccttgccgatcggcgccacgatgtcgatgaggcggccggtgagcttgttcggcgtggtctcctgcttcaggcgttcctgcggatacagcggggtgagcttgctgaactgcggacgatgctgcgcttcctcgacgctcatgccgttgatggagtcgatggactgcagcggcacgaacttctgacgctggttgcgacgttcgccttcacgcggggcgcggatggagccgtgcacggcgtcgcccttgcgcaggccgtacttcttgacctggcccatggagacatacacgtcgttcggtcccggcaggtagccggacgtacgcacgaacgcgtaggagtcgagcacgtcgacgatgccggcgaccggcacgaggtcttccttcggctcgtcgcgatgctggtcgcggtcggcgcgatccatacgatcgttgcgctggtcgcggtcggcgttgcggtccatgcggtcggcgcgatcgttacggtcgttgcgatcattgcgatcgcccctgccgcgacgctcgtcacgctcgtcgtaatcgcggtcacggccacgcatacggcggccacggcgatcgttgcgtccacggctgtgacggtattcgttgtcttcggtctcgtcgcgacgcttatcatcgtcggcgtcttcctgcgacggcagcgtggcgaggatgtcatcaaggtcgcgcacgacgtcttcgctcttcggcccgtccgccacgcgacggcggcgacgcggctcgaaatcgtccctacggtcgtcatcacgacggcgacggcggtcatcctgcttcggagcggcatcgtcaaggcccagttcggcgagcaggtcggcgccggcttcggcgtcacgatggcgacgacgcttcggcgcttcatcgttcggcttcaacgcgtccaccgctgccacggcatccgcgacttcggaggattccgcggacttggcctgcttggcacggacggggcgttcctcctgcttggcttcatcggccttcttgtcctttgccgatttgacctcagcgtctgcggcgggagcggactttggcgcgcgcacggtgacgccggccggagcctggccgccggaacgggcggcttgaagtgttgcgatcagttcggtcttgcgcatggtggagacaccacgaagtcccatctgcttggcgagctccttgagctcgggcagtttcatatcatcgagattagggcttgttgccactggtagttgcctttccttggcttccacaggcatgcgcccgcgacagctgtaaaaaagaattgcggaaaatttccgtcgaatgaaaagtccgccgcgaaacatcgcggttttcgaactgtcctaaccatacaacgcaacccagaccaacgcaaagcgggcacgcgcggtccgcccgtgcggttcgcgcaccgcgcaatcgcaatgaaaatcgcaatgaaaaagcccatgccaaaaagcatgggcttgatcaaagttacgctgcgaaaaataaataacgcgtgcgaagacgcccgtctgaggccgaaggcatacaaaggtacgtcgagcgccggagaaagggcgtatgcgcacgcgttatttatttttctacttttcttcgtggtaggacttgtcagtgttgaccgaccacacgttgtctttcgacgtttcgccgctcttgatgtccttgacggcttcgatggcggtggccatggagtggtccatgttgttgtaacggtgctgtccgttacggccaacgcagtacaggttgccgaaggagtcgaggtagtcgacgagttcgggcatgcggtcgtaggtgtcgaagtaggccgggtaagccttcttgacgcgttcgcggtgggagtcgagcacgtcctgcgggccgttgatgacctgcatgcgggtgagctcctggatggcgaacttggtggcttcctcgtcggtcatgttccagaaggagtcgccttcctcgcagaagtattcgaggccgatccacacggtgttgtcgacgtccttgaccaggtacgggctccagttgttgaagatctgcagacggccgaccttgtagcccggatcctgcacgtaaatccagcaatccggcacgatcggcgggttgccgagggtcggaatgtcggtggtgttggtcaggcgcaggtgcttgacgagcaggccgacggtgacgaaatcgcggtacggcaggccgttggcgatttcggtcatatccttcggagccggctggtcggaggcgtccacggcgttgacaaggtccttgaccggcatggaggaaatgaagtcgtccgcggccatttcggtgcggttgccttcggaatcctcgtacacgacggatgcgatcttgccgtccttctggcgaatttccaccacattggcgtcggtgatgaccttcacgccggcggcttcgcagttggattcgacggtttcccacagctggcccgggccgagcttcggataccagaattcctcgatgagggaggtttcgacttcggagttgtcgcgcttcttcggcaggagcttctggaaggcgttcttcagcacgcccatgatgctcaggcccttgacgcgctgtgcgccccagtcggcggagatttcggacgggtgacggccccacagcttctcggtgtagccctcgaagaacatggagtagagcttacggccgaaacggttgatgtagaagttctccaggttggtttccggcagcttgtgcaccatggacttcaggtagctgaagccggcgaccatggtgagcttgaagcccatggccttcagggtgttggcgctcagggaaatcgggtagtcgaggaagtggcggttccagtagatgcgggacacgcggtggcgcttgagcatcaccttgtcttcgatttccggatccgggccgcccggctccatatcatgctcgcggtggagcttcttgtcatcatagctgggtgcgccctgcagcggcagaacgtccttccaccagtccatgatgcggtcgtccttcgagaagaagcggtggccgccgatatccatacgattgccgtcatgcttgacggtgcgggagatgccgccgaattcgcgggtggcttccagcacggtcacgtcgtactgttcggagccaccgtccttgacgagctcccaagcggcagtcaggccggcagggccgccaccgatgatgaccacggattgcttttgcgtcactttgaagtctccttacaaacaaaatcgaagatattctacccgaaggtagggaaacgcacagcgcacctgtgcgcatgcacacaaaatcaccgccaagtccgacagcaatcgccctgatagaaggaaaaccagccgtacggcttccgccgaagactggttttccgtaggtctgctacatgctgtcgggaatgtcgatgtcggttttctgcacttcctcgacgttcacgtccttgaacgtgacgatgcgcacgttcttgacgaaacggctggaacggtagacgtcccacacccacgcgtcggtcagccgcacgtcgaagtagacgtcctggccggcggaacgcacgttgaaatcgaccttgttggccagatagaagcggcgctcggtctccacaacgtaggtgaacagtttgatgacgtcgcggtattccttgtatagggacagctcggcgtcggtttcgtagttgtcgaggtcctcggcgctcatcgtctgccttccgtgtcgcgcttgcggccacgtccaagcgtgcgccaccaagcatccttcgaggttttgcgctcatccgagctgtacggccagttgttgtcggcatcgccggccttctggtccgtcttcgccgttccggatgcttcgttcggctgcgattcctgcgatggcgcggcagacgtctcgtcggcggaggtctgcgccgtgtctccactctggcctgccgctgcggcatcgtccgcatcgcccttatgtacggagttgagttggatggcgatcgagtgttcgcgggcgctcaacgcctccttgacgcccggattgtcttcgatcacgtgcatgccgaacgcgtcgagcgagcggatcgggtcgaattcgtcgacgagcgtgtccatgacgatgaggtcctggtaacggttctccgacgcgttccacagggcatcgcgcgaacggccggacggcacgaagccgagcgactggtagacggatacggaacgcgtgttctgttccggcacggccacccaaatgcggtgcatgccgaggcccgccggttccggcgcgaagccgtacgtcatcacgcggggcatgatgtctcgcgagtagccgcggccgcggtagtccttgccgagcaccacttggatgcgggcggaacgtgcccagccgtcgatgtcgatgaggaagatcatgccgatcacgttgtcggaagaggccgcgtcaagctcgccgtcgccgtcatggtcggcttcggtgacgatggaccatgcgatggtacgacgagattccggatcccccacgccggattcgttcgatttttcgccattggaccatgccacggaacgacgcacccacgcgttcacagcgccacgttcggccacgcggtccttgccggtgatgccggatgcgccgacgtacgcctcaatgacctccatgcgtgcgatgtcgtcgatggtggcggggcgcaagtgcaccatctcgcccttgatgggcggaatgacgatgcgttccggcagctccctcgcccgctggtccgtcgtctgttccttcgctgtggtttcagcgtactctgacatgattatcgttccctatgtttctcggcgcggtccctcgccacacccataccgacggtattgtacccgactgaacgccagctgggagttttgttaggcaaaatccccgtgaaacctcccccagccgacgcgtgaatcgtacgaaaaggcatgtaaaagcagataaaaagcaacaaaatgcagaaaggcgtgcgtttttacgattcctctcatcgcaaaaacgcacgcctttcgatgccatcaatcaggcaacgttcggcaatcgccggaacgtcacttgatcttgcccatcacgatcttggtgacggccttcgcgtcggcctggccgcgggtggcgcgcatgacagcgccgataatcgcgcccatcggcttcatgttgccgctcttgagcttctcgacgatgtccgggttggccgcgagtgcctcgtcgacggccttttcgagcgcgccgtcgtcggaaacgacctggaagccgtgcttcttgacgacctcgtccggagtgccttcgccggcgagcacgcctgcgacggtctgcttggcgagcttgtcgttgagcttgccgtcggcgatgagcttctcgacctcggcgacgtcggccggggtgatcggcagctcttcaaggctcacgcccttgttgttggcttcgcgggacagctcgcccagccaccacttcttggcgcccgaggcggaagcgccggccttgacggtgtcctcgagcaggtccagcgcgtcggcgttgagcacgtcgcgcatctccagatcgttgaagccccactcgcccttcaggcggttgcggcgctcacgaggcatttccggcatctggaccttcatttcctcgatgtgctccttggtgatgtgcagcatcaccagatccggatccgggaagtagcggtagtcgtcggcgtcggacttgacgcggccgccggcggtggtctgcgaggcctcgtcccagtgacgggtctcctgcagaatctcgccgccttcggaaaggatggcggcctgacggcggatctcgtactggatggtcttctcgatgccacggaacgagttcacgttcttggtttcggaacgggtgccgaacggatcggacgggctgttgcgcagcgacacgttcacgtcggcgcgcatgttgccctgctccatgcgggcatgggagatgttcagcgcacgcacgatgtcgcggatggcgcgcatgtaggcgcctgcgatttcgggggcgcggtctcctgcgccttcgatcggcttggtcacgatttcgatcagcggcacgccggcgcggttgtagtcgaccagcgagtggtcggcgccttcgatacggccgtcagcgccaccgacgtgggtgttcttgccggcgtcgtcttcgatgtgggcgcgctcgatcggcacacggaagatggtgccgtcctcaagctccacgtcgaggtagccgttgccgttggtcggcttgtcatactgcgagatctggtaatcgcgcggcatgtccgggtagaagtagttcttacgggcgaactggctccattcggcgatttcgcagtgcagggcgagacccagcttgatcgcgtaatcgacggcggtcttgttgaccaccggcagggagcccggcaggccgaggctcaccggggtgagctgggtgttcggctcgccgccgaagtggacttcggccgggcagaacagcttcgtggtggtggacagctccacgtgggtttccagaccgatgaccgggtcgaacttcttgacggcatcggcgtacttcatcaacttttcagccattttgttttctttcctccgatgcttcctacttgtccagtccgtcgagccacggggtcttcagggactgccagattgggccgttccagctttcctcgagggccgcttcgagagcggcggccggcttgtacatgacctcgtcgcgctgctgcggggcgaggaactggaagccgaccggcaggccgtcgtcgctcaggccggccgggatgctcatggccggcacgccggcgagattggccggaatggtggtgatgtcgatggcgtacatggccatcgggtcctcggtcttctcgccgaacttgaaggcggtgaccgggctggtcggaccgacgagcacgtcgaccttttcgaaggccttcttgaagtcgtcgatgatcagggtgcggactttctgcgcggagccgtaccaggcatcgtagtagccggcggacagggcgtaggtgccgaggatgatacgacgcttgacttcgtcgccgaagccggcctcacgggtgtaggccatcatgttggcggcggtctgcggaacgcctgccggcggcatgacgcgcaggccgtagcgcatgccatcgtaacgggccaggttggagctgacctcggacggcatgatgatgtagtaggcgccgagggagtacggcaggtgcggcagggacacttcgatgacctccgcgcccatttcctcaagcttcttgacgccttcgttgaagcgggccatgacgcccggctggaagccttcgccgccaagctccttgatcaggccgaccttgaggcccttcagatcgcgcttcatgccttcgcgggctgcggcgaccatcggacgcgggccttccggaatggaggtggaatcgcgcttgtcgtgtccgccgatcacttcctgcagcagggcggagtcgagcaccgtacgggagcacgggccgatctggtcgagcgaggaggccatggcgatcgcgccgaaacgggagacgccgccgtaggtcggcttgacgccgacggtaccggtcagcgagcccggctggcggatggagccgccggtgtcggtacccagggcgagcggagcttcgaatgcggccactgcggctgcggaaccgccgccggaaccgcccggcacgcgctcggtatcccacggattgtgggtggtctggtaggcggagtgctcggtggaggagccttgcgcgaattcatcgaggttggtcttgcccaacagcggcatgcccgcggccttgagcttctcgatgacggtggcgtcgtacggcggcacccagccttcgaggatcttggaggctgcggtggtttcgatgcccttggtgacgatcatgtccttgatggcgattggcacgccggcgagttccggcatctgcgccttgtcctcatcggacttggcgtcgaaggcgtcggcctgttcgagggcctggtcggcggagacctttaggaaggccttgacgctcggttcggcggattcgatgaccgcaaggtgggcttcgaccagctcacggctggaaacttccttggccttgatcttggccgccatctcggcggcggaaagcttgacgagttcggtggtgctcatatcactcctgtcccagaatgcgcggtgcgacgaacatgccggcctcggagaccggggcgcctgcggtggcttcggcctgggtcagcggggtctcggggacgtccggacgcaggtaggcttccagcgggaccgggttcgcggtcggttccacgtcgtcggtggcgacttcctggaccttgttgatggattcggcgatgacgttcagatcgccctgcagacgggtgatttcctcgtccgtgagtgcgattcgggccagatcgcccaaatgcacgatttcttctttggtgaaagtaggcatgaccctaacagtaacgcgtctgtgtgacgagcgtgtgccctatttcgtgccccgttcgcaacccggccgcggacgttgccttccatttcgcaacccaattgttggacacctggtcatctttccggtacagcaacgttcgacggcttttcttgccgcgtgccgatggcgcgatcaggcttgcggcgcggcgtgctgggcgatccaggcgtgcatggagaccgcggcggcggcgccggcgttgatggaacggaccgagccgaattgggagatgtagaccacgtcatcggccagttcgagcgctttttcggacaggcccgggccttccgcgccgaaaagcatgaggcagcgtttggggaaatggtaggtttccatgggcaccgcgccgggaatgatgtcgagcgcgatgacgcgggcggcttgcagttctgctattttcgcgtccaaggcttccagttgggccatggtttcgcttgtgttcggggcagtgccggaagcgccgtccgtcgcggctgcggagccacgcatatggaaggcgatggcggcggcttgcgattgggcggcggcgatttcgccggcgatgcgcagtttccaacattcgacaagttccgttatggatggatggttttcgacgtgctggtacagctccgtcatgagcgcgcccttgcgattccatttgtgcgggccgacgatgtgcacgcggcgcgcttggaatgcgttggcggtgcgcaccatggagccgatgttgaaatcgtgggtccagttctccacggcgacttcgaaatcgtggcgcccgcgggagtccaggtcggctttgatggccgcgaccgtccagtagcggtagcggtcgagcacgttgcggcggtcgccttcgtcgagcagggtggagtcgaagcggatgtcgtaattgggggatgacgcatcgtccgggcgtggttcgcctggatgggtttgcgaccacggtcctacgccgacctcgcggaacgtcggttcgccggatgcctgtgcggcaacatcgatgggattgggatcgtgcacgttctccccttcataggaacagcaatacaaatatgtcaaaggcccgcgcatccgtatgcatcatcatgcttgtcatcgcacattcgacgacgtcaacggcagatatgtttgcggtcggtcggcgggaaactcggtgttcagtggagttcggattccttgaacacttcaacgaacggcagttcggattcctccgaagtgaccgggttgatgaccttgatggtcgggtcgaccatgtcgacaccgccgatcagcgaggcgacggccagcactttggcgccttcgttctccaccacggagaagtcgaggctcagctcgttgccgttgcgcagggtgaccagcgatgaggtctgcacatacgatttttcggacagccaggagtcgatcagcaccactcgcttgcccttgatggacggacccttgatggacgggtagacgaagtccatgacgaaaccgtccaaatcctcgccacgggaggcggcggcctgaatcatggcggagaccagcggcacggccgcggcggtcaatgcgccgaccgcgtcgcaatcatcgacggaatagccggcctcttccaaggtgtcgagcaggatatggccgacgatggaggctccacggtgatcgaacagcacggaggagagttccgagaacggcttgtccttcatttcggcctgcagcagcgccttgagctggtcgcgcggttcgagcatggcgaaatcgacggtggattccgtcgaagcggaaacagactggcccgcagcggaatcatgcgtcggaaccggtgtcgtcttgcggaaagtgttctcttcggtcatggttccagcctatcctttcggctcgtcattcaccgtgcggtatgggtgatttatgagcgataaacatggttattcggcgttggtctcgggagcggacaactcgcggatatcccctttttcgggcgcgatcatgtcgacggtgccgatgaccttgctttggtcgacgcgttgcagtttgcgcgcggtgaccagcacgcgcgattcgagcgacgcggcgaacgagttgtatgcgccgaccgttttggtgatggcggaacccagtttggtggctcgctcccccaatactgcaaaccgttcgtacagctctcgggacaggtcgaacagcattttcgcgtcatcggtcaggctttgctgctgccatgcgtatgccacggatttgagcaccgcccatagggtgatcggcgaggtcagcgcgactttctgcgcgaatgcgtcgtccatcagtgtcgggtcggtttccaatgcggcctgcagcaacgattcgttggggatgaacgcgatcacgaaatccggagcatcgctgaacgcgttccagtaggctttgtctcccagggtcttcacatggtctcgtaccgctttggcatgggaatgcagcagctcgttcttgcgggccagctcctccggtgaggcggtgtctggaatctcgcatgcgcgctggtagtcggcgtatggcgctttcgcgtcgatcggaatggttttgccgcccggcatgtggatgatcatatccggccgttgcgtatgtccatcggcgtcggtgaccacaacttgggtgtcgaaatcgacatgttccaacagacccgccgattccacgatgttgcgcagctgcgcctcgccccacgcgccacgcaccttgttgttgcgcaatgccgatgatagggcgctcgtctcgcgatccaatcgcgcctgctgttcgccaagacctttgagctgttcgccgagcgcgcccatctcatgcttgcggccctcttcgatttgcgcgaccttcgtctgcagggcgtcgaggttcttctgcaccggagccagtgcggagagcaccttgctttgctcctgcagtttccgttcgctttcggcttgacgacggttcgcttcttcggcggcacgctgccgttcacgttccacgcgcatttcctcggcacgctgggcctgtgccaattgcgatttgagatacgtcagctgctggccgagcccttccgcctgcgtacggtattgcacaacagccgcgttgagattgctgatgtcctgtttgtccgcctcgatctgcgccttcgcctcgttcaggtcggattccttcgcgccacgggccatatcctgccctttggcacggcccgcgaagaagcccgcagccgctccgagcgcggccacgatcaccagcaatatcactacaaacacaggattatcgaacatacgttcgatggtatcacgtcgtcaggaacacatcaatccacgcatccacattcattcgcaagaccgaccgcatgccacacaaccgtgcactatgctgaaatcagccgaacgcgaaatgcatcagcccaacacgaagggacattatgggattcgatctgtttttggcggccgtgtcgattgtggccgcatccatcgccacctgggcgttgttgcggctgtttccaagctcggacgcacgccaggcgattccgctgcggacggacggcggatttgccgacctatcccacacaaccgacggtggagtgacgatagacggcaaagtgacggtagacggcgaatcgacatccgacatcgacggacaacccaccgaccacctcggcaagcgcctcgtcatcgcgcttatcctgaccattccaacgttcgtcatcacattactggcgctggccaaaatcgccatgccgggctggctgacgaatccgtggccgcacgccatcgtcatcacgccggtcatgttctattgcgcggcgccgattcaccaccgcggcctgcccgcattgcagcggcgacgtccgaacggcgattcgctggtttcgcttggcatggcgattgtttacgcgtacagcctgctgctgtgcgtggtgtcgtggattttcccggccggctcgcgcgatccgtatttcgcgttcgtcggcgtggtcgcgacgctttcgctggctggcacgcttgtccggcaacacgcgatgaccgcgcagcagacggcagaaacagaaaaggcgcaatcggcacagtcaacagaatcaacagaatcggcgcgatctcaagcgaaatcccctgagccaacgcaagaaaaaagcgcggaagaattgctcttccgcgctgtggtaggtcatgcgatccgcgcacgtgtgctgcagatcaccacgtcggtgacgatggtggtcgcggtgtggacgtgcgcgttgtggctggcgttcggcgtgcaaccgaagctggcgatcgccatactgctcggttcgaccgtgctgtcggtcgcaggcctggtattgcaggcttacgaccgacaggtaaccaatcgataatcgtcactcagccgggttcgggacgtcggcggaatcgtccgtcttctcctcgcccatatcctccagctggtccgcggcccacgcggacagctccaggtggtcgccgccggtctggtccaccagcacggtgtcgccgtcgtgcacttcgccggccagcagcatgcgggcaagctggtcgccgacttcggtctgcaccaggcgacgcagcggacgtgcgccgtacgccggatcgtaaccggtgttggcaagccattcgcgcgccgaatcggtcacgtcgagcgtgatgcggcggtcggtcagacgtgcggacacctgcgcgacctgaatgtccacgatgccgccgagctcctcgcgggtcagcgggtggaacatgaccagttcgtccagacggttgatgaactccggcttgaactgcatgtgcacggcgtccatcacggccttcttcttggcgtccgcgtccatgtcgggattgacgaggaactgcgagcccaggttggaggtcatgatcagaatcgtgttcttgaagtccacggtcctgccctggccgtcggtcaggcgaccgtcgtcaagcacctgcagcagcacgtcgaagacttccggattggccttctccacctcgtcgaacagcaccaccgaatacggacggcgacgcacggcttcggtaagctggccaccctcttcgtagccgatgtagcccggcgcggcgccgatcaggcgggacacggaggccttctccatgtattcgctcatgtcgatgcgcaccatggccttctcgtcatcgaacaggaagtcggcgagcgccttggcgagttcggtcttgcccacgccggtggggccgaggaacaggaacgagccggtcggacggttcgggtcggagatgccggcacgcgagcgacgcacggcgtcggaaaccgcttggatggcttccttctggccgatcacgcgcttgccgaggtactcctccatgtgcaggagcttctcgttttcgccctgcataagacggcccacggggatgccggtccagtcggagacgatttcggcgatggagtcggcgtcgacgcggtcggggaccatcggcacgtcggcgttggcattgtcggctccgcccgattccgcctcgttcttctcggcttgggcgatttccttctggatggccgggatttcgccgtagttgatggctgacgatttcgccaggtcgccttcgcgctcgtacttttcggcttgcgtacgcagctcgtcgagcttcttgcgcaggtcgccgatacggttgtggccgttcttttcggcgtcccaacgcgctttcagcccgttgagcttttcgcttttgtcggcgatttcctggttcaaatcggcgagacggtccttggcgctgtcgtccagttccgcttcggccttttccgcggccttgtcgttcttcggattgcccagcaggtacgacttctccatcttgagacggtccacctggcggcgcagttcgtcgatttcctcaggcgaggagtcgagttccatgcgcaggtgcgctgcggcctcgtccaccagatcgatggccttgtccggcagctggcgtccggaaatgtagcggttcgacagggttgccgccgcgaccagcgcgtcgtcgccgatggtcaccttgtggtgggcctcatacttcggcgcgatgccgcgcaggatggcgacggtgtcctccacgctcggctcgccgacgaacacctgctggaaacgacgttcgagcgccggatccttttcgatgttctcacggtattcgtccagtgtggtggcgccgatcaggcgcagttcgccacgggccagcatgggcttgagcatattgcccgcgtccatggagccttcggccgcgcccgcgccgacgatggtgtggatctcgtcgatgaaggtgacgatctgcccgtcggccttcttgatctcctcgagcacgctcttcagacgttcctcgaattcgccacggtacttggaaccagccaccatggagcccaggtcaagcgagataagcttcttgttctgcagggtggtcggcacgtcgccggcgacgatgcgctgcgccaggccttcgacgacggcggttttgccgacgccaggctcgccgatcagcacaggattgttcttggtacggcgggacaggatctggatgacgcggcggatttcctggtcgcggccgatcaccgggtcgagcttgccttccttcgcggcggccgtcaaatcggtggagtacttctccaaagccttgtacgagccttccgcgtcggcgctggtcaccttgcggtcgctgccgcgcgcggcggtcagggcgttacgcagcttatccgcggtaagaccgttcttttccaagatgtccgcgctttgattcggtttcgcggccgcgattgcgaccagcatgaggtcgacggtgacgtactcgtctcccctccgttgcatttctttttcggcttgcgatagcaccgccgacagctgcctgctgacgtccggctgcgttgtggtcgatccgctggcgctcggcagcgattgcatcgcctgatgcacttcggcgctcacgttttgcgcgttgccgcctgccgcttcgatgagcgcgcgggccatgctgttttcctgacgcagcatcgcgtccagcaggtgcagggtgtctacctgcggattgcccagcgccgccgcgttctgaacggcgtccgaaagcgcttcctgcgccatctgcgtgaacttctgttccatatcatcctccatggttcgcgcccggccgcccggccttcgctaccgggccggcgttcggacgcatatgtcgttgtctgatatgctcaaccgacttcatcgccattatattcccaaaacttgagtcccacacactcaactttttgcgtttctcaaaaccgtctttcgacacaggacggcagtcaccgacaatcaccagcgctcaccggcaatcgcaatacatacgaaaaaggcgggcagcaacgtaacgaaatcacgaaacgttgcaaacccgcctaatccaaagtccgccagcaagccgaaaatcagccgcgcaccaccacgttgcgcagatcgccgatgccctcgacgtgcacgatcgcctcgtcacccggatccagatgacccgacgcgttcggcgtacccgtcataatcacatcgcccggcagcagcgtggtgaaactcgtaatcgccgcgatctgctcaggaatgccgtgaatcagattcgccgtggtacccgacgccatcggcacatcctcgccgttgagcgtgaaggaaatcttcgcatccttccaatccacatcgtcacgcgtcacgatccacggacccaacgggcacgccgtatcaaaacccttcgcacgcgtccacgtcggatcaagaccctgcagatcacgcaacgtcacatcattcacgcacgtgaaacccagcacataatccatggcctgctccaccggcacattcttggcgatacgacccatcaccacagccaactccggctcgaaattcatatcattcgaacacagcggaatcacaatcggatcatccggaccaatcaccgacgtgctcggcttggtgaaaatcaccatatcctccggcgcatgcttgatatcggaatgaccggcctcatgcatgaactgcgcatgcgcctcataattcttcgccaaaccgtacaccttcgacggaatcaccggagccagcagacgaatgccgtcaccatccaccggatagcgctcgccggtcggctcgacggcctggccggacagcggatagccgttcaaggccacgagatagtccttgccgtcgttcttgtcggtctgaacgaaggcgtactgcggtacatcattatgcgtaaaacgtgcgattctcatacccgcaagtctacccgctcgccacgcccgccgttctcgacatgcgtcgctttgcggacgatgccgattgctcgcattttttacgatttttgcgattatttgcgatgcagttccgaccgcaacgccgccacctcgcgttccagctcgtcgatgcggcgcacctgctgggcgatgagcaggtcgcgcacgtcacctcccgacagaattggggcttcggctgcgttgcgcggcgcgggcagcgtcgcattgctttgcgtttccgccggttgcgttggctgtaccggctgcgataccgcagatcgagcaacctccgcagattccgccgacggcgccacatccgccgacgccgatggcaccactccaccattcccatcaaccgataccagccggtccgtgcccatacggcaggcaatcttgcgccagcgcgcgaaacaacgttcaatgcgcttatagccgatcagcgatgggtcgagtccggcttcgcggaacagttcgaccggcgattcgcccgcatggtaccggcgcatgcagttgtgtttgaacgattccgtgtaggtgatgcgtcgcgacgtcgcttcggccaccaccggcagcgagcgcagatattcgacttcttccggactgaacgctcccccaccgttgcacatgatgttccctttcggcttggcgtgcggcggctcccttccaccgcacggcagtcgaatggcctccgtcatgccattcccctgttcggcttgcgatacgtgtttgcgatgcaaggccgcaatccgattcgttgttcgcttcgtgttccatcataccggtacgaatggcgtttttccaaccatttcaggcggtacgaaaccctaaatcgcccgtattcgtcacaacaaaagcgggtgaaccgttgatcgctcaacgactcacccgcccgaacaagccccgttgcctgtctgctggcccgctcagaccgccatcggcgtatcggattcgcggaagcgcagcacgagcgccagtccggctccggccattaccagggccgcgatggtgaacaacgcggtgcccattgcgccggtgagcggcagctgcgtgacgttcttcacgttcttgacccagatcaccttgtcgacctcgcttgccagaccaaagttgttggcgccgaccagcttgaaggtcgacttgccggtttcctggttcacagctagttcgacggtgaaggtcggcacgaagttcttcgcgtagccgtccgcgaatccggtttccttcagcgtgtacttgccggacttcaagcccatgattttcacgtcgccggtggtggtttccacatccgcgacagcgccgttctcgttcgcttcggcaaggcggtattcgccatccacaatcttgatgaacttgagcggggtctgcgaaacctcggttccctcgaacacgtggaacttcgctcctgcgagaccattggcatcgcttccgacaccgtacttgtggaaggagaagcccccggtataggagtcgaattcgaccggcgtattccacacctcggtgtcacgggacacggccgccttgttggtaaccttgttgcccatgtcgatgatgtccttgttgaccacggcggtgtaggtgatgaccagctggccgctcttgttggccaagtcgaattccagcacggtggtggtcttgccgtcggctccaacggtcggaacggtcacgtaggtgaacggcatattcgtttccgtgccatccgcggctcgaacaacggccttgaagtccctgttgaccgtcaggcccttggatgccacgtccttcacgaagtacggatacttgtcgtagccttcggccgcgttcggaatatccagcgtgatggtgtaggcgacggtctgcccaatgctcacgccttcagtggtggtaatcgtatcggccgtcttgcccggctggtcgggctcgttctcgttcttggccacaaacatgccgacagcgttgatcttgccctggccggttgccggatcgcccttcactttgaatgtggcggccacgccgttcagcgtggtggcgacgatggcgttggtgcctcggccaccctctccatccacatcggtgatgagataccagccttcttcaagagaaccgatggcagccgtaccgccgttgcctgcaacggttttgtcggcaacgacgccatcgccaaccgccaatgaggccgcgaatgtgcggaaccatgcggcgtcgttatcgccggtcttggttgcggcgaacgcggccggattgctgtcatattcggagggcatgctgacaacggggtccatgttgttgttggcggcggccaccgcgtcggtcacagcagtcacccaatcggcgtcggtgtcgacctgcacggcgtcgccgtccactgtcagcgaggcgaacttgtacgcggagtaggtgtgccccttctgcgaatgccgcacttcgatcgacgcattaccggccgcgtacgctccggcggtgccgagcgccataccgcccagcaacgttgccgccgcggcgattactgcacaaagccttctcgtcttcatgatgagagacctctcttccttggtttggtcggccttgttactgcagccgattggttggttttatgggaagtttcgtatgttgtgttgctctttagttgtgattgaaaattgcgattgccggattgcgatcagagaattgcgattgccgtccggcagttccgtcacggccgtccgcgcccgatcaaagccagtccgacgatgcccgcaagcagcagcaccagtgccgtgacgccggccacgaccagccaggtccgtccttccgatgcaccggacagcggcagcacggccaccgtctctttcacgttggtgaacgaggcttcgtaggtggcggtctgtcccttgtcgaacgcgctccacatgtcggctctggtgatgctgatcggcactgaggtgacgttgcctttcgcgtgatagccggcgatgttgccttccgtgacggtgtagtcgcccgccatcacgccacggaatgtgtactgccattcgccggtaggcagctcgtcatcttcggaaaggtctttgcccagcttcgatgcgccgccctgcatgaaatcgatgcgcaatgtggctccgctcgccggcattccgccttcccaatgtttcgtcacgaccacgttggcggacggcacctgcaatacgggatgctggtaggccgcgcaggcggactgcttgtcgaaggtgtaacagacctgcgccgacgcgttcgatcggaagcccggctttcctgcggaggtcgtgccggtgcccgcgtcgccggtcgcgtcgtagttgatgccgccgtcgaccatattgacccgcgcgtaggcgctgtcggttggcactatgccgtacgagagcgtgtaggtcgcgttgtgcagcagctcgtaatcgccggcgaattcgacgcggatcttgccgttgccggcgtcgctgtaccacaatgtgtaatcacgttccagcactggaggcgtagcccccgaaggcagattcgtcacgttgagcgtcacgccgccggtcacccggtagtaggtcgttccgccgaagttccgcatgccggccatgttccagacaacgccatcgacctgcgcgtattcggacagctcgtcgacgatcgagacgccgctgtaggcgcttcccgtggtgatctccttctggatgtcgtcgaagatcttcgtcaggtcgctcgcgctgttggtggccttgtagtagccgaggttgccgcccgtaccccaattggcttcgtcgtacgcggtggcgttcggatagttgctggacacggcgtgcatgaactggttggctttgtcgttctcccagttgtcgaacgattgccgctccggattggcgccttcgaagatgccgatgctgtagatgagcgtgccggccgatttcatggcgagcgcggtttgcacggcgtcattggcgactcttgtgctaaaagcgctttgcgtggtcggcacaccgtccgcgaagaaaatgacgattttcttcgcgcctggccttgcctgcagcaatgccgtctgcgcggcggccatgcctttgtccgcaggggtcgcgccattggcggacagccaccgatgatttcagagcgacggtatcgctggtcagggaactcaccacgccggatgtctgcccgaattgagcgatggcgattcgcactttgctgttttcgtcctggatggtgtcgttggtggtctcggtggcgtcgatgaagctggtcgccgcttctttcagcgccgtcaaccgcttcggattcgatttgttgcatcttctttggcttccgtccatgcagtagttcatcgatccggacgtgtccagtacgagcaccacttcgattttctccgtggtctcatggctttcgcgggtatccttgcccaccacgttgaggttcagcgtgtatttgccgccgttgttgtatgtgatgcttttcgtgtggtccggctgcggcacggcgacgttacgcgcggcacgcatcacggttttgcgattgaaggtgaagcgatcgcgcatgatgtgttcgtcggcgtcggcatcgtctttggcagcatcattcttgtcgttatcgttgccgttttgagccgacgcggcatccttgtcggcgtcattcttaccgttcttgtcggcatcgtcggcatcttcagcagtgttgccatcgttgtcagcatcgtccgcatcgccggcatggtcgtttcgatcgccgtcttgagccggtgcagcaccatttgcaggtacgtcagcgttctcagccgtcagctgcctaaccgcctgccgttcctgctccttctgctcattcggctgttccgtcttatcgcacggctgccgctgttccggcatcgtctccgacggttgttccggttgcgattgcgactgcagttgcgattgcgtttgttcgttcgatggctgatgcgattcaccgtcgtccgtaaggcattgtgcgtcgtcatcgtccgtcgcggactgtccggcaacatcttgcccggcaatgtcggcaacgtccgatccgactgcgttttcagcatcggattgttgtgtcgattccggctggctcgctgcggattcggcggccacgttgccgccatccgtcaccgtttcgtcggcgaacgcggtcgcgccggctcccgtggtgccggccagcatcgcaatcgtgacaagcaatgcggtgaattttcccatccgcgcgccacaccggcttatgaagccggcaagcgggtccttcatccacttcatgacatgtccatctctcatggcgctgcggcgaattgcctatgcgcctccatgccttgaaccttatggatgaacgttttgaaacccgtcccctccattgatgggttcggggaacgtacggacccgcgaaaatcgcggccttcccccttatcctttacgcggccaggcggaagcgtgccgcatgattcggtgtcggggccgcatcgaccgcacgaccatgcagcacaacagcatgccgcccatcgtgcaaacgatggtcatggcgagcgcgcccagttcggtcgcacgctcgtcgcgcacgtcggccggatctggcgcgggcagcggtattgcgacgcgatgcccggagactagcagccgatgcgtgttgatgccgtatggcgtgcaggtcatcaacgtcagccggtcttcgccgggcacgattttcaaccgtgagacgtcgtccggttcgatcacgctgattcggtccacttcgtatcccagcgtctcgtccatcactttgatgtacatgaaatcgccgtcgtgcagttcgtcgagccgtgtgaacatcaacgatttgaccaggccgcgatgcccggtgaccaccgtatgcgagccagtgccgccgaccggcaggctggtgccgtacagatgccctgcgccgacggcgagcaccggttcggacgtaccatgccgaatcggcagttccacaccgattttgggcaccaataccgtgcccatgatgcctgcgccggaatccagcaggccctgatagttcgcgtccgtgtccgccgcggaaagcccggcaccgccggaatgtgccgaatcgtcggcggtatcagcatctccggaagtgccagccggtctggtagtgaacggatcggccgcctcgcccaataccggctgtccttccacggcaagccgccgattgtatgcgcgcgcccgttccaactcctccatcgccatcggatacggccatccggcaaccgtgcgagccgccgaatcggatgtctcggccaagcgccgcgcggaatgcgcctgcatggcgaacggcaacgacgcgaccaccaccgcgcccacgatcagcagcacggacacgcaccgcaccaatatgaaacgaatccgccgcagcctgcgcgcgcgaaccacatcggcaatgtcaatcgcctcgtaaaacgacggcgttccagcgaacgttccagcagacgttccagcgaacgcaacagttccggcatgaccactgtcggcagctgcaccggcatcagatccgactccggcgccattgccgatgccatcgttatcgtcaccggcatcataggaatcagccgaggcgcccgccacggcaccgaacagccgcatgggcgaacgcagcacctcatgcgcatgcacgtaggaatccgtcctgcgggcgagcagacggacgggtttactcatcaatcgagaggcagaccaaaacatgggtttctccttcgaacacacccatgttcacacccgccatacgaaagcccttgccccctataggagggcttacccctagaaagacaacggtttcaggcacgaaaccggcaattttggcaccaaaccgcgcagcaccccacctaccggcggaacgcagctcagacaagccgtttttcagaggaatgcaagccggacgaatgtaagccagacgaatgcaatccaggcggacaagccccgcaaatccttaaaaaaaacagaaaaagtcaaagaaagcgctcagatgaacgcacgctcaccgaaaatcgcagtgccgacgcgcacgatggtggaaccttcggcgatggccagttccatgtcgccggtcatgcccatcgacagttcccggcaacggtccgtgcccggttcgccggatgcgaggatgaggtcgcgggtcttgcgcaggtgcgagaaaccacggcgaatcaccgtttcgtcgtgcacatgcgcgccgatcgtcatcagtccccgcaattcgatgccgtccaacgtgccgattttctgcgcgatgcggatggcgtgcgccggatcgcaaccggatttcgattcctcgccggattcgttgacttccagcagcacgccgacagtaataccgcgagccacggctctacgtgaaattttttctgccaaatcgattgaatcgaccgattcgatggtgtcgaccaccggcagcactttgccgattttattgctttgcagctggccgatcaggtggaatggaatatgctccgccgcagcatccggcgcggcgcctgcgacgcccagcgaaaacccgcgttccgcgcatcgccgtgccagcccttcggccttcgccgtcacttcctgcggacggttctcgccgatcatgcgcacgccggcatcaatcgcaaccatgatttcgccgatgtcgcgcgtcttcgtggcggccagcaggcgcacggagccggcttcgcgtccggcttgttcctcagctgccgcgatgcggtcgagcacacgatgcacgccgtccgtgatctcacgtgcgcgcgcatcgtcgatcacctcgttggcgaggttcttgtgatccatgtatgcagtcatcgtccacctctcgcaagttcattcgaccgccggtccgcggccggcaccaccgtttccggcatgtcggctgatatttcgataccagtgttaccagaaaaccgccgacaacgtataaagaagcccgcgcgatgacctgaagtgaagcgataaagcggtcataaattcgcgcgggctataaaaccagacggcagtagaagggggacttcaaagactccgtctacgcatttaatgtatcagataaatgcgcgcgaaccgccggaaaaaaccaataaatctgaaaactttttttcagattttatcccccttgcgcagcccctccaccaaacgctccaatttatcgacgcgatcgctcaacaccatcacctggcataccagcgattggatcttgcccaacggcacttccgacatcgcattgtggctgtccacagccgtatcatgcggttccggctcttcggccgccttgcgcatgatgtcctcgtcacgcttccagcgtgcgatattgcgttcgatgcgcttgtgcccgatgaccgatgggctcaatcccgcggaaatgaagatcgcagttggcttctccccctgcagataccgcctcatgcagtcgatttggaattccttcgcatacgtgattctgctgtccgtcaccgcgtcgatcgacggcaatgtacgcaggtattcgatttccgctctgctgaactgtcgcttcgtcatattcgccccttgtaaatccccttttgaccggccataccgataacgcatagaccgaattgccgaaatcaccacccagaataccggatgacgcacaccaccttacgcacaccccaaacgaaacgcgcggcccgtatcaccatgcgctaaatatccttctcacactgtgagatatctcacagcgacggcacgttttcggagcacgccgcaacctcggcatggcacgtcacggcacgtccagcaacgcattccgcaatcgcgtcccacgaaacccaccgttccggccgccgatgcaggtacagttgcaagcatcggcgcgaccggtctccgcatcggcaacaccgaaccgcccgccaacgacaggaaggaaccccgtgccaggtcgtttcgcccccaccccatcaggccgcatgcacatcggcaacatctatgcgatgctcggcgcatggctgtccgcgcgcagccgcggcgacgacatgctgctgcgcatcgaagacatcgacgaaccgcgcgtggtgcccggcgcggccgaactgatgatggacgatctgcattggcttggcttggattgggacggcgatccggtgttccaatccgctcggcacgacctgtaccgtgaggcgctgcattgcttggaaaacctgacgattgacgacgcatacgattcgccgtttgacgagcgcaacgaccacacccccgcagtcggcagcacagccaacaacgcaatcgctggcacaaccccgctgatttacccttgcttctgctcgcgcgccgacatccgcgcagcctccgcaccgcaggaaggcgaccgtttcatggtgtatcccggcacgtgccgccggcttatcgccagcaatccggataccgtccggcggcggctggccaacggcgaccgccattcgctgcgcatcgccatgcccgccgacacaaacccgcacgcaaccgtccaattcgatgacgcagtgttcggccatcaggaattcaatctggcgcacgacgtcggcgataccatcgtgcgccgcgccgacggcctgttctcctaccagctggtggtggtcgcggacgatcttgacatgggcgtcgacgacatcgtgcgcggccgcgacctgctccggtcgaacgccttgcaaatcgccattcgccgagcgcttatcaaggcgggattccgcaaggcgaaaacgcaggcctctgcaccatcgcagcacgcaccacaatcgcaatacaccccatataaccccgaaaacccacggtatgcgcatctgccgcttatcgacaacgcggccggccgcaggctcgccaaacgcgagcgctctttggatatgggggcgctgcgcgcgcatggcgtcaccgcggaacaggttgtcggctattgtgcgtggctgcttggtttgcagggcgattccgcgcataccagtccgcagccgatgagcgccgtcgaggcgttgcaggagttcgattggggtaaggtacgggccgatacggccgaccgcagtatcagccaagacgatttcgacgcgtatttcggcctgtgacaacggctggccgggtctcgccgaattgccgagacgacccggtcagtccggaaaacagcagaaagcagcagaaaataacgggaagcagtcgacgttcagccgatccacagctccgagtcaagcggatattcgttgaccttgcagccgtccaaatgcatggattgctcctgcatcagcggcgccaactggccttcgccggcgcaggtcgtttcgttgtcgatgtgccccagccggtgtccgacctcatggttgatcaccatcgtgcggtatcgcgccaggttgccgccggcggcgagccattgttgcgtgccgccgttccaacggtcgtcgttgacgatcacgttgttgtcgaccctgcaactgtattccaccgagcatgatggcgagaacgacgtcatttccgacgcttgggacagcacgagattgaaatcgcagttgccgtccgtggattggtcgaatatggctccggcgcgtggccatccgtgttcgtcgttgaggatgcggaacgccgcgttgccgaattcgtcggccgaaccgacgtttcctttggttgcgatgcagtaatggtattgcgttaccggtttgccgctgttttgcgcggtttcctgcgctttgttcagaatcgcggttttctcgtcgtcgctcagtgccgccgattgcgcgctcaccgctttggcgacggcctgctcttcctgcgattgtttggtttccggtttggtttttttggccgtcttatgctgattggttttggctgttttcttggctggcttcttggccgacgtcgaatgcgtggcttgtgccgtcgtctgcgtgttcggcgtcatgcggaccagcagtgcgtgcacgctgcaggacgtcatcgatgcgatcagcaggaacagcacgagcaccagcgcggcggccctgcggatgcgaaacgcctcaagccgttcccgttggcccattgtggcgtcggctttcggatcgagcgcacgtatgatacgacgaatccgcttcaatccagcctcccgatatggtgatgtttctctcttcggcaacagtaccagtctcagtcaacatgccgaagccgccgaccgccatgcataccacctatgcgtaaggcccgcgattccggagggaatcacgggccttaccagcatgtcagacgaatgccggcaatcgtcaaagtaatgctcaggcgaacagcaccttgaacaggaacgcgccgacgatcgcgcctgcgatcggggccacgaccggaatccaggcctcgccccagcgggaatcgcccttgttcggaatcggcaggatggcgtgcaggaggcgcggcatgaggtcgcgggcagggttcagaccagggccggtcgggccgcccatggaggtcacgaggccccacacgatgaagccgacgacgatggatgcggcggccgggttcgccttgccccacggcagggacaggcagcacagggcgccgagcaccagcatgaaggtgccgaagaactcgttgaggaagtagttcacgcggtcgttgtgcgcgtcggtggtgcagaaggtgccgaggatggcttcggcatcgtcggtgtccttgtagtgcggcaggtaggtgacgtacacgatgagctggcccgccactgcgccgagcagctgggcgatgatgtacggcaggacctcgttccacgggaacatgccgttgacggcctgcgcgagggtcatggccgggttgatgtgggcgccggagacgccgccgaacatcaggaccgggaacatgacgccgaagccgtagcccatggcgatgttcagccagccggcatggtagcccttggtgtttttcagttccgcgttggcgacagcgccgttgccgaagaccatcagcacggcggtgccgacgaattccgcggcaagcttggtgaagagtgtgtattccactgcagtttcctctattgcttcttctctaacgattcttacgattcgtgcgattcgagatgaattgcgattccgctctgggcggacaacagcgcactaccttactccgcacggaggaagtaacgcggctttgggtggacgcatgtccgaaatacgaaaaagacccaagccattggcttgggtcttgtctgtgccccctcagggattcgaaccctggacacgctgattaagagtcagctgctctaaccaactgagctaaaggggcgttggtcttggcgaggtttttgttctcgctgagcacatagagtaaatatactcagaatcggaaagaacgcaaccttcggcgtgtcgcaatcataaaaccgctattttccaacgttttcagcaaatcgccatctatggtgcacatcgcgtcatacgacgaaaaatgcggcgcgatggcgccctagaatccaagtaatcacattttcttcacattctggcgcaatgcaaccactccgacagtcaacggcacgaacttttccatcacacatttccaccgcggcgagccgaatagcacgcatcatcgtcgagcccgtcgacgcgccagaggccctttataataaggaccatggcgcgtcacaggagtatatgacgcgcatcaagaaggagaaaggcttacctatggcatgcccaaattgcggtcagccgaccatcgaaggcgctaaattctgcgcctcgtgcggctcaccgctcatccaaacgaccgcggcggcaccgcaagcgccggccgcggcggaatccgatgacggcaccatgctgtcttccgcgccgcacatggcaccggccccgcagatgccgaccgctgccgtcccactgcccaatagcgccgcaccggcagctccgcaaaccaccgtcccgcagcccaccacaccgcaaccggcggcgcaagcacagccgaccgctcaggcgcaggcaacgcaaacggtggcaccacaggccgcgccgacgcagcagttccagtatgcgccatccccggccccgcagccggcagcagcgccgcagccaagccagccgacccagcaaatcgcccgtccggcggccgatcccaccatcaccgcgctgaccacaccgcagtccatgaagaccatgggcgccagcctcggcatcggtctcggcgcgagcgtggtgttcgcgctgctcgcatcgatcgtcttcttcatgggcaatgccgcggccagcaacgggcttgccggcattccgggcttttccgacaccgcctccttcctgggcaacaacggtgtgtccggctccggcccgaatttcttccagattctcttcaccgtgatgacgctcggcgttggcggttcgctgaatctcaaaaccagctcccagggcttctcgctgagcaatctcggcattgacgcctcgcacgtcagcgtgacgctgccggtcggactgcccggcgtggcattggcgatcggcgccgcgttcggcgcatatatgctggcacgcaggttcgcgcttcgtttcaagtggacgggcgtcatcagctcgctgatcgtcggcgtgctgtccggcctggtgctgctggtcttcgccgccatcttcccggtgacggtgggtggttcctacagcgactattccgcttccgcgtcgctttccggcgtgtccttccgcacgttctgcatggcgttcctgctgtcggcggccggtgcgctggccggctacgcgttggcacagtatgcgggcgattcgggtaacgtcttctccgccgcttggcgttgggcgcaccgcgctcgtggcttcgtgcgcacgctggtcgaatcgtttgcgatctacggcgtgctgttcctggtgcttggcctggtggcgacgatcgccatgtccgccgcgaaccatctcggcgcaggcggtctgctgctggttccgctgctgttcccggctctgccgcttatgctgatttcgctgtcctcgttcggcggcatcgccttctcgacgtccagctacagcgtccatacgatcacgttgttcaacgtgtcctccctcagccagtatggctggattctgtggatctgcttcgtgctgttcctgcttgccacgttctatatcgcgctgcgtgagaccgcgcgcaatatgtacgacccgtattacgcgggctggcagcatacatggaaggctccggtggccgcgatggtgttctggctggccgcggagttcctgttcacttatttcgcggcgggatacgcctcgtccagcatgtcgatgacgaccccgatgtggtatttcctcgtcgccggcatctggacgttcctgatcgaggtggccgcgatgacgttcggtccgacgctggtggcgtccctgccgggcatgtggcggatcatcgtcggtggcaccgtgcagcagaccccgcagaacgtggtcgattacgtcaagtcctgcgatccgtcctacggcatgaagaagacctctgccacggcgagcggcacgaccgcaacagcgaccatgccgacggcttcggctgccgcacagccggccaatccaactactccggcagctccggccgcatcggtcccccagcccgcgacgccggctgcgccgatgcccgcgcccaccgctcctaccgcaacgcctgtttcacaggccgttccacaaccggtcgccccgacgtccatgcccaatacgacaacgggcaacacggcaacgggtgcggtgccgctgccgcaatcgccagcaggcgcggcttctatgccggtcgcagctccgggggcaggtcagccgctcgacccaaaaactaagaagacgatccttatcagcggcatcgtaattggtgccctgattgtgttgggcattgtctacggtgtgctcaactcgaccgtcttcagcgcgaaatccgtggcgcaaagctatctgacggcgattgccgacggcaagtatgacaaggccaatgacatcgccgatccgcaggtggacaaggaccagctcaagctgctgtccgacaccgtagcgaaggccgacaacgccacgatcgccaacccgcatatcgatagtgtcaaaaccgtcgaaggcgtggccaaggtcaacgtgacgtattcgctgaacggcaagaacgtcaacgattcgctcaccatcaacaaggacgggtcgaagttcctgctgttcccgaattggaagatctcgagcccactgctcaagaccatcaccgtgtcggtgcccaatgccgtggaatcgttgtccgtcaacggtgttgacgtgaccgcgaagaatgcggagaagtcggacagcagcacgtggacgctgcgcgtctacccgggttcgtacaaggtgtcgatcggcaagtcagggtatgtcaccagcggcatcaccatggtgcgcacgaacgcggactccgatgccgccgatctcaagatcatgcctacggccaagcttaaggaggacttgagcaaggccgtgaacgccaagctggacgaatgcgcgaagtccaccgactacgcgccggaaggctgcccgttcggcttcgacctgtacgacgaggactactaccgcaacttcgcgtggtccatcagcgtctatccgaagctgtccgacatcgatctcgattacggcacgttctccacccggcagggcaaggcgaagtgcacgtatgaagagaagaatttcgacgattcgtgggagtctcaggacgacagcacccacttcaccgtcaacggcagcttcagcatcagggatggcaagctcagcgtcacgattgacgatgaggactgatgccggctaaagagcggatataggaaaatcccccgcaccaatcggtacgggggattttcgatgcttaagctcagacgtgtttcagcctgaagtcattcaccgccggtccgtaaggacgtcgagcggtgaatggggcgaaatcactcagcgacgaccttcacgaagaagttggcggtgatttccgggtgcagggcgacggttgccgggaagtcaccggtggtcttgatcggctcaacggtgatgttcttcgggttgacctcaaccttggaggagagcgcgatggcgatcttctctgcggagatgccgccgaacagcttgccggactcggagaccttggcagcgatttcgacggtggagccctcgatgatttccttggcggcaacagcctcttcgcgggtggcgacggccttggccagacgagcgcgcttcatggcctcgatctgggcggcggcacccttggaccaagcgaaggccaggccctgcgggaacaggtagttgcgggcgtagccggacttgacggccacgacgtcacccgggtgacccaggtggttgacggacttggtgagaataaccttagtttcagccattgttcaaacctctctaagatcagcggccggacgtggcgtacggcagcagggccatctcgcgggcgttcttgatagccttggagatctcgcgctgctcctgcacggtgacaccggtgatacgacgggaacgaatcttgccgcgatcggagatgaacttacgcagcagggcgacgtccttgtaatcgatctcggtgaccttggcggccttcagtggattcggcttcttcttaaacggcttgaccggcggctgcggcctcttgcgtgacatcttgatgttctccttaaaatctggaaatactgcgattaagctgcttgtttcgctgttcgcctatattgcggacggggttcggtccgtcagaattccggttcgtcgctgtcgccgccgaattcggaggaacctccgaaggactgggacgcgccgaaggaaccgaaggacgagccggagttatccgagcttgaccacgggtccgaggccggagcggactgtgcgggagcggcgttgaccggagcggaggctccaccctgatatccggcgccgccagcatagctggagccgccctgatatccgccgttgttgccgccgaaaccgccgttgttgttggcgttgttgtagccgccgcgattgccgctgaagcctccgttgccggacgagctttgacgggtcacctgggcggtcgcgtagcgcagggacgggccgatttcgtcgacctgcatctcgatgacggttcgctgggaaccgtcctgcgcctggtaggaacgctgctgcagacggccttgcgcgatgacgcgcatgcccttggacagactctgcgcgcaatgttcggccatgtcgcgccacgcggagcagcgcaggaacagggcctgaccgtcttcgaactggttcgagttacggttccaggtgcgcggagtggaggcgatcgtaaagctggcgacggcggcgccgctgccaatggtacgaatttccggatcggccgtgaggttgcccaccacggtgattacagtttcacctgccatgtcgttacctacttactttgcagcttagaaagcttggtttacttacttgcgaagaatcttcgtacggatgacggattcgttcaggttcagcagacgatcgagttcgtcgctggtggccggctcagcggagtagttgaccacgacgtagttaccttcggtcttgccggcgatttcgtaggcaagcttgcgacggccccagatgtcgatgttctcgacggcaccgccttccttggtgacagtttccagatactgctcggtcagcttcttcagaccgcgctcatccagctcaggatcagcaatgaacatcagttcgtacttatgcgcagacatcacccacctccttcggactatcggccatggaccttccatggcaggagtgtgtatgcgtgctgccttcaggcatcgataagtcgcaatgaacatatggatacgattgatggcaacttgtacaggctaccccgacgccgcgacgtatcgaaacggcgtctgccgggcgcgaaatcacgtgcggaggcaagcaaaaagccccgctcgcaagcggggcttaatcgcaaagaatcgtaataaatcctgaaatatcacgatagccgtatggcaatcgcacgaaatatcaggcgtagatgttgcgcggacgcatgtcttcgggcaggccgttgagcagcgtagaaacggagccggattcgaacacggagcggatgccggcggccagcagcggggccacggacaggacggtcatgttcggcaggcgcttctcttcgggcaccggaacggtgtcggtgagcacgatttcgcgggcgccgcagtcacgcaggcgctccacggccggaccggacagcaggccatgggtggcgacaagcgtcacggacttcgcgccggcgttgttcagcgtgcgcacggcctcgcagatggtgccggcggtgtcgatcatgtcgtcgacgaccacgcagtcgcgtcccttcacgtcgccgatgatgccgtgtgcctcggcatggttcgggcgcgtggtgtcacgggtcttgtggatgaaggcgagcggcagtccgccgagcttggcggcccactgttcggaaaccttgatgcggccggcgtccggggacacgatggtggtgttctccagcggcatgctgttgcgcacgtagtcaagcaggatcggcatggcggtcagatggtcgaccgggccgtcgaagaagccctgctcctgggctgcgtgcaggtcgaccgtcatgatgcggtcggcgccggcggaacggaacaggtcgaacatgaggcgtgcggtgatgggctcgcggccctgatgcttcttgtcctggcgggagtagccgaggaacggcgcgaccacggtgatggaacgtgcggaggcgcgcttcatggcgtccaccatgatgagctgctccatgatccacttgttgatcggctcggtgtgggcctgcatcacgaaggcgtcggcgccacggacgggctcggtgtagcgcacgtacatctcgccgttggcgaaatcgtatgcggtggtctcaagtacgtcggttcccaggtattttgcggtttcctgagcctgctcggggtacgcgcgacccgtcaccagagccagtttcttatccggagtgccttcgagaatcgccgacatgcttgccttcccaattgttcgatatgtgaaaataagccaaactccaatataacaatgcgggtgcccacggcacgcggccgttgcggaagcgtttcaccataccgctccaaactgccgtcggcaacatcaaaaaatccccaaaccatcgacgtagaaggcacataccaacgccaatggtttggggaaaaccggattaccggactattcggcggacgcaaacgcctcgcggatctgcgccgcgttgccgtaggacgcctgcgcgccgtagccggtggccgcgtacgccgaaacgtacgaggcgagttcggcggattcggacagcgccagtccggacgccagacctgccagcacggtgcccatgaaggaatcgccgcagccggtggtgtctactgccttgacccgcaccggagcgatgcgctggatgcgatgctccggatcgtccgcggtgccgtcgagtaccacggaaccgtcgccgccgagcgtcacgatcgcctgttcgaagccgaatccgcgcagttcgtcgagcgcgtgccaccagtcgaacgaatcccaatcgtcgttctccggctcgtcgatgtcgagcagttgcgccatttcatgctcgttgacgagcaggatgtcggatgcttcgatcagttccaccggcagggagggggtgaacggcgagtcgttgagcagcaccttcacgcccgcctcgtggcacatgcgcgcggccgcggtgacggtctcgatcgggctttccaggcacaggcccagcacggaagaccgtaccagcgcctcacgcacggattccacatagtccacagtgacctgcgcgttcgatcccggagagtagacgatggtgttttcgccagttgcgtccacggtgatcacggttgtaccggatgctccaagcacgcggcgaacatgcgtggtgttcacaccagcttcacctagggcgcccagcaggaagtcggcgttggaatcggagcctaccgcgccgaacatttgcacggttgcgccgatgcgcgctgcggcggccgcctggttgccggatttaccgcctggcagcagctgcagcggaccgccggtgatggtctcccccggccctggcagacgctgtgcggtgacggtgtaatccgcattcatcgagccgattacggacactgtgccgtggatgcggtccaatgcagagagaacttcagtcgcactcatctttgacttccttacattaattaaataaaaaggagatttgcggaatattgtttttcagtattcgcaattatcgcaaatctccattgtttatattgaggatgttatgtgcgattatttagccgattcctcggtttccaacgcatggttgccttcgtagatctttttcttgaagacgaagaacacgatcagaccaagcagtgcggtaccggcggcgatcagcagcaggttggaatagttggcggcgtcaccggtagcaccggtgacggaactgcctgcgagggcgttggagccgagcaggctgccgatgatggcaatgccgatggacggagatacgttcatagccagatcgttcatgccgacgccacgaccagattcgtccttctcaatggtgccgagcacggtggaaacgactggagagtacataaggccacagcccgcgtagaacacgcatgcgcacagggtcagcaccacaaaaccggagttcacgcagaatgccgcgccggtccatcccaggaacatgagggtgcctgcggtcacgatgccggccttgatgccgatcttgcggatgatcatgccggagcaggtgcccaccacagcggcgaccacgaaggcccacacgatgtgcagggaaacctgggtggtggtcatgccgtagatgttggtaccaatggcattgaagatcgggctcagtgcgtagttcacgaagtagaacacgaggatcagacagatggcgcgcagccaacgggtgttcttgaagaacgccggggtgatgaacgggttggaggccttgttgatgtagaaggcgaatgccacgaacagcagcagggagaccacgagcatccaccaggacatgtaggagaagaacagggtcaggaacgcggtggcgaagccgaagatcacgaagccgaacgcgtcgaccttctggccgttgccgctcttggacgggagggtcttgagcaggatcggcaggaacaggatggtgacggacgggatcaggaacaggaactgccatgcgatggagctgagcatgccggccgcgaacacgccgatggaagcggacagctggtatgcggcggtgaacaggccgaagaagatgaccttcaggtcgttgcgcaggtatttggtggccaccaccaggaaggcggagcctgccacctgctcgcctgcggtctgcagcactcgagcgatgatcacggtccacaggttcgcggcgaagaaatagttggccacgaaaccgaagatggagccgatgaacagggtcacgaggccgaaggtgacgagcttcttcagggagacgaagtcaccgagggatccatagatgaagcacacgatgccgagcacgatgctggggaacgcggtgatgagggacgcctgcgccggcgcgccgacgtcggcgccgacctgctggaacacgaggttgaatccctgcaggcacagggtgccgagcacgaaggtgatcagcagcggaataagggcgcggacggccatcttgttgctggtcaccggatcgtcgaacgggtcgacgggggcttgcgatggtgcggtgttgactgccgttgcggctgcgttgctggtagacatgtcagttcttctttcgcttcttcgcttggtttttgtgatgttgtgttgcgattatttcgatggtgattccgtggtgagggttgcgcgggaaacgctccgtggaacgttttccgcgcgagccgtcgttcactgcgcttttgcggcgaggccggagatgcgggtcatgaattcgttgaggaacctcggcacgtccacgccgacggcgaccttcatggtcttgaccgggtcgttgaggcgggtttcgtcgccgatggtgcgtccgcgggtcgggccgtccacatcgaccttcatgttgatgtcaagggtggtgacgagggtcgggtccaccgccacgccgacggcgagcggatcatgcagaccgcagccgcccaggtgcggggacgtagtctcgtaggccttgatgtagaagtcggtcatgtcggccaggaacttgccggccttggtgccgagatcgcgccactgctgagtttccttgtaggtgagcagggtctgcagggtcacgtcgaggccgatcatagtggtcggagcgccggaacggaacaggtagtcggcggcttccggatcctgcgaaatgttggcttccatgcaggcgttgcagttaccgggcacggtcagtgcgccacccatgagcacgatctggccgatttcgtctttgatttccggagccttcttcagtgcggcttcgatgttggtcatcgggccggtcggcacgtagacgagatccttgccataggtcttcactgcgtcgatgatgaagtctaccgcggattcggtttcgacggagcggttggaatcagggatttccacgtcgccgatgccgttgtcgccgtggatgaacgcggagattggcagtacttcgaaatggtcggtggtgctggagtgcggcaaaccctgatacaccttgacttccgggtggccgagcaggtcggtcacggccagtgcgttgcgcacaccctgctcgacgagcacattgccgtaggtaccggtgatgccgatcagttcaatctccgggcttcccagagcatacgaaatggcaagcgcgtcatcaacgccggtatcaagatcaagaatcatctttttcatgtgtgtgcctttcctctttgacgggcctgacgacggtccgccaccatacgggtgcgtcgtcagttatgtatcgaacactttctcatttatgttgtgtgttgacaagatttatgataaagcgttttatcaggaacgcaaattcggcactaccatacggcgtgttgcttttatttccagcaatttaaccgtataagaaactccgacgacactttaatcaagatttatcagcgccacccgtctcatcatgatccgcaggtatctaaaaatcctcaatcctacgcgcaggcggcctgcaccagtttcggcgtaagcacttcaacctgcggattagaaagccacgggcgagcatcccctgattccgtaccggacttggcacgaaccgcaacatcaatccgctcacgcaacataccccaacaggcggcggccaaatcagccacgctctgctcaacggtggtcatacgccaaccaagaccgaatcgtttgagaatattgtcgtaaccaatcacctgcatatcctcagtaacgcgcaacccacgttccgccatacgctgacggaaaccaagcgccatcacatcattgcagcagaacacggccgtcgcaccgccatcaataatctgatccgcagcatgatagccactaccgaaacggtaatccccctcaacgcatagcgacgaatcaaaacactcccccgcctgctcgacggcatccacaaacccacgacgacgctccgcagcactcgactccgcagtatcgccagtcacaatgccaatacgagtatgaccaccctccaacagataacgggcagccaaacgaccaccaagataattgtcaaaaccaacggcatcgcaccaaccgcactgcgtcaaacgatcaatcaacaccacagggcacgacacaagcgccacatcctcacgcaaccgctcagcagcatcgccagcgcaggactcgcgcgccggaatcagcatcacaccgtccaccccacgagccggaaggcgctgcaacaactcatgctcggtaacacgcgaatcatcggaattggccacaatcagcgaatacccctgcgcggcgcactcatcctccacgtacttggcaagcgccgcgaaaaacaagttctcaatatcaggcacgatcagcgcaaccagctgggactgcttggtcaccaagcttcgcgcgctctgattcggcacgtaattcagtttctttgccgcgtcggcaatggccttgcgcttctcctcggacacgcgagccggtcgattattcaacaccagcgaaaccgtcgtcacagacacccccgcggcagcggccacatccttcagtgtcgcacgatacgccatcaaacccccttaaaacgtttctccctccagcataaatgccatgcgatcctgacgcgcccagcatcgcaatcacaaacaaattcctttcacagcaaaataatccgcattatttccagcggtaaatcgtttctcggaagtgttttttgtatactcgcaacgttttgtctgaaatgagagccacacgagaagagaggaaccaccatgcagccaaccatgcagaaaaacaatgtgaaacagcgcaagaccatcgccatcatcgccatgatcgcagtagctgccatcgcgctcgcagccgtcgccatcatcgcagtctccaacaagcgcgaaatgacacaagccgccagcgacacctgcgcgttgaatgcgaaggcgctcgccacgcatcaggagagctttgaagaagcgcaacaagaagctgaagaagcagcgaaactcaccgtgaatgacgtggcggacggcaccacgctcgaaaccctgaaggatgcgatcacactggccaaagccgtggaaagcgcgccagcatgccccgcaagcggcaatgccagcgacttcaccaaagcgacggacgacattcgcaaatacgccgacaacctgcgcaacatcaccaacgaactcgacgcggccgccaagtcggtggtcgccagccaagaactcagactcgagtccgccgagtaagtcaggtaagccgccccgacggttagcgccgacgtcagcgccaaaccctacgtttaacggggccaaagtcatccaagtctgcaacttcgcccccattacaagcattttcgcaccacatcgggcttatatatggcagattcgacaggtcgcccggagacatttcgcttatatatggcaggtcattccggaaagaccgcagttagagggtacaaaattaccccctaactagcttgtttcaaaaacagactgccatacataggcgagatgcctccgtacaaaccccaaaatctgccatacataagcgagatatgcccatgaattacgcatctatgctgtgcaggcgcgacctcgcgtcgcttagaggcttgacaacaccttccatttgacaaaagttatcagttgccacgcaccaggagacgcaataggggccgcaccttcgaggtgcggccgtttttcatccttcaccaaacctggatctgcaactaaggctagcgaacaaaatgtacgccaaaccacacatccattccccggcgaggttgactcgcctgcaacgcgtctcctcgatcaccgcttaccgaacttcaattgtccggcttgcgccacacgaaccgaattcttactggccttgggcgcggtagcgggcttcggtggcggctttggcgggctcccaccaggcgcggttggcagcataccaagcgatggtcgcctgcaaaccggcttcgaaatcggtatgcacgggccgccagccgagttcggtacgcagcttattggaatcgatcgcgtaacgtcgatcatgcccaggacggtcacgcacccagtcgaatgcgtcctccgcacaccccataagccgcagaatcatacgcattacggcaatgttgctcatttcgccgtccgcgccgatcagatacgtttcgccgatgcgaccgcgcgtcagaatcgcccataccgccgaagagtggtcttccgtatgaatccagtcgcgcacgttctcgccggtgccgtacagtttcggccgcgcgccttccagaatggatgtgatctgtcgtggaatgaatttttccacatgctggtatggcccgtaattattggaacagttggaaatggtggcgcgcaggccgtatgtgcgcgtccacgcgcgcaccagatggtcggacgcggctttcgacgcgctgtacgggcttgacgggcggtacggcgagttttcagtgaatttgcatggatcgtcgagcgcgaggtcgccgtacacttcgtcggtgctgatgtggtggaatcgcacgtcatgcttacgggcggcttcaagcaaatggaacgtgccttccacgtttgttgtgatgaaaggttcaggattggcgatggaattgtcgttgtgcgattcggccgcgaaatgcacgatcgcgtcatgaccaggcacgatacgttccagtaacgcaacatcgcaaatatcaccttgcacaagtttgacttgcgattgcggaagaccggcgatattctgcggatttccggcataggtcagtttatcgagcacggttatgcgcacgtcaggatggttacgtgccacatagcgcacgaaattggctccgataaacccgcagccgccggtcacgatgatattgcgcggcttgaaaatctcactactcacaatttcagagtaccggcaggattgcatagccataaagcgattccacaaactggcttatatatggcagatttggaaggctgaccgttgagctagcggccaaaatgcacggtaagacgtcacttccacaaccgcaccatccgcaccgaccagcacacggttccccgatgcgatcacggttcttctagagctaaaccgatccgatgaggaaatgaaacagcactcatgattctcccacacagtttcgccccacctcaacatactagtttctgaaaaccgacaagttgtcatttttgtcagaaactacacttatccccattatcaattgcaacatgcgtgcatttgacataaaatacacattaattgcacgcaaaattagggcaggtgattcaggtgggcaatattaccattcgtatgaacgacgatttgaaagctcgagtcaaccagacactcgacgccataggcatgaatttcaacacttacgtaaccatggcaagcatccagctcgtaaatcagcaacgcctgccttttgacacttccgtgcgcgccgcggagccaaacgagcagaccaagcgagccatgctcgaagccgaggccaaggaacgcggtatcctcccagacgacgcggccaccttcaacagcgcgcaagacgccatcacctggctgcacaacaatcacggctgaacaggcaaaacgccatgattaccatcaaattcgaccaacaatttcagatcgacttcaaacgcatctcacgacggatacctcaaatcgtcacggaactcgaatatgtgatcgaagccattgaggagtacggacgcgttccggaatcatataatcctcacatgcttgatcgcccacgaggaatctactcgggatatgcagaattccatcttgccgaagggaaaatggatgtgttagtgatctactcggagcgatcggaagcgtcaacaatccgattcattcgcctgggatcccacgacgaactgtttgacggtccgttgctttagatgaaaccatcgtaggctccaacgagattcagccatcgatttccgcctaataaaactttttctcaacatatcgagcttatatatggcagatttggaaggctgaccggagacatctcgcctatgtatggcagtccattccgggaaaaccgcagttagagggtacacaattaccctctaaccggtctgtcacaaaaaacgagctgccacatataagcgaaatacgtccggacaaacgccagaatctaccatatataagaccacctgtcagaaatctaattcaagccgatcagcaaaccgccattacattacccttgatttggtgtataattaagcatgttattacccttgattcggtgtatttacggcggtgagacatggagactttcgaacgaaaagcgtacgaaaaactggcttcctggaaggattcttcccaaggaagcacagccctgctcatcgagggcgcgcggcgcgtcgggaaaagcaccatcgcggaggaattcggacgacggaactatgcatcgtatatgctcgtcgacttctcaaaagcccccgatgacgtgctgggctacttcgtcgacctgcgcaacgacctcgacgcgttcttcatgtacctgtcatccttctacggagtggaactacacaggagggatagcctcatcattttcgacgaggtgcagctgtacccgaaggcccgcgaggccatcaagcagctggtggctgacgggcgttacgactacatcgagacaggctcgctcgtctctatccgcgagaacgtcaaggacatcctcattccatcagaggaggagtcgatccgcctgaatcccatggatttcgatgaattcctctgggctttgggagaaaagccactgtccacgctcatcgcggactcgttcaagaagcgcaggccgctccccgattcgctgcacaggaaagccatgcggctgttccgtgaatacatgctggtcggaggcatgccccaagctgtgtcgaaatacgtcgagacccatgatttcagcaaagtcgacaacgtcaaacggaacatcctccgactgtacaggcaggacatctccaagcatggcggcagcgaccggatacgcatcacgcgcatctccgacaacctggtgggccagctttccaagaaagagaagaagttcaacatcacatcgctgggaaaggaagcgaagacccgcgattacgaggacgccttcttctggctttccgacgcgttcatcaccaacgactgcttcaattccactgatccgagcgtggggctaagcattagcgaggaccgttcgacggtcaaatgctacgccgccgatacagggcttctcactacgctcgccctggccgactcggaacagaccggaagcaacctgtaccgggacatcctcctagaacgcatcgagatcaacgagggcatgctcgcggagaacgtcgtcgcacagcttctccgggccaacgggcaccggctgttcttctattcgcgcagcgatcgcgacgacccgtcgaaccgcatggagatcgacttcctcatcgtcgaaccgtacgagaacgcggcaatgaagtacagggtcagccccatcgaggtcaagtcatcgaaacgttaccgcacggtctcgttagacaaattcaaggcaaaattcgataagaaggtcggcaccaaatacgtgctgcatccgaaaccgctggtcgtggaaaatgacgtggtcaagctgctgatctacatggcaggactgctgtagaaggcttcatgcagacagcgctttttggtgcactaccagcgaatgacgcccaacacttgcgcgcacatatgttgtccaccttgaacatcagatctgtttgccgcttgctgcccatcacccagttaaccgtccagctacccttcagacatctactagacacccgttcgtccacagctgaacactagaatatatccggtttaattgtacagagctcctaattataaggggctatcttgttgaaggatgcgacgatgcctattttctcgcctgaccgtcatgctcacgttccttcatacgtaaaacttactaagcaaccgattgcgggcggaacatatcgccctcttgcggacaacgaagacagcaacgcctgtgctccatccaccctttcaggccaccacagttcaaggctgtatacgcagaagccggcaattcacgccacctccgacaacacaagcgttttcattcccaaagtcgatgcgccccatctgccaaaaacagctaacgacgagtccattgacgaagccgcgaacgacagtacccattcagcccccccatctgctgaaattcaactcgcgcaagctaacgagcatcctctgatgcaggctatcgaggtctgcaaacaatccgtacacactacggcaaaagcactctccaccgcaggacatgcagttgcaaaagccgccaaaaccaccggccacgccatccataccgccgccacagcggtaaagaccgcatggcaaactttcaccaatttcaaagctattcaactcatcatcaagttcttccagagaacgcatgccctgtggaagaaacgcatgaggttctcatacgcgttctacgccatcgtgttcaccctattgacttccgccgaagtcatcttccttcagtggggagtgtatagcgaaccaacgtacgataaaggcgatgaagttgatcagacaactaaaatcctgaacagtgtcgcagggcaagtcaccaaatttgtcagccagatttggcttgaacaaaagtatcagtttctccttaatttcattggcatagggcttatttaccttgcattagtttttgtattaaatcgcttttggatagcgaccgttattttcggtgccgctatgactgcctacggcgtagcgaacagcatcaagatgggacttcgtaacgaacctattctcccttcagatcttagctttgtatcaaatggcaatggcggaaacctcctttctttcataccgaaagaccagcaagctctcgttaatggagcaatcaccgtattaatctggttctcctgtgcttgtcttcttcttttcgttcttgatggaagacgccgctttattcactgctcttggaaacacccctcttcgaatgctaaaaatataattgggacatcatctcgcgcacttgctgcaattctcagcgtcgttcttctggtttcctacacatggaatctcaatattcctggagcttggtcctatactctggcaaccaacttaggatacaagcctgtcccgtggaatacctatgaagatgccaaatcaaacggcccagccactacatttcaaagtctcgtaagagttaaggcaatggataagccgagcgggtacagtaaaaaaactatggaagagatagccgctcgctatactaaagaagcaaataaaattaatacatcacgggcaaacatcctcacagatagcactgtgattctcattttatccgagtctttttctgatcccctgcgtgttcctggcatctcctttgatatcgatccgatgcctaacattcgagctttgaaagatgtcaccacctcaggacttatgctatcgccaggctatggtggcggcacagctaacatcgagtaccagtctctaactggaatgaatctcgctaattttaacgatcagcttatttctccttatcaacaacttgtgcccagtcaaaaaaacgtatacaccttcaatcaaatttggaatgatgcatgccaggtgcaatgctcatacgcttttcatccctatttgaagaatttttatcttcgagattcgaattataaaaaattcggtttcaaatacttccgtacaatcgacagcaaaccggcgttgaaatatcaggatcacattgacgctggctatgttagcgacgcatcggcatatcaaaatgtgatcgaccagcttaatcaatctgacggagaatcccagtttattcagttggtaaccatgcaaaaccatttgccatacggggactactacaccaacaatgaatttaaagaggcagatacttcaacaggtctcgatgaaaacgaagaagttcagattgatacttatgcaaaaggcatcagttataccgatcaggccacgaccacattcctcgatcaactaaatatgatagaacagccaattactgtcattttctacggagaccatcttccaggcatctacgcaccagcagcaaagtacaaagaaaatcaactcactttacacgaaagcgattatttcatatggtctaactcttcttcttcgagcgctggttcaaagctatcgcccgaagaaagcgattactcgtcttcgaacttctttatggctagcgccgcagaacacatggatgcgaaagtcacgcctttcctagctctgcttacagaagtacatcaatctgtaccagcagtcagcagattcgcctcgaccgatgccgattggggtactgggtcaactagctatctggattcttctggacagttaataaaaaagaagactctatcatcagaagcaaaacatctactggaggattatcgtctggtccagtatgaccagaccgcaggaaaaggatatctcagcgaaaactggtttaatcgagtgccataaaaaggaaacggcagccagaatgctctggaggaaaaacaagaacgtatactaatgttatgtctgcactagaagaaaaccaagaatgggaagcagttaatagaattgttttcccaactacagacgcggaaagcacgcttcctctctacgttgtcaattggacaccgtcgcacccagatccagctctatttgatgcccgagaatctctggaaaaagtcgctttctcaagtttaagtaaacgacagctctcggggaccctcaggaatgggatcttttcagcacaagaagcaagtaaaacagagcttcccgcgggatcagttttaattaagtctcgaacttcaattgagttggcagcaggtcagcacgtctcattgtgcactttctttaacgcatttccggcaagttactggcaacgctggaccaaagttaccaatgtacgttttattgcgaaagttggcggcgtcggacgtatcgtcgtcacgaaatcatcagcccgaggaatcccctctactgttaccacaattcctgtggcacaagaagatgaattcgtcgaagccgacattagcttatctggcttcatggatggcggattcatttgggctgatatggaatctgcttcgaatgactctttgaccgttactgacgcccaatggcaggtccccacccaagaaaggcgcgcccctcacaactcgtctctttcaattgcgatcaccacattcaatagaccgtcatactgtttgaatcaacttcaaaccattgccgccgaaaaaaacttacgagatcatttagatacaatttattgcgtcgatcaaggaacagatcgagtacaagatcaacccgattttcagcaaacgagagaactcctagggcaacagctaacatatatcctgcaagacaatttaggcggatctggcggtttctcacgagggatgtatgaaacagtcaaagcccagaaaagtgcatatgttttacttcttgatgatgacgcaatcaccgaacctgaagctatattaagagctcttcagttttccgattacgctaccagaccagttctcgttggtggtggaatgctgcatctggacaataggactgtactgtactcttccggcgagcgctttgacgcaagctctgcaatgccagcaccagccaccggcacacattacaatcatgattttgctgtaaatccgctaagggatactcctgaactgcataagagaatcaatcctgacttcaacggctggtggttatgcctcatccccacggaagtcttgaagaaaattggtctttccatgccggttttcattaaatatgacgatgtggaattcggcttgcgtgccaaagaaaacaacattccgactatatgtcttcccggtgtcgccgtatggcaccaagcatggcatgataaggatatttccagaacttgggaggagtatttcgctcaaaggaatcgttggctctgcactcttatgcatttccccgtaccaagcaaaaagtttgctttccgaatgctttatgaagatgctcatctaggaacaaagcttctttattctgccatgaagttaaaccatatggcacttcgcgatttgaccgaggggccggaatatatcgtcagatgcctcccgcagaaactagcagaagttcgtaaagcaagagaaggtttcacagatagtcttgttctgcataatctcgacgattttccagcggcacttgcagactatgaaccgacattcattccgtcggatcccaaaaccgtcacgaagatagggctcaaatccgttatttctgcattcttttctcaatcgagcggaataaaagacgctcaccctcaagtgtccatcatgtccaaggatgcaatctggccggcttttaacaaaatatcgtcggcacttgtaactactgctgacggaaacggagcggcctggttcaagcgagacagcaagttgtaccgcaaggagcttttccgctgcgtacatctagcggccaatatcttgaagcagtggaacaagctttctcgcctttatcgagagagcgatttctgcagcataaatacttggcaacgaattttcaatcactcaagtaaataaaagcagtgagtggcggtacatcagagtcggttctcgacgtgtaccgccactcgctgtttttactttgcagctacttgtggataatcaactctcggattgaacttccacgcttcaatcatctttttgtacatcttttttctcaacggctttgcaacatttccatgtcgcataccgttccagaccagcgcgcaaaaacgcaaatactgataaaaaccttcatgatgcaagtggtaggaagcctcattacgaactccgtaagagaacttccaagcgtttttctcatcaatcatggagaagttaactccccgattaacacccatatcatggagaacgacactgtcaagtacctgcacgccagggcaagacttcgttatacgaagcgtgtactcagcatcatcgaaccaaatgaagtattccttatacggcaagccaaaagcttccatcacccaacgtgggattaagacagaaacgaaggagcatcgggaaaccatgacaatgtcaagtcctttagctttcaaccttccccaatcccatgtcggaatcggattattcatttccgagatagttccgtcaataaacttcaccatggaacaggcaaaaggtacgtcaggccccagctccgctactgcgctatcgtacccgagcaccaacttatctagagcatcaggttccggataaccgtcatcatcaaaaatccaagcgtaatcagcgcccagctcataggagcgacgcatgccagcagaaaagccgcctgcaccaccctcatttttctcaagcgtgacaatatccaactgcatggaatccgacaaggcgaatcgctgagcatactcctgcaaatactccgcagttccatccgttgcagcattgttaacaatgaccaacatctgcggaagtctcgtctgcgattcaagcgaagccaaaacttttttcaacttctcaagacggttatatgttacgacaacggccgctacttttctcacgtctgttgacatcagtcgtgccactccttcaacatcttcttgaaatatgcctcagcagattcaagctcagagaacttctgaagacgagcaagttcactctcccaaagcttcctgcgatcttcttcattattcaaaatatgagatagtgcggattttgcgtcatgtacaaagtttgaagtcatacgacggcacaaaccctttggaggaattaatgtttcttgagaaccaacattagctgagagaacgggcactccagcactgatggcttcaatactcgttaaggtgatgccttcgttaattgacgagatgagtaacgcatccgcatcccgatatgtctgagcgacaggagcatccagcgctcggcgctctatgactttttccaacccatatcgtttgatcatcatgtcggaaaaagcatccatatctccatttccttgcatgatgaaacgaacttttccaggataagccgcattcacagctttagccgcaagaatgaacgcctcaggtcgtttctgacgaaccatgcgaccaatgtaagccacagtaaaaggctttgtcttatcccgctctttaaaacttggagtcttagcatcagcagtcaggccgaccaaaggagcatctacgactttctctggagcaatctgatgatcgttgattaaccaatgttcgagttggggggaaatgacatggtgcaggtcaatccactcatcatgagctacggattctttggggaacccaccgtggaagtaatactccacaatatgcaatgaatcgacgattctagtctgagggaaatgcgtcttaacccaccatgcgttgtcgtacatccactggcaatgatggatcaaaataccagcaatatcaaactgttcgaacaaagcacgcaatactggagaatcccccggacgctcttgtaccggcatagtcataggcaacaaaatagcatcatcaaatgccggatcagcaatccatggctggtgcccatcacgatcagtgataacaattgggatgaagcctgcatcacgaacaagcttcactgtctccagagcccaacgttccgccccgccagcttggaaccaatgcatagcaacaactaccgctcgaggacttccttttggagccctccccggtgtaacttcaacccacggatgttgaacttttccagctttattaacattatccgcatttcgagccatggtcattgggattgacttttttccaacatgctcacgcatcgtacgtttagcatctcggaatacgtcgaaggctgtaggcatggatgattccaaagtattataaagtttgacagccttactgttgactggatgatttagctcgacatctctatccgtcgcatcatccggcgtcaacaagatatgacggacattatgatcaagaatctggtcatcacctgcaaaatagtggggagagaaatcagtttgatttctgctgacagaagtagccttaaaaaccataaatggaacaagccccatttgttcggtaatgttcccactaagagtagaggtatctgttaaacgcggatactgccatttttcgcccatatacagcttatatgtcagagttctccccggttggatcagtgaattataatccaccgcaccataaaccagcctttgcatacgcttgctaagattttctatctgcgcagcgtccttctcatcaacctggaaaaaatgtcgcatagaaaacagcgtaacccactttcatctccactaacgccatcttttttattctcacacataatgtccggttactgtaactacatcagaaaagccgcctgcctcagattccaaagaagtatgctgttaagcaacatactcgaaaggggagaagaacgcctctacttcaaagaaccaataaaaataggggcgtgatcaaacatacattcgatcacgcccctatcaactcatctaatttgtttgatctgcaacgcattatcatttagtaatgcataatcacgagtacgctcatcacgaaccgcaaagatacagcagttgtcatcattcgtgaatgcaaccatgtcggtaaggtttggattctctgcattctgggtacgtagcgacacgacaagcttgaattccccattattaaatagtttcaatggcacttcaaacttcaccttacaatgaccatgctgattcagcttaatcacattggctccagtatcgtaagtgactccgccacgccttatgtcgtgcatagcaattgcaagataatacgaatttggctcgtcatactggtattccacttcaaactggaacgtatcatcgcacgtcagaatctgcttactaagcgcattaatccgcaacattgggactctggcgttcaaacctgttggatattcatccgctttgtcattatccgtgtcacgtttatcagcacgcatattttccaaggtatagcggttagcaacatcatctttgtttccgttaacgatgacttcgccatctttaataagaaccgccttattgcagtattttttcactgcgcccatatcatgcgtcactaaaataacggtctttgtcggatcttttttcaccttcgcgaaatagttatcgcacttacgctggaatgcttcatcaccgacagcaagaacctcatccagaaccagaatgtcgcccttagcttggatagccacagaaaacgctaaacgaacttgcataccagatgaatagttcttcagcttctgatccatgaattcttcaagctcagcaaactcgacgatgtcgtcgtacatgtcctcgatttcttcacgggtaaaaccaagcaaagctccgttgaggaaaacattctctcgaccggtcaactcaggattaaagccgaccccaagctcgatgaaaggaacgagcttaccttttacctcaatacttccggaatctggaacatatatgccggaaatcagtttcaacaacgttgacttgccgctgccgttacggcctacaattccaaagaagtcaccttggtggacttcaaaattgatgtctcgaagcacatgctgttctttgtaacctttgatgcctctggtccagttaatgaaagcctgcttcaaaccgctcgcttgctctgttggaagtttgaagtatttgccaacatgctcaactgaaaggacaaccggacgattcacttccttgatggaagcagattgagactgtgtatcaagcatcacatgacctccgcgaatttacgattatgcttccggaacacatgcacgcccagcgcaagcaacaggaacgcgagaataacaggaatgaccgcaatcaaaggattccctacaagcgtccacacggtaggctgcgtttctggggcaatcagattgtgccgaatatcttgaatcgtctgcgcaatcggattgaggagctgtattttcgcaataatcaagccccatttgcccaaagaatcgttatccatcaccatggaaagcggataaataaccggaatcgaatagaacagtacctgctgcagaacttcccataggtgagcgatatcgcggaaatagacatacatcgttgccatcaatagagctgcgcccagtgccaacacatacaattcaatgaaatttaagggcaatagcaaaactctccaagtgaactgaatcttggagaagatggcaaaaatcacaaccactaaaagattgatacccaaactgatcaatgcaccaatagtggcagagacaaccacgatatagttcgggaaatgtatcttccgaagcaagtcaccacgatccacaaccgctctcaaaccagttgctgtggcttctccgaaaaactgccacgtactaattccaagtagcagaacaactggatacgtcggtgttccgtccgacatgcgtaagaacttcgcaaacactacgtacatcacgcaaaaaagcatcaatggacgcagaacggaccatgcaactccaagaaacgacccctgatagcggagcttaaaatccgtcttgacaagctctttcaacactaccagcgaatagtggtagcgctcttgaatcctcttcacaaatgtattcacgactgacaagtctatcgacttacgaccccaagataatgcccctaccgttttcttcgcaaaatcctcagcacacaatcaaccatccgcttgtcttgctacgataaatacaccacacaagacacaggacctgataaaaagtgaacacatcatccaataagagaaatgtatcaattgagcttcttcggataatcgccatgctgctgattgtcgcatgccatttcatcattcatttcaactggaatacacatcattatgatttaatgctcatccaggaaccaggatggacgaacgctctcaagttcttgattgtgcaatatggacaagttggcgtatctatcttctttataatctccggctatttcctagtagataagacttttaaaagaagacgtattttcaaaacatggtttcagatgttttgttactcaagcgggttttttataacacttttaatcattggggtattctataaatacccgacagtcatacaaccgctaatgcaagggagcgagctattccgaactatagccgctagctttttcccattcttctatgggagctactggttcatcagcgcatacatactcatgcttctatgtgcgccgttcatcaattccttatgtcaatcactttccaagcgcgctaatctaagtctgctcgttcttttttcttttttaagcatccagatcctcatctttggacgagtttccaactggaacaatttgacatatgccattttcggttatctgattggcgcttttatcaaaaagaacaatacagagatttcgaagcgaatgcgcacagcccccatgcttgcaggcatcgtcttcatgacactgttaatgctgctatttaattatttcgcatcgtcatcatcacccattagcagtgcactcggctggacaaaccaaattcacaacggaatagtactattcccagtagcgataggagcattcgtcttcatcatcatctcacgcattaatttcgacaaaatcccaaaacttatcagtaaaacgatagtaggaatttcttccacgacgtttggaatctatcttcttcatgagaacatcttcggattcaggatcttgtgggaatatgtgtctaaattttgctatgcgcccgacagtttgctactcagaattgtctcagcattcttcatcgtcatcatcgcgttcttagttctgagctgcattgcaaaaataatagatactctattcgtccatcccctcacggacaagatactctcatactttataaaatgatttttaggagaggtggttgctcacctctcctaaaaatctctcctaaaaatcagcttagaaaactgaaccaagattcaatcacacgatatagagcatcattggagctgcttaaacatccatatctcccatctgataggagattcagatagctcaggaatacacccactaacgtcagtaggacaaatacgttgaggcagagattcgaaatcctttcgctcgaatatttctttgcataaagagtcactgtggatatcgcaccaattatcaacaaccagccgaattcactgtaatatcttgtcgagataccgacaatctcagtatcaaccaccaaaagaacagcagcaaagccaacgaaaaagaggttaattccccaaataccacttgctttagcctcttttcttactgtgcaaagcaaaaatgcaaacaaggctgccggaacaaaggcaaaaaaaccaccaaagttaggttccataatggtttgccccatgaagccagacggcacatctaactgtttcataaatggataatttgggcttatgttaattggctgaaaaagatacatccacaatccccatggaatcctcgacaaggcataggatcgatgaaccatatcaaaaccagttagattatacgtagcgccaaaatcaaagaaagaatcaaaccggacataattatacgccatagttaccccacccacaagaagaaaaggcactataacggcaagcgtgttccaaatacctctcacagagaagaaaaacctctctctgatttcagaccagaatatcggaaaagcgacgaagaccaccagaacaaattgaggtctacatccaagatttaatgctatacaaatcgcaccaatcaaaagatgtagcttagacagctcaccagtatcttttcttgcattaatccataagccaagtcctgttaaagttaaaaccaaagaaaaaaggattggtaaagaatagatcatcggataaaacgcttgtgtcaggacaccgcttccagtcacgagcaagagcaaggacactaggaatagcccgaaggatggcttgatgtattttttcatgaatgagtacaaaaagaataccgccgcaagcactaaaaatactgtcatcaaagcgacagcataatcagtcctcaaatcatgtccagttatgagtttaaaggggacgaagagcgacaatgcaggcaatgctccaaaatagcaataatattttccattataaaaagcataatcccagtacgtaggctcgccggttttgaaagataattgcgctctcgcagatgcatcataaggatttgtcatcttctgcatccattccggaacagggagatccaaataagtatggccatttatgatggcattagctaagtaattatactgattctcatcgcctataaaagctccgccgtttaattcacgagttgaatcaaaatactgagcgggatgaataagctgtgtcacagcaagtaaaaccatgatttgtatgaagacaaagatggataaaagaattttctgccgccgtactttcaaatctagattccactgatacatgtcacgagatgtccaaaagcagaacaccaaataggagacaagcagcattatgaggaacctcaaaaaagagaacgaaaaaggtctctgagcatttatggaaacagagtcaataacaatcttgtcgccttcttgcatattcagctttagtctaagacccgtaacttttcccgcaggatgaatccggatataatgcgattcagttaagttctcggaaacatgtgccgtgccaagagatatatacccgttagtattaccttcgtcaagcacatatggactcaaactatacgtcccgccaactacggcatcggaatcactagcgaccagatcaatatccaaattgtctatctctgtaggcccatctacagcatactcaatgtacggagtgtcggaaccagtaaccctatactcatttccctctcttacaatattgttcagagaggataccgaaatctgctgctgctcaggaaatgtcagagcctcccaaaaagcgaaattgaaaagaaaagtttcaaggagaaaaaccaccgctaacggaataaaaaactttaatctgacttgccttttacaatccacacttactccttattaaactcattcaccagacacaaaccaacgaattcgaacgcaaagatcttgttcttcacagaacgcccctgtcgtatccgcgcaatttatcatcctagcttatatcacgtctcacgccattctctcataacctttgccaagaagacagcaatcataattgaatccgcaggacgcctcgctccgaccacagcaaaggctatagtgttctacatgctcgagaagaatacaagcccctccgttgccgtactgctgccttgctataacgaggaagtcaccatcggcaaggtagtgcgtgatttcaagacagcattgccgagcgccgacatttacgtgtatagcaacaactccaccgaccgcacggcggaaatcgcggccagcgagggcgcaatcgtccgcaaggaaccgcgccaaggcaaaggcaacgtgattcgcgccatgttcgaagacattgacgccgacgtgtacgtcatggcggatggtgacgacacctatcccgcggacgcagcccccgccatggtggataaggttctcgaaggctacgacatggtgatcggcgatcgactgagctccacctacttccaagagaacaagcgtccgttccacaacttcggcaaccgtctcgtgcgtgattccatcaatggcttgttccacgcgaacgtcaccgatatcatgaccggctaccgcgccttctcgttcacgttcgtcaaaacctatccggtattgtcacgcggcttcgaagtagaaaccgagatgaccattcactcgttaaacaacaatctacgtctgttcgagatgccgattcagtaccgcgaccgtccggaaggttccgtcagcaagcttgacaccgtgggcgacggcatcaaggtgatgagcaccatcttccgcatgattcgcgaatacaagccactgccgttcttcggcggacttggcgtcatcctcggtatcatcggcatcgtgctgtgcggcagcgtgaccgtggacttctggcacactggcgtggtggcgcgattccccacgcttatcggcgcggtcatgctcgtcattgccggactgctattgttcatcaccggcatcatcctcgatgtcatggccaagaacgaccgcaaagcattcattattgacgccaatcaattcgccatgatgcggcgccagaaatagcacagattccaaatatggctgagagcaaaaagatacttgtcctcagccatattttattggttaatctgtctgctatttcacccacttttgggcattcgtgccatttgcggtatacagctgcacattggcaccattcgaggtagaagcacccgaaacatcaaggactttgttttccgcgagcgccgactggaacgtgtatgagccatcggagtttttgatggcgatccacttctgggcgtatgtgccgttcgaggcatattgctgcgcgttggcaccgttggcagtgctcgcaccataaacgtccagagctttgtctgaattcgcactggttagtgtcacataaccgttgtcatcgtgcgatactctccatctttgagcattcgtgccattcccagtccaaagttgcacattggcgcagtccgaacgggacgcaccatatacgtccatcttcatgttcgtctttagctttgaaccgaaagaatatgtgccatcaggcaaatcctgcctatgctttgccgcctgctcattcaaacggtcgcgcatggttttagacttctcgatgatccattgctgcgcagcggtatcatttggcgaatacagctgcaatgcgacgttggacgaataattcgcgcccggtacatcaatagctttattcgcgttcactgacatcaatgagattttcccatcgccatagttgcgaacagtccattgttgagcaaccgtaccgttactgtcatattgctgtagaaccgcaccattggacgcagaagcgccataaacatccagtaccttgccggaattcacattgacaatgttgtaggttccattgccaatctgctggaaatggaatttctgtgcgttcgttccattagccgcatacagctgaattctagcgctgtttgcggtagaagctcctggcacatcaaatacaagattggatttccctgcggatttgatgttcaccgcagcatttaccggtacactaacttcgctagaggaaacaacgaatcgttgagcctgagtaccgtttggcgcataaagacgaatcgcagtaccgttagaggtgttgccaccgctcaaatcaagcacccaattacccaaagccgactgcagataatatcccgcaccggaatcacgaatgaaccaccgctgtgcattcgttccattaattgcatactgttgcaccacagaattattacccgctgccgctcctcgaacatccaaggctttatcggaattcacattggtaatcacatagctgccatctgattgtttagagaatttaaattgttgcgctttggacccattgccggagtagagctgaatagtcgtggaatcagacgtgctggcgcctgaaatatccacgctagaagccaccttgaaacgtacattgatgaaataattaccatcaggaacactcaccacaggcatcttgcgcacatcaatgacggacgagtcctgggcataattcttgctgccaaaagcattcatgtccacggaaccactgataccgttgatatggccggaactggtgtattgccagccgcggtcgttggcaccgaaggcgttgtatcccatttgagcaccatactgggccacccaacgggtctttgcgtagatgttcgaattgttcaacgggccttgcaggtagctcgtatacgaatacacaccgagattcttgtatccggcggactgcagtgcgccataccaggcgtcggccataccgctataaacattcggattggtcggcggggtatgaccagcccacgtccacttctccaggtcataatacacagggtatttcagatcgttcgggctcacgcccatctggcggagtttggcagccacatcattgccttccgcacgtgcgcagttcgcatcgtatgcatacgaataccagtagatgccaaaaggaataccaagacgtttgcattcgttgatgttacgttgcgctttggcatcggcatagttgccccagccatagcccaaacgaatgattgcgccttccacgccgtcggctttcgccttggcccaatcgacgtcaccctgccatgaggaaacatcaatcacgcccttggcctgttgaacgaacaggttgttcctataatcgaaaaacgcctttgttccgttgtaggttccccagtgtgctccgtattcgttgctctcgaatttagtgagccggacagtcgagccacccttcaaggacgactgctccgcagactgtttcacaggttgttccacagcatctttcacatccgaggcactcaccggaatgaatgattcgccatccgttttggccagtggatcaggttgctgcgattgcgtgccgaccagctgagcgtccgtcacggtttcgccggtctcaatgttctgtacatcaccttccggcgtaaccgcaaggttctccgaaaccacagtggaatcgtccgaaatgttttcgcttaccgtttccggcagcgtcgcgttcggattgtccggcatgctgtttgacgaattctgcgcatcatccacagttgcggcaaaagaacttggcgcatcctcaatcgcaatatcctgcatggcgtaagccggcaccacggcaacggaaaccgtcattgcaaccacggaagcggtggtcgcaatcttcatcaagcttttcggcgatatcatcgtcagcctctctcacaaaacgcatttcacgcgttgacgcaattgcacacgcaaaacttaagtgtattctgagatgtccccacttaaaataaagcagctggattccagaccaaacttcacatttaccgaatatgccacaacatgaagtgctggcattcggaagtggaacgggtaacataccttatgtattgtcatttgggaacagaggaccttgtcggaccacctccaatagacaacatcaaaacggtatcgcggactcctggagggaagcatggcacggcacgaaaggcagccaaataaagctgacagtcaagcaagtaacgtccgcaagccccgaacgttcagcagtaccgcgaccgtcgggaccagcaaatccaacaattccgtcaatgccaccaatcgtgacgaaaagcttagaacaaaagcaccggggacttcctaccgaacggctcccgaagatccattccaaatcgccatatcgcaaggcgtgcaagatggcgacacttgggtacataaccatgtcaagaacttgattcgccgttccatcatcgtagccgttatcgtcgttgcggtatgcattgtggtcttcggcgtcatgggcgtgagaacatcgcagaaaatgcgcgaactgaatgccattaacgactgcagagacgcggttgccgccatgaacgcttcatattccaaggatttccagctcaagggaaagattgtcgacgcattttccagcatggattcctcatatgatctggaaaagctcagcaccttgtatcaggaagaagtcaaatcgccgaaggcgcttgactgcaaagccgacccgtccggaaccaccagcaaagccaacaccgaacgagccgcatatgacaaacaggccagaaccttcgagcgggcgttgacaaagaacgaggcaaatcagaattgaatacgaaacgattggcaagaacggcacttgccgttatcgtaaccgtaggaatagtcgttgccatcatcgtcgggtgcggccccaaatggggcaacggttcagcattgcaccaaaacgaagaaaccgcacagtcctcaaattcgcaggtttccgtgactttgccttcctactacatggaaaatatggtcttccagcgcaatcagccgttagtggtcaaaggaaccgtcaaattcgcgcatgccagcaaacagattgacgcatcgaaactatccgcaacacttgcccaaggcaagatgactgcgagcgccactgcgaaaatcgcaaaaaatggttcgtttacttgcacgctgaacgcacagaaagcaagcctcgagtcgtattcgttacaggtgaagtacgacggcaaagtcgtaacggaactggcgaaagtgtatgtgggcgacgtgttcgtggcggccggccaatcgaacatggaactcaactatacgcagtattacccggagaacagcgccaattttggcaacggaatcatcaaagagaccgatcttccaaaaccactcgtcgacaagaacgtgaaattcgttatcgcagatcatgatgtgaagaacacggattttccgctggccaacgtcaacctgaacgctggcgcgtggctgaatgcggattccacgaactcactgcatttgagctacttgacacagcagttcgcacttcagctgcgcgcgaagcatcctaacgtgccggtcggcatcatccagaccgcgtggggcggcacgcctatacgcagacatgtgcgcggcggagatatctacgcgaaccatattgcaccgttgaaagattttcatgtggcaggtgtgctctggtaccaaggatgcgacgatgcgatgaattttgcgaccgccacggagtatgagtcgcagatgaccgcgctgatcaaccagtaccgtaccgtattcggacgcaagaatctgccgttcctatacgtgcaactcgcgcgatggacgaactatcagtacacacagaacgtacgtgaagcgcagcggaccacgcttggcaacaccaacctgcacgattcgtcaaacgtggcgatgacggtttcccttgacacagacaagggcacatccgcgctaatccatccgctcggcaaagatattctcggggcgcgcatggccgcgcaatatctcgccatggaagacggcaccaccgtacccaacggaccgcttatcgaacatgcccggcacactgcgaacggcgcaatcgccttgtctttccggaacggcaccgcaagcaggctgaaagccatgcagccgaactattcgaaaaccgcgagcgcaatcgcaccaaactataagagcgctccgaaagcgaccccgttaagcggtatcagcaatatcgccgctcccaccactacggcattgcaggggtttgaggtcgccaattattccggtcaatggcaggcggtcaatgccactatcaggggcaatcaggtgttgctcaccgcagccgatggttcaatactgaacgatctcaacgccatgagccaggtacgttacctgttcagtggcaatccgaagtgcgcgagcatgctgtacaacggctttaatctgccggctagcccattcatcactattgtcgagtgatctttgttgggggccgccgctagataaaccaatacgggcgggataagtacgggcggtctaagccgttacttggcctgcttggccatgtcttgagcaggctgttccggcttctggtttggattctggtttcccgcttaaactatgaagactgctgcagcatcgcagaaactagacaaatgtcatttttccaccggtttatttaggcacattcccctcctactatggcatacggaatgaacgcgagcgcacaatcacagatcgaatgcaaacgtgcgcaggagaggaaccaccatgaggaatcgtattgcagcagctgcagcggcgggaatattaaccatcgacatggccgccttgccttccgcggcttcggccagtgaagtcgcaccgtctacggacggattggccggcagcaccaccatcagcgggcagatcgaccaggatatggccgtgtgcaccgacaaaacgtgcgatgccgtacagcatgtgcgcaaaaccaaccagcagatcaagtcggacatcgataccgccaggcagcacgccgagcagctgcatcagaacgcgcacgaggacgccgacgcgcttcgccagtacggcgagcaggcctggaagaactaccaggaggaccgcgaggatataaagaatgcgattgacggcgcggtcaagcgcggtcaggagcgtcacgacactctgcatcaggatatgcaggatacgcagacccatctgaaccagatgcatgccgacatgaaagagactcacgacgaactcaagacgaggcatgacgcgtttgcggcgagcagccaccagtggcatcagtcgttcatcgcggcgttgaaggacgcgaactccaagacgggtcagcagggcggctcatccgttgctaccggcacgcatggcatcacggctggaacgaatgccggtacgaccgctactggagccaacggcaccactggcactgtgcgcacggctgccgacactggcacgaatggtgccgcaactggattcgtcgcagcgtccggcgatcaaaccgccgcgtccaccggcgcgctgaccaagtcggaatatgggcagcttgcgcagaccggcatcggcatttcccttgcctgcgcagccattctgctgcttgccggccttgcctacgccatgaagacgttcgtgcagtataagcgcgaaaccagcgaagactgagccggttcgctgccggacagcgtttgcttcatcgactcatgaaaaacggtctcgaatatatcgggaccgttttttcatgcgcgtttttcatatgtgcttttcatctgctatacgcattgttgcgattcaattggaatgacgtagtacagcgacgtacaatgcagcgcgaagcgcgcgtaccgtgcgtgaaccgcgtgtatgtccagtattcccactgatttgttacgttggccgttccgatcagtccactggtcaattcgcataatggggagcactgctggcgattcgcggcgacggcgtatcgccattccccgccgtccgtccggtactacccgcgctccccgcatcgccggccttttcagcattgccgatgttggttctacgcaacgaccccgcggccaacgatcggatggatcgcctgcgctgcgcctgttccgtctgcgaagcggactgaattgcgggaaaagcgcccgttacaggacgaatacgaccggttgcggtcggaataaagcttggtggcaaaacctgcgttgtgatggcgcttatggatgccatctgcggctgctgcgtattatcaggaccatccacagcgtctttttctttcacggtttgcgattcttccgcacgattcacgtcatcattcgcatcctcgcccgtttgcaaggcagacccagcttcgctctgcttttcttgtttttcctgcttttcctgcggagcggcctgcacatcactctgcaatacgattggcgatgaattcgaacggcgtcgggcaagcgccgccagagagtcacgagtatcagcatcgcgttggtcagtctgctggctgccggcagccgtcttgtcaaccatcgtcgtgcttctttctctcaacgtcacgatttcgagcgtaacgtagcgcagcgcaaaagtgcgcgtaaaacgacgatgtacgcaactcccccaccgaatcgcaatcaaatatcgacatatgagggcaaacaatcccattattgagaccacagactggcaccaataagccgcagcatggcaatcagggactttcctggatgccggcccgtacacgcgagacttgcgatacgggacgattcaaaaaccgaggccaacgaaagaagcattcggagggaatctggaaggaaccggaaaacggagtggaaaagaaggaaccccagaaaccgaatgattccaacggttttcggggttccaatccgggcggagaatacgagattcgaactcgtgaggctgttacaccaacacgctttccaagcgtgcgccatagaccactaggcgaattctccaattattcaacgcttcccggtgtctatccgtgaaacgcaacttgactagaatacaacaggagcagcaaaaagccaaatcggcgtgtcgcactgctggtttgcagagttgggcatacgtgtcaaggttgtgcaacaggtatgagcgatcggctgcctttactacggatacttcttatttcgcacactgtagatgctatattgccgccgatggaatccaataggcaacgggattcggtaagcatgggaaaagatacgaaaaaagggttcctggagcgacgcccgccgggaagcccggaaaaagagcatgaaaaaaggggcctcccgggagccaaaggctcgaccgggaggcccaacatgtgaagcggcggcgtgctactctcccacaccctctcgagtgcagtaccatcgccgcctaaacccgaaaaaaatacatgactaaacacgaaacaccgacttgacgaaatacatcaccgtcgacctgccaggattcgagaccccgggcgtaaacacgtccggcgtcatgcttgatcgccacgggacggtatccgttctccaacagcatgaggttgagcagttgccggccggtcctgccgttgccgtccatgaatggatggatgttttcgaacatcgtatggaacgccgcggccttgagcaacgggtgcgcgtcgcttccgttcagcccgtcgatcagggcttgcaggtcgtcatggatctccaacgggtcggcggtcttgacgcgggtcgcggtgattctcgccagatatccgtaaggacggaacgtgccgcgtgcgaacggctgcaggtccaatgcggtcacctcgtggatcctttggatcagttccgggtcgagttcacgtctttcggaggcgtattcgcggacgtaggccatgccgtcggcgacgccgcgcgccgcgaacacgaaacgtgccggggaatccgagggcacgaattcgccttccaatacgagggatgtgtcctgaagagtcagggtcgatccttcgatggcgtttgaattgtaggtgtatctcacgagccagtcgcggtcgtaatcggataatgccatggtttcgacgccatccaacggttccagtgagagggcgtgggcgcgcagggtgtcgatgaggtccagtcgggtggtgatttccggaatccgttcaagtttggcgaggatgccgggcatgtcgtcgatatgttgacgcagttgcgtgttgggcatggtttctccttctttggcttattttaccgaaccgtggtggatctgggtcctgagagagaaacggccggaacagggtcgggaaaccgtcatgtggttttccgtcgtcctgttccggccgcctgtttgtttggaggggggaattgggtcagcgcatgccgtggcgtgcggtcacgtccatgcggcggcgtttcaggtcgagcgtggcggcgcccatgccggcgaacgcgacgacggcgaggatgatgccgttcgtatccgcgccggtggatgccatgaccttgtcggccttggcggccgcttcgaccgtggcctgctgggcggcgttcagactggtctggccggcattgtcgtcatgcttcgggttggcggcctgctgggccgtcttgagcgctgccttcgcggtctcgtagtcgctcttggcctgggcttcgaccgtctgggcctgcttgaggtcggcctgcgccttggcgaggatcgtcttggcctggtcgagcgcgtcctgtgcttccttgaccttggcctgcgcggtcttgacggcgtccgtgtccttcgcgtcgctcttggccttggcgaggcgtgcctgcgcgtcggtcaacgcctgctgcgcgttcctgaccgcggtttcggcgtccgtttcggcctgcttggccttgtcggcctcgttcctggcggcgtcgtatgcctgggtcttcgcgtccaggtcggcctgcgcggcggcgagggcctgggtcctggccgcgaggtccgtcttggcgttttcgaggtccttgacctgttgggcggccttgtcgctttccttcttggcctgctcgtacgcggtctgggcttgggcgagttcgtccttcgcggtctgcttggcctgctgggcctggtcggcttcgctcttggcctggtcgtatgcggtctgggccttggcgagggcgttcttcgcgtcggtcagcacgtcgagacgcgtgtcggcggcggtcttgtcctgttcggcctgcttgacgtccgtgttggccttgtcgagcgcggcctgggcttgggtgagacgcgtctgcgcctgctcgtcggcggatttcgcctggtcgtacgcggtctgcttggtctggcggtcggtttcggcggtggtgaggctggcctgcgcctgctcgtcggcggatttcgcctgctcgtacgcggtctgcgtttctgcggccttgcgggtcgcgtcggcgagcagctgcgtggtgcgtgcggattcgtcttgcgtgtcctgcaggtaggaggtggccttgtcgagcgtgaggacggcggacgcgtgggccgtgttggccttgtcgagcgcggtcttggcggcctcgacctgcttcaacgcgtcctcgtacgtggattgcgcggatttgatctggttgacgtaagcttcgaccttcgcgcggtacacgctggcatcgaacgtggtgtcgttcgcgttgtaggagttccagtcgttatagaactcctgggaggatgcgccgtatccgtaatcgccggtgtcgtagccgctgtaggccatgccagtgacgctgtattccgggtcgatgatgttgaggtagtggccgaccttgtagtacaggtccggatacttcgagaacacgtcgtacggggacaggtccgcgaggtccggatagtcgccggacttcacggccgcgtcgtagatcgctttctcgttcgtgtaccagccgatgtacgggtcccagtccgaagttccccatgcgaggttctcgccgacgttgtcgtactggtagttgtggttgtggtgttcctcaccgggctgtgcggcgtagttggcctggaccatggccatggccaaagcggtctcggacaccttcaacggttccaggccgttctcctcgcgcagcctgttgcactcgtcgatcatgtcgagggccttgagcaggttgtcgaggctggtcgcgtcgtccttcgcgccgatgtgcgtgtattccaggtactgggacacgctggagtcggtcagatacttgtacgcctgttcggccttgttggtcttgaaccatccggccgcgccctcggcctgcgccttcgcggcctcgtccgcggcctgcttcgcggcgtccgcagcggcctgcgccttgtcgtacgcgtccttcgcggccgcatactcgtccttggtcctgtcggcctgcgcctgcgcgtccctcacggcctggtcggccttgtcgagcgcggcctgcgccttgtcgttggcggcctgggcgtccttcacggccttcgcgtccgtgttcttcgcggcggtggccttgtccagggcggcggaggtcttgtcggccttctcctgggcggcgtccttcatgtcgttcgccttgtcgagcgcggccttcgcctggtcggcctgggtgcgggtcttgtcggcctcggatttcgcggtggcctcggcgacggtggcttgggcctgcgcggtcttagcgtccttcacggcctggtcggcctgcttggccttgtcctgcgcctcctggatcttggcgggatcgttcgcgtcgcccgcgatgcgggtggcctcgtcgagcaggctcttcgcctggtcggccttctgctgggcctgctgcgcggcggcggatgcctggtcggccttcgtctgggctttgccgagcgcgtcctgcttcgcggcggtggtctggtcgagcttggtcttgtcggtcgagtcgaccttccgctgcgcgtccttcacggcctgttcggcctgttccttggccttggcggcgtcgtcacggatggactggctgtcgttcatggccttcttgatggtctcggcgttcttcgcgctctggtcggccttgtccttcgcggcggcgaggctgtcgtgggccttgtcgaggttggtctgggcctggttgacgcccgtctgggcggcggccacgttcggatcgttgttgatggtggtctcgacctgctgttgcgcctgctgcacgttctgctgggcctgctgcacgccggtctgggcctgctggacctgctgctgggcctgctgggtgccggccgtggcctggtcgaggctggtcttcgcgtccgtgacggcctgctgggcggcggcgacctggtcctgctggggctgcgtggtcggctgggccgcggcctggtcgacggcctgctgggcctgctcgacggcctgctgggcctgttcgaccggggtggtcgcggtctcgtcggccattgccggcgcggcgatggtgcccgcgacggccacggatgcgacggccgttgcgaaagccttcttgttcataattctccctccaatgccatgccccgtatcggggtcgtggctccaatggaaacatccctgcgacgtttccgacaaccattccacgtgcccccaatccgatatcggcgccatcggcgtgtcgcggtctcggaggcatatggcgcgcatacccaccagtctacccccgcatgaggcggtgccggcgtgtgggcgtctaccgtttcatgccgtggcgtccgtacgggcggacgcgtggcctggactcgaccatcgccacgggcatgcccgcgagcaatgccacaccggacacgagcagcgggcgcgtgtcacggccggtggtcctgggcgcgtcctcgggatagggcgcgtcgtccggcatgctcacgcgttcgcccgtgacgagcagccgatacgtgttcaggaagatcggagtgcaggtgaccagcgtcaccaggtcgcgtcccggctggatgcgcacgtcgcgcagatcgtccggatcgaccttgcggatgcgttcgaccttgtaggcgagggtctgggctgcgaccctcacgtagaacacgtcacccttcctcaattcggtgagccgagtgaacagggccttgtcggccactcccgtatgtccggtgatcacactgtgggtgctttgcccgccgacgggcaggctggtgccgtgaaggtgtcccgcaccgttctccaacgcgtacgtgtcggccccgtggcggacgggcaggtccacgccgatggacgggatctcgacggtcgccatgatcccgtcgccgaaatccagcaggttctggtattccgtgtccgatttgaacccgaaatcaccatcgatggtcccgtccttgccggacgtctctccgatgacatgcggcgtggcggcgagcctccggttgtactcgcgggccttggcgaccatgcgcgcgtaatgttcggccgaatggtcgtccttcgcggccagggcggacgattcggccgccctgcgggccgctccggcctgttccacgccaagccaagcgaacgtgcccacacccgacaggcagaacacgaccgtgacggcgatgagcgcgcggaacacgcgtctcgaatgccgtgcgcgtatgcggcgcaggcgccgcatacgacgtccctctgaagcacgttcgccctcgatgatccaatcccaatccataacgtccatacctttgccacgatccgttccacgaatatcgacggggatgggcaacgggaagggccggcgtccggaccattccgcccacgtccgaatggagttggtggatggccgtccgccggcccttccgtcaccgggttccggtcactcgtcgtccggcatgccgtggccgttcatgcgtctggtgagcatgacggtcgagccgatgccgaacatgagcagcaagacgccgcccgcgatggcgatcggcaggccgataccgcccgtttcgacgaagttctcgtgaacctcctgccattgcgcgtacagggtgatgtccttgtcctgcaatgcgaccttgctgccgtccttatagacgacgtccgccttaccgggtttagtgccccaacccttgaacacgtacttgtcgcgtttgaacgacttggacgtgtcaccgggaatggtcacatccgaatactgccagccggtcgtgttcggatgcgaaccggtgccgccgttcgcgttgtagatcacgttggcctgcaaccgctgccagtgcgcgtacacggtgacgctgccggtcagcggggtgttccagtcgtacaggttggagccgtcctgcggggtcgtgtaccagccgaggaatctgtagcccttgatcttcgacacgtcgcccgcctgccagccggaaccatccgccgcggccgtgttgtagggcacggacacggacgccggggtggacggcatctcgccggtccacgtactcggcttgttcgtgtcgtaggtgaggaccgggttgccgacccacaccgcgtacacggtcatgccgccctcgaccatcgtgacctcggcctgcgcctgggtcgcgttccggtcctggttccaacccagctgggtgtggcccggacgcgacagcatgctggaatcccagcagtcgtcgtccttcgccatggtcgccaacgtgatcctctggccggccggatagtagacctggcagccggacaccacatccgtgctctggtcgacggtcctcacggtcacgctaccatcctcgtgggtggtggtccgctgcacgaggtccgacaccttgccgtcggtctccgatttcgcgggctgagtggtgttagcggccgtgtcggacgggatggaaccggtggcatcctgcgcgttcttgttgtaggtgagacggtaggcgatggtcgaatcgactggctggaagccggactggcgggcctgtcccgaggcgaccgaccagcggacgtggaaggacgagccggtgaatgtggcgccgacgtaatgtttcattccatgcgcgtcggcattgttcttgttctcgtccgtggtgccggcccagctgttcgtgccgaaccgggcgaggtgagcgtcggagcgcacgtacgcgccatcgaagccgctgacgagttcgacgccctcgttgtatccgctggtgccgccgtcaaggtcggtgaatccggtcgcgccacgcagcccctgcggcgtggatccgtcgtccagcaggaaatcgacggtcacatccatgtatgggcgggacgagggatgcttgtcccacttgccatacgacgctctgaactcgtgcttcgattcgaggtacaccagggagccgaggttctggtcgttcacggtgattttggcgttgagccaccgttgcgtgccggaggagtcgcgccactgtcccacatggtgcaggaccaggctcgcgccattcttgttcggctggtacatggtggccagaattccggcatatgcctggttctcctccgtgggatcccagttcttcttgacagtgaagccgttcacgtcggtgatctggtccgcggtgacaccatcggttgtggagaacttgaaatcgccgtactgggccggagcgatgtcgcccttcttcaagtcatgcaccgtcagaccggaagcggtcctgtccgccacggtcctcacgcttccggtcgtcctggtcttggcctgcttgacggtgttcgcggtcgtgtcggacgggacttggccgtaggcgtcgttcgcgttcttgtcataggagagcttgtaggcgagcttgaactgcacgtcgtcgatcagattgccggagatgccgtcgatggaacccaacgccttgaacgtgaacctgctgacgttctgaccggcgggaaccacgaccgaaccctggaacgtgtcccacgagccgagccagccatccgtgttcggagcgttcaccgtggtggacttctcacccagcctgttgccccggtcggacgcgatgcgggtcatctccaccggctgctcgtggccgggcgcgccgacgaggatctggatcttctcattggagttgatggtcccgttcctgtgcgcgtaccggagcttcaccgtgtacacggtcggataatcgtgcgcggtgtcgatgtcctgatacaggtacgtgcccgcctgcgaggcggtgatctccgcgtacatgttgtcgttcgcacgggagcgttggatctcgacgatgccgccgcgcccgtcgaccctggtgtcggtctggttggatttccagccgaacttgttcgcgtcgaacccgttgaggtgcacccactgcttggacgcctcgcccttgccgttcaacggtccgctgacctccacgtcgccgtgggccgggtcgatgttggcgaaattgtatttcgcgctcatcttcgactgggtgacgatgttccgccaatcatggtcgaagtcgctgttgacgagctgcttcggcaggccgttggcggcgtaggtcgccacatcgtcggatgcgagacgcacgctgccattggtcttcgtcttggcctgcttgacggtgttcgcggccgtgtccgacgggacggaaccggatgcgtcaccggaattggtcttggcgggctgggtggtgttctccttgccgcgctggttcgacggaacctcacctgttgcgtcagtggagtttttgtcgtaagagagcttgtaggcgcgggcgaaggtcacgtcgtcgagcaggttgcctttggtggggtcgaggtagttgacggccttgaatccgaaccgtgtggtggtctgcccgtcagggatcacgtagtagccctcgtaggtctcccactggtcggcatgatgccaacggttctcgttcgtgaccttggtggcgatggtcgtggacttctcacccaccttgtcaccggccttgccgttcgcggtcacgcgggtcatctcgatgggcgtgccgttgatgacgacctgcatcttatccacgttgtccttgcacaggctggcgtgcttcaaccggatcttatacagggtgccgggaatggtggcaaggtcctgatagatggtgcggccggtctcggacgcgaccatttccgcgtaggtgttgccatccgtgctgtcctgttggagttcgaccgcgttggcacggtccttcagaccgccttggtcctggccgcccttctggtcggtcctccaagcgaacctggacgagtcgaaaccgtcccagtccacccaggcggtaccggtgtccgactcggcgtgccttgcgttgcggatgtactgtccgttgttcggatcgacactcgtatacgcgcttgccatgtcgtaacgggcgctgatggtcttccacccaccgtcgggaaggtattcgaagtcgctgtttatcaggtggtccgacagtttcgacgtgtcggaggcaagcctgattttgccgttggtcttggtcttggcgggctgggtggtgttctccttgccgcgctggttcgacggaacctgaccggacgcatcggccgagttcttgtcataagtaagcttgtacgccttggtgaacatgacgtcgtcgatgaagttgccgcgcgtggagtcgcgtccctgggcgctcttgaacgtgaatcgggtcacggtcgaggtggcgacgtacacgccggtgtacgtctcccattcggcctggccgcccttggtcgcaatggtcttggacgtcacgccggtccggtcgccgcggccattggacgtggtgcgggtggcgtcctgcgccgtctccctgcctggactgcctatcatgacctgcatggagtcgacgtgggatgcgtcctcgctcgcgtgcttcaggctccaccggtacatgacgcccggcgtggtggcgatgtcctggtagatgtactcgtccggggtttcggcgatgatctccgcgaaacggttcattttctggccgttgttgttcggcttgttgccgatctgcacgcaatgctggagcttctggtgcgagttcggctgctggtcgggacgcaggccctcctggctgctgtcccagccgaatttggaccggtcccagtcggggataggcatgaacttgcgtccgtaatccacgtagaagccgccccagccggtcgtcggatccacgtcgcagctgttcttgccgtccgggcaggccggatagtcgaacgagccgttgacgatatggtccggcaggcttgacttggccgtggccttgtcctggctcgtcgaggattggatttcggcctgctggccggcgtcggactgcgcgccggcgtccgtggtggaatcggcgtccgtggagtcgtcgtccggattgtctgccgtgtcctcggaggtctcgttcccgccgtcgtccgcgagcttcacgacgcttttcgtggttccggccgcgccggtcacgtcgaccgcgtttgccgtgccggtcaggccggtgcccaacgccgcggcggccgtgagaccggcgagaagtcttgtaaggaatcccatttccctcatcctttgtgattcatatgtgagttccgtattttttggaagagggccgggatcgtgcggctgacaggagaaaaggccgcacgatcccggcctctggatccccggcccctcgctttcgaggccggggacgattcggaaaaatcaggcgatggccggaccgtcgcccaggttctcgtggcggactcggtaggcggcgaagccggacgcggtggccacaaggatgatcgcgaacgcgccgaccagcatgacggccatggtggtcgcgccggtctgcggcagctgggtgatgttgtcgatgttcttcaccacggcggtcggggtggtggtcttgccgtccgcgttgttgaccgtgccggtgagtcccggctggtccttgccggtgatggtcacgtggccgtcgtcggtgatcttgagggtgaagctcggcttgacgaagctgaagtagccggtcggcacctgggtctccttcacggtgtacgtgccggcgcccagacgggtgaagttgatcacgccggacgcgttcgtggagaattcggtggctttggactcatccgtggtgaacgtccactggttcgaacccgtgttccacacgtaccactggttcaggctgtcgttgtggagcttgaacttggcgccctggatgaccttgttgccgtcggccgcgctgatcttcttcagattcacgtcgtaggtcgggaccggggtctcatcggtgcccggccccggggtcggcacgtccggcgggaccacgttgggcagccagttcgaggtgatcaggatctggttgaggccctggttggccttggacgcgttgacgaccttgccctggtaggtcacggtcacctgcttgccctggtaggtgtccacgaagctctgcaggctggtggtcttgaagccggtgccgtcggaattgccgaccttgtccttgccgatggtgccgaactggttggtcacgtccgtgccggacgacgtggtcgcgtggaacgaaccgtccacgtatacgatgccggtcatgtggtcctcgagggtgatggtgtccacggccagcttgttcggcacggtgaacgtggccttgaagtcacgggtctcgccgttggtcgcggccgcggaatccttccacgtgccgtccacgctcttgatcttcttgtcgatcttggtgacgttggtcttgatctgggtggaaccgagggtctggccgttgctcatcctgacgctgccgccgatcgtggtggacacgaggatcgggattccctgggcgtcgacgacgagataatagccctccggcagggtcaggttcagactgcccgtggcggaggtctggttggtcttcacggccgacaccttgctggccgcggcggtggactgcagggtgccggcgaccttgcgcagcgtgtccgaatcggtcttcaaccgcaggagttgttcggcggcgttacggccttcggacgtgttgtaggtcacgccgttcttgttcaacgcggccttgacccacgcgtcggtcgtggcgttcggggatgaggcgctcacgctcttcacgttcgcgccgtccttgacgacgtcgttgtatccagcgaccttgtacacggtgaagctgtgtccggcgagggtgctgccatcgcccgcgttcagggtgagcgtgccgtccgcggcgaacgccgagcccgggacgcacaacgcggccaacgcggcggcggtcgcgcacgcggccgagatcttcttcatatccatactggatgtctcctttgatagggattcttctgttttctgcacggacggctcacgctgccgtggaagtccgatatcgtcggcgtccgctttcggatcgccggccggttgccggatctctcaaccattcccacgtgcacatggccgtatgagcgcagatattcgaacgggtggcaccccaataagatggatgggggcgtgggccgttctttcggacgagccacgccggccttgtacggcatccacggtccgggaaaggaaaagggcgggatgttggagaatcctccaacatcccgcccgtggcgtcactcatgccgtatggcggatccgaacggtcatcggatcatttggcggcatgcacgccgtgcttgacggtcgaggtcctgcgacgtgcgcccaagagggtcacgccgacaccgccgaaggcgatgatggacagcaggacgccgccgatggccatgccggtcttggcgagatcctcgcggtagccgctccagtcgtcggtgttcgagtccacggtggtgtcctcgcacagggtcctgtcgccgaccttgacctgcttgaggcctgtcgtgtcggacgcgtcgccgtcgaccttcgcatcggcgtcggacttctcgtcgccggtctggttgccgtcggtgggctgctggccgccgaactggtcggtgacggggcattcgacgagcggcgtgccggtgaccttgacacggtcggtgtgcttgccgccctgctcgacgcccttgagggtgccggtgatgatggtggattcgccgggcttgagcacgagggtgtcccagttgtccggatacttcaggtccgtgacgtcgccttcgccggcgatggtcctgtcgaccatcttgaggtccttggcgagataccaggcgccctcaccggtcgaggagtccgtcttggacgtgttggtgatcttgaacgcgatctgctggctgtctccggccatcttcaacgcgtccttcacgtcgtcgcggtcgccggcctgttcgccggaggccacgtcgtacttctcgatgtggatcgacggggtcatgtccggggtgcgggtccatacgatgttggactggaactccttgtcgttgaagatctcggtgaactggttctcgacacggtcggacaccttcaggcgcttgcactggatgtacgcgcgccagccgttctcatgcgcgttgtccgcggacacgagggcacggtacgcttcggtcgcctcgacggtgacctggccgttggcgtcggccgtggcggtgaacagttcgccgccgagcttcgagctgtcgaagccgttgccggcgagcttgtcgcccttggcggcgagcaccttgccgtccctgtacaggtcgcgggtcgcgtacacggcccacgcgtccgtgtactggtcgaactcggtgttcagcggatccacgatcttccactggctgacctgcgggtaggcgcgatcggccgggatgacggagctgtcgagctggtagaggaaggtgcggtccttgtacacgctcctgccgtcgatgctttcgccgccgaccttgacggtcacgtccttggccgggttgacgggcttgagcgggttggacacctcgttggtctccacggtcgtgtcgttggtgacctggatggccttgttcctgaccgtgtacccatccttgaccttgacgaccttgtacggcatgacgacctggtaggtctggccgaggaggttctggtcgatggccggatcgttgagcggatcatgcttgccgttggtcgaatacttggcgaggtccttcggctgggggtcgcccttgacggtgacgcccttcttcgggatccacgtgtccacggtcttcgcgtacacgtatgcgacgccgtccttgatctggatgttgaactttccggtcacgtccttgccggactggtcgagcacctcgatcttggattcgtcgatggcgacgtactcgtcatcgaaatcgtcggtgatgccggccttccacacgcggtacgcgttgttggtctgcttcaggtcgagggtgaccagatagttgccggtatcgcccagcagcatggtcttcccgtcgatgctgacggtcggatcgccctgctccttggactggttgtccttcttggaggggttgtggaccggcggcaggttgtcgacgatgttcgacggggtgatcatgttgttcagcgtgagcgcccactggttggccactttgcggtcgacgggagcgttcttcgcgacggtgccttcgaaacggacctgcacctgcgggttcgtgccggccttccaatgttcggccacgtacttgttcgagtacgtgatggtgaacttgtgcgccgcggtgtcccatgcgaccgtgtagtcgccttcgacgcccatctgcgggtcgctggtggtcagctgtccgccggtggcgaggtcggtgatctcaagggtctgctggtcgggttcgaggtactggtcgtacacgtcggtgtcctggatggacacgatccggtatccgaggtcggcgggcagtttcggctgcgtggtgagacggtattcgaccttctggcccggatacacgaccttgtcgtcggcgtcgttgttcgcgccgccctggctgccttcggcgatgaccttcttcttgaccggtgggacatagccgcagatgtgcggttcgttggtcggctgggactcgttgttgaccttctcggaacccgagttggtcagcttggagccgtcggggttctcgcagaacgtgagctcgtcgcccgcggccttcctgaagtccttgcggacctgggccgcgcccttgccgttggcgaagttcaccacgccgggcaggagcaggctgatctgcttcggattcttcaatccggcctgcgcggcacggtattccggcttcgcggtcgcggtgaccttggtgccctggacggtgatgtcgaactggtcggtcacgtcacggcccttgttcgcgatgtccgcgacggaggatgccgcgtcggtcgtggcgtcggcctcgtacacgcggatcttcgacttgtcggacgtgagatcccagatgtagtcggccttggcgtaatcgtcggtcagcttgatgtcggtgaccttgacgagatcggacgcgatgacgccgttgaccacggacgcgacctggtcgccgtcgaggaacttctgggtgtccgctccggtcttgttcgtctcgtccggatcgaccacggcctgccaggtgccgtcatcgccgagcttgatccagctcttgtccgggttcgggctccactccctgacgggcggctcgttgccgggcacggtctgctggttccatttctcccaatcgccgttggtgagctggaccttctggccggccttgagcacgcccttggtgaacgcgcccttgatggtcatgcggaccttgcggtccgccgcctggttgtaggtcgtgtcgagcagcggttgtttcgcggtgatccacaccctgccatcctgcttgtgcacgtcgaacaggctgttcgcgtccttgccgtcgatggtgacggtcaccgacgcggaatccaggtcgatgttcctcgcgctcttggagaaatcatcgcccaattcgtaggagctcatcttcctggcgaggttcttcggcagcaggccgttgacggtcacgccgaaatcgtcctgctggacgaacgtgtgcgtgtccgcgttgaccttgttggtccacgccgtgtcctcggccgtggcggcctggccctggtcggcgctccacaccttgtcgggcttcgggttgcgcacgtagaccggcggctcgttggtcggctgggattcgttgttccacttctcggaggccttgttggtcagcttcctctggtcggccgcggcctgcgcgttcggcgtctgcttcacgtatccgccgatgtacagtttgaccttgcggtccttggtgccgaacgcggtcttcgtgaggaacgactgcttcgcggtcgcggtggtcgtgtgcttcgcggtgtcgaccgtgatgtcgaactggtcggtcacgtccttgccgtccacgtacaccttgacctggtccttgtggttccagtcgatccactgggccgaagcggtccaatcatcggtgatcgcgtaggaggtgaacgggttgagcaggtgcgcggggatacggccgttgaccacggcgccgatcgcgtcgccggtcacgaacgtgcggttgtcgctgcccttgtcgttcgtatgctgcggatcctcggccgtcagggcgccgttggagtccaacacccacaccttgtcgggcttcggagtgaccttgccgacctgttcgctgttgccggtctggcagtggctcttatccgcattgccgtactcgtcgccggtccagcaggcctggctgtcgtccggaatggtgtagtccgtgccggtcggggtcgcggactggggcacgttcaacgtgtattgtccggagaccgggttcagcacgtgcgccttgacgacgcgtttgcccgcatgggaatcgtccaccgtgatgtcggccttgacggtgttgccgtcctggtcggtcacggtgatcttcgaatagtcgtccttgtctgtgccgccgatcaggaccttctggccggtcacgtcgatcgtgtcgtacagccagaaatgctcggacgcgttcgactgggcggtgatatgcgccgtatacaggctgccggaagcgatctgctgggcctcggcggtgacctgctggcccgccatgttggtgagcttcttcgacggcggcggcgagaccggcttccaggattccttcgcgtcctgagcgcccatatggctggccgcggccttcatatggccctgcttgccgacggtcacatcatagtagtagaagccggccggccatgccttccaagacttgtccacgtccctatagccgaacgagacgcttttggtcgtgttgttgttctgggtgaactgcttggacgcggtacgggtcgtgccgtccagaccggtccaatgcagcgtgacggtgcccgtcacgtcctcggagatcgtgctgccgccacggctggtggtgatcgcgtcggaaacgtcatcggtcgaaccggcctgggtgaacaggccacccgcctgcgtgctgacggtcagatcgtagtcgaccggcggctcgtcctggtcgagaacgatggcgacgaccgcgcgcggggccttgctcatctcacgggccgcgagactgttaatggttgtggctccatcgctgaaagcatcggaagtcttgtaattggctccctgatacgaataggtgccgttcgggatgccggaggcgttgtaggccgccttccactggtccgcgctgaaggagccgttggcgcccgtgtaccagtcgccgttcgcgccgggcgtgtgcacgaagcccacggacacgaggcggcaggtcggattctggttgcccgaagccttcgaacgggccacgcattcggcgttcgcgccgttcacggcctcgtcgatggcgctgttggactcgctgccgtccatcgacttcacaccgacggatcccatggcggatttcacattctcgcgggtcggggagccgaaggagtccttgtacacccatgtgatcttgccggtgccgccggcggagccgtcgcccgtgcccgtgccgtcaccggagccgccgccaccgtcggcggcgaacgcgccggcgaccggggacgccagcgtggccgcggcgaccaggccggctatcgtggccttgccccatttcttgttcttgttggaacccaatgttccgtctcctttcagagattctgcttgcagaacgtcccgccgtgcgggcgggacgggacgacgggaacgcacgttccctgcgcggtccccctcacggggaccggcccatccaaccggttccacgcgtacgggcgccgatggggctcgatatgggttcggggggttacgtggcatgtaaggtacgggaaagggaaaggccccgcccaacagggcggggcctttggaaggctggatgaggcgaatcagcccaaagggcagaaatgctgtccatcgcaattcggattgatggtcactttgtcttcccagtcgtagtggatgcttggcgcgggggagttcccgctcggggagccgccaccctggccttgcgatccgcctgaatacgatccgccggaataggaccgtccaccggcggaaccggaccagccgccggacgaatacgaaccgtacgagtacgagcgttgcgcctgctgttgggcctgctgtgcggcggccgcctgggctgcggcctcctgttcggcctgcgccttcgctgcggcctcggcgtcggcctggtccttcgccgtcttcgaatcgttcacggccctgacggccttggcgattgcgtcggcgtcgcgcttggcgatggcctgcttcaacgcgtcacgggtcttatcgtcctggaccttgccttccgtcgccctgtacagtccgtccgcatcgtccaccgtcttgtcgagcttcgacgattcgaccgccctgaccgcggcctgcagcgtcttcgtatccgccttcacgctcctggccgtcttgtccgccttggcggtggcctcgtccagaccggtcttgtcggacgcgtcgcacttgaccatggcgggcgtctccgccccaacggcccgtttgagcgcgtcaagggtcttatcgtccttcacggccttcacgtcggtcttcaacgcggccgtcgtggcgtccgcgccgagcagcgtccgatacgagtccacggccttcttctgggctgcgacggcggaaccacacgccccacgcgccacggagaccctatggtcctcccaggcgcggtatccgcacacgccgccgacagccaggacggtcgccgtgacggccgccacggcgatgatgatcggcctgcggtccttcctcgttggaatgtcctccgtgccggccggtggaatggctgccgggacagtattcttctcttccatgacggttctccttgatgtcttccgttccctgtttcctcaatgttcgatatgctcatactacccacataaccccctgacaatatcggcaggggagaagcatgggtttttcggtctggcggcccggaaggaacgtccgcccatggagttcggaatccgggaaacggttgcggatggaaaacaggagtcgcggaacgccatgggagcaccacgtagcagtcaactcagaaggtcgatactccgaacatagtggaggcttgttcccggtttcctttcatcggccgtcggtcccttcttcaacgacttcggataatacagtccgttgtcatcccgtcccagaccaagatgccatgccgagccaccgaaatacaatcggacacgactattgcccgactccaccacgagttcggccttatccaattcgaatgcgccggcaatcacatcggccttggctttcaaccagttcgcatcaccggtcggcgcgaccctcttcggagagatacgcttccgcgcgagcagatcgacatacagacgacgtgcgggcaatgaccgcctgcgatggtcgtcggcataataatccaagccacacaagtgagcgaagttctcagccctccaccgtatcgccacctcgaaaccgtcgtcacagacgattcgcgtggtccggccaacgagacactggtacgacagggcggccttgcgcgcctcgccaagcatgcgctccttctccctggtgacgttcaagcccgatcctcccgcgaaaaaagaaggggcgtcgaaccaacgccccttcggaagcagacggcaagtctttttacagtcttctgcgtgacttgacgctcccttgtcagggaggatgaacggcttcggcccgttccggccatctggtccagccgctggacgagacgtcccgctatcgcggatgacgcggccatcgtcatcggacgcctgcggcagcatgccatctgttccggacccgaaaccccgcccacgaccaaaacggggtcaggcttcaaggtctatgcgattctattcacagaccatggacgagtccatccaaaggattcataggctcctgccatgtgtgcggacgagcaggtacgcccagaccatcagattcacggtctgcaccaccagcagaatcacatccacgccggaaacagtgccggtccaaccatcccgtatgcgcatgagcccatgacccaacccgtacgagtaggcgagcacgccgatccacccggccaatcggcacaccgaatcgcgccgccgttgttcttccgaacatcgacgggaaccgttcggcatcatgtatggtccgaccagtcggacgcacgccacgagattcagcacgcatacaaggcttttcaacaggttcacccaattcactgaatgtctccttcccaccatccggcgctttcgcgcacctgttccatcagatcctccaacgtggcctgtttcgaggcatgacttccgatggtccgaccattccacgtctcttgaccatcgatatcatgagaggcgcggtcaccttcccggaccgtcgaaacgtatcggagcggaggacgatgagggcacgatggaaggatcgggatcgggaagaggttcggatggttccggccgggacgggaagcccacggcgggatgcagttcccgccacgcctccacgaacgcatgctcgtaccggtagtcgcagacacggcgatgataatcgtggaaaccctccggcgcgacggtgagaccatgcgacgtggagggtacggagtcgagaagatcatgaagggaacgcggatcgtatctttccatgaaacgatccaacgccttcgtacattcctcgtcctgccccgacatgatgtacttcaagggagcgatgggagcgcccttgtccgtcacataacaggagcggacgtccaacgcgtcctgccggatgagatccgggttggcgagacgacgttcaattcctgattccgttctcttgttgttgaacgaattgccgttatcatagaccggcgcgagggagaactccccacgtggatttctgagaataccccaattcgtgttattccggtctatattgcggatgaacgcgtccaccacgaacatgtcccagaacctatcggacactccatcgatcgaacgaagcaccgggatgcggtggatcgccgaacgcacgtcagcgagcaccactccggagccggtggacgcgtcctcggtgaatcctggctcatcatcggaaagagagttcttcagatcatggaaattgacgagtctggaatccggaaaggtgaaatccctgcaggcgcagacgatacgcccatcacggattcccaacaccgtttcatggaccggaatgccaagcgccccgtacacatgggatcccaaccattcggacaatggcgcggtcgtatacgacgggacgctgccgtgaaggttcctggtcgtgccggggaacttcaccagccagtcgctatccctccagacgagtcctatcttccgtccggcgtttcctccatagaattgcccggaagtctcgcatgattcaaaatcgtggatgtcgatcataaggttcattctaacggaactggctttcgagggaacgagccggccggactggaaccagattcatggcccgcacgccggttctccttattcaagccggcggattccgtcgtttctttcactcctgcggtccggcgctttcgcgcacctgttccatcagatcctccaacgtgaccgtgatggactcggccccgctcgcatcatccgtggcctgttcagccaaagccaacgtgtccgcgagacgcgtccgcaggtacgggaccttcaactccatgctttcggtccgttcaagcagactccgcgccgcatcgatatccttggccaaccggtccatgttctcctcgtccgcacgtttcgcagcacgccgatcatacacgcgggcgaacgcgtccacccggctcgactgtctcccgtaagcgcgcgccgcatcacgagccttgtccgcatgcttttcgagctgatcgttcttctggctcgcgtcacagtcgatggacacggttgcggcgacacgtcgcaacgaatcatattcacgtttctgccgtgcggtcaacgactgcggatcgacgttcctgaacttgacacccacacgatcgctcaaccgtacacgcgcctcgctcatttgcgagaccgcgtcctcgcaatccgagacgagctggtcgtggcgcacgctcaaccgtgattccgtgatgaccatgccgatgcccgcgaccgcgatgacgagcgtgcatgcggtgaggacggccacgcccttccctgacatgcgcgacgggttgacgtgaggcgtctcactgccgtcatcccagccgatatcgtccggatcgtcgtcacgtggcgtggagaacggattccaatccgggtccacgccatgcgaccgtatgccgtcgtaaccgtcgtcgtcaaccatgggaaacctcctgaagaaaaaatgagaaggccgcccgccggacttcccgtcgagaagatagacaaaaagaaacgggacagaaaacggtccggcggacggctcccgtcgaatgtcggatgggaaggggtagaacccatccggacgggaccgctcaccagccttgaagcgtaggccggacgggaacgccggacgctccctcaaggggaggagggagaagcccggacgtttccgtcaaccatcccacatgacggccgaccgataacagccgatacgggtttctaatccaacacgtcggcggccatgtccaacaacgttcggttcctatgggaatcgtccttcgccatgagactgtccaggaaaccggtatccaagaccagtttcagatcaggttcgaaccggacgtcacccaagcatacggacagccgataggtttccacgcaatgctcgccgcgcatgacaggactctgatcgtggataaggaaagacaaatcgacgaaaccatggccctccgctctatcgacacggacataaccatccatcctggtcggagtgaaacgaatgcttttgatccgcagctttttcagataacagtgcaatgggccatctaccagcaagtaccgtcccaccaggttctgggcgggcgcggcgtagaaaagcatgaacgactggttgaaataggaggcgcgataataccgccatccctcatcggcacgccacatggacagcagttcccgagcgtatccacgtcccacatgcaggcccgtggtcttctcccagatgtaaacataccggtcgaattggtcgcgcatcagagcgtacagttcccgtccggccttatccgtcggagtccggcgcgtgttaccgggatccgaatggttcctggacagcggacagaacatgtacgcggtctcgtcatagtccgcgactccaggaaccgacgccgagtaatgccggccgtacggattggccgaccggcttccgtcagtccttttgaacaggttgcagatcaggatcggattgccgcacgccggacataccgcgaaatacgagggatgtccgccccgcatctgcacgaacggtgctttccggttcgtttcccgccgataattttcttccgtcaacggcacaacgcgtcctcttcgacctgttctgaaaacatccatggcgaacctccactaaccggaaccgatatcggttccaatcgtaggacgattcgcctatcatcggtcaggaccaaactcactggtacctcctgctgacttttatccaccattccgtcgagaggggtggcaccgcgccctcatgttcggcgaacgcgagcatggaaagcaccgtggtcagtcccatgccgaactcacggccaccctgccgcagaaggaacacgtaatcctccgtgcagtcgtcgcaatccatatggtcgatgatcgccttgcgcgccagacgcgcacgctccaccttgtcgatatcctccgccacgcttcagctccttactatcattcactatgctttctcacatgcgtcactgaagagccgccgcgataaggatacgggtcccgaaacaagcccatccattaggacctccagcaggtctagcggacgcagaagcgcccgcatccatcgatcgtccatgtcgaccgtcccgatcagatgccgaggggaaggatggtcgtcaacgcggcacgctgctggcccttcatcggattcagtttcatatgccagttcttggccttgttctgcatgtcgcggtcgaacacgtcgagttcgggcaggctgggcgcgaacagggtgatgaatccctgatggtcggtgtccggccagttggcctcctgctccagctcgcgcagccgctgttccttctcctcgcggcgttcgtcacggcttttctcacgctggtcctggagtttgctgcgctggcgcatgctgctcttgcggttgcggagttccgcttcggactgttccatcgtcaaaggccgccagatatggcagaacgccatcatgcgtcgttccgtgaccagttcacggatccaaccggcctccacgtcgaagtcgggccactggtagatccagaacgaacgtgccacgcacgagtccaaggtgatgtagtcgtgctccttggcctcctccacccaggtgacggtcggatcgtccctgttgaccggcggacggtcggccgcatgctccgggtccgcgacggtgcggatcagataccgcaggtcgtccacggaacaccagtggatcgtgttccggcgggcgccgcagtccagcagggacggggcgacggtcatccggatcaggtcgcccatggcgatgccgaccgcggcccgttccgtccggtccttcctcacgacgtgcggcagacggtccgcgttcacggacacgctgatgtagttcatgttctgcaatggagtgaggatgtccggaagatgccacaggttcgccagatcctcacgcgcccactgcggggtcttgtccgattccaggtattcgggttccgggggagtgtggccgggaagcacgaagcttgtctccttcaattcgacgaaaccgtccgtttcggacagttccttgagcatcgtgttcaacgccatcgcacggccggctttctgccggtcggaggaaagaacccattcctccacgttcgcggtcaatacggcagtggcctgccgtttgtccggatcccacaggtagcaggctccctggaacggggtgcccacgacctccacgccgtcgccttcgatggtctgggcacggtcctcgacgtgcccgtacaatcccagcacgcccaacgggcggccggacgcgagcggcgagtacgcccaacggttcgtgccgtccttcagccggccacgccaatgcgtccagatccatgtccatgacacgaggctcaatccctggattcgtgggatgccgtaggcgaggacgagcgcgcccaatatcatgatcggcacgttcaggcccatggccgctccggccacgaggatggcgaggccgatgacgcagacgatcagctgggccttgtcgaggccgaggaccacgcgtgtggcggacagtcggctgaacgacgcggaggggaccctgctccggccggtattggattcgttatcggacatggaaacctccatcggattatcggttgtcggaaaaacaatggagggaacccgcctggggtcgggcccaggatggtgggttccctccggtattacggccacacggccgcgtgtcgataacgaatggcgtcagccgacggtcggaccggacggggagccgttgacgccctggtacgggttcgaaccgccggacgagccgcccatgccgccgtttccgccacggccaccggagcctccctggccaccggtgccaccggtaccgccttggcctccttgtccgccgtccgagccctggccgccctggccaccgtccgcaccctggcctccctggcctccttcggcgtacgcgctaccgccctggccaccggccggtccaggagcgcctggaacgccgggtgctcccggcgcgcttggcgtgttgggaacggaaacgtccggcgtgggttgcggtgcgggagggacggaggataggccggaaccggtctcgttcccatccgttttcgccgcggcgtccatgacctggctcgaaccggaacggtccattccatccgtcgccgatggtgggagcggaggcgcgtcgtttggacgggaagcggcgtccatgacctggctcgaaccggaatggtccgcgccgtccggctggacgtccggcgtggactgggttttccgcgcgtcatcgccaacaccgccgttcgacgtgtagtcgccgtccgcgccgccggcctgcccgtccttgggcagcaggtccttgatgccggaggcgaggcccgggatcgacgatcccacggcggccggattgccctgagcggctcccagcacggctcccgcacccgaattcacgaccttgccaagacctccggtggcgccgccggtcgcggcctgcacgacaccggccgtgacctgcaccgcggccttgatcgcgttcggaccgatcttgccgccacgctcctgcatgtcggcggtaacgttctcgccgatgaagctcacggcaggcatgatgagcttcggactgaagcacgccaggatgatcgtggcgatgcccatcagcgcggggaagaacgattccgcgtagttcggattgttcttcgacacgaagcagatgccggaacccaccatgatgaccagggcgctcaacggtgcggacaggagcacgccgaccacggcctgcgcccatttcgccgcggcgggacgcgtgactttccaaccggtcatcatgaccggcagcggcgccacgcaggccagcaggatcaggctgatgtcgcgtgcggcgagcatgcccgccagggcgaggaccgcgaggaaaagcacgaagtccacgacgcagcggatgatcagatcgtatccgccggtggtcttgacgatcgtgccgatgaggttcgacacgatgctgtcgccgaacgggtcggatgtgccggcaccgttcaacgggacggtgaggatcctgtgcgtgatctgtccgacgatgccgtccatggtgatcatcacgctgatgcacaccgcggtcaacggccatgcgagcacggccatcgcgaagcttttgatcacgtcggcgacgctgcctttggccgcggcctgcaaggcgccgatgacgcataacgccatgttcacgaatcccatgatccagccgatacggttcgccgcggtgatggcgacgttccattcgtcgttggacatgctgcccaccaggccgctgaaggcgcccgtcaacagttgggagcacaggttgtccaacggtttgaacagccagtcgataaggttcgcgaagacggtctggatgatgagtgacatccggcctccttcaaaaaaggaaatgccgtggacgggactggcccggccacggcgtgaataggggtgtgtcaggcgggagccgtcagaacagcgcctgcgtcgcgaagaacttcacgatcgccatggcgctgcccaggatcatcgtcgccagggcacaccagatgaacaccgtgccggaatactgctgcatcggaccggaatggatcacacggccggcgatccaggcgatcgccgcgcagatccacgctccgacggcgatgtacaggctcaacgcccacaaacctccgaccatgtcggacaccaactccatgaacgggaagaacgtgaagttcggactcaccttcaggttcgagatgtcaccgttgttcaggccggtggcgacggacacgattgttgccgcggcgggcgccgcgagattgtgtaacatgatgcacactcctttcagaagattccacgcggccggacggcccggccacgccgataatcggcagggggattatttgcttccggtcaaccatttccataggccggtcgcgccgtccttgatgccctggccggccttctggaatatgttgcccttgccgtcaccgccggaaacccagttccaacccttcaaagcgtcgtcgacggcgcctttcacggtggtcttgaccgtgtcggagataccggacacgatgtcgtcgcccaactgtttgaccagtccggtcagactgtcgtcgcccttgcctcgaccgtccttcaggttggttttcccactgccggacgcctgcgtgtaggaacggttcacgcccaacccgttggagccgaacacgttgcagctccaaccccatccgctcacggcggctccgatcacgaacgggacgagcatggcggcgagcaggcgtttccaactgaacgcgcgttccatctggttgttggacaccagtcccggaatgaggctgacgcagccgatgatgatcacgcccacgcacaatacgagcgcgacggcgatcacgccgccggccatgtcccggacgccggacacatcccaggccgggtcgggtttcaaacccttcaacgcgttgtccgcgaggttcaatgcttccatttccgtttccttccattcgaggtccatcagtaccagccggtcgcttcggaatgggcccaagcgccgcaaggcgactggtagcgttgttggatgtaacccaatccccatttgacctgcgtggccgcgttcgtcttccaatcctgtcccgcggacgccatcttgctgccgggcagtgattgggggatgccgtacgcgccggaggacggattcgtcgcgttccactgccaaccggattcgcgtgtccagagcttgtccagacagtcgaattggctatcatcccaaccgaagtccttgagcttgcgtcgggccatcttcttcgcgtccgcggccgatgccttgtccccggacacgtcggatgtggagtcgtcgcccgtcacgcactgttccgtgccagacgagccggacgcgcccatgcccgtgagcttgtcgttcggcagcacgtacgtgccaccattcctgatcggcatggtccgtgaatacactttgtagccggcgcccttctcactggtggtgatggtgcccttcgcggtgtccacgctttcgacgatgccgacatggccgtacgtgggatccgaatcctgcacgccggcgggccagctgatgatcgaacccgcgaccggcgcgtccgtcgtggtcttgtagccggccgctgtggcggacctggcccaatcctgcccgttgccccaatattggcctatgttcttccagccgagtttcttcgcccgcatgcacgtccaccacgtgcattggccgtacgcgtacgcgacgcagaggttgttcggcccctgctgcccgttgaaccaagcctcggcgtccttctcgctcatgccgaccacgttcgtggaaccggtgctgccggacacggcctgcgcggatgattggccgccatggggatcgttcacgttcatggagcccttgtaccggtagtaggccgcgtagccggccgcgtacgagtcgatgctgatctcgtcgccggtctggtctccgggcttgggaccttcaataccattgttctcgtcgtggtgcgcgcccacgaacctgccgtcgccgatgtagatctccgtgtggctggaactccatacgatgtcgccggtctgcaggtcggacacgcgtgaccagtcgtgtcgttcgaatcccgcgtgcttcagggccgcgtcctcaccgtaggtggagaaggggtacgagcccacgtccaggccggcctgtttcaacgcgtagtagaccaggctggagcaatcgtagtccgggttgccggtacgacgcggctgactgtagccgtgggaatcgtccgcggcgatgttcttggcccattcgacccatgaggtcgttgttccggccgcgttggacaatccacagttcgtgccgtactgcgattggaccatggcgacgaggatggtgctgaggctcatgagcatgacgagcggcacgatgacgatcatcggcacggccagaccgaacacggtggcgcctttcaccagaccatgcccgccgttcccggtcctctccgccataggctcctcccatcatcggcacgcttattgcaatccattccacgcggatgcgggggagaacgacgccgataatcagcgagggggagtggacgggagccatggagaagcaaaaccgactcgacgaggaccggtcaagaagatagtatcgtccattacaggccagacggaaaggtgagtgaactatgagcatcgagatgcgcccgttatctggaacacgcccgttgtacgtggacgagccggaaccgttctggccggcgggagacgacccggacctctacaagctggaactctggagactccacaaagtgggattggtccaaggcctgcgcagcgtgccctgctggaagtgcggatacttggtcatccaaagcggactgttcctggaactcgagggacgggacggataccattgccgcgtcgtatcctggagcgacgcccacaacgccggtatactctcgcaaccattcctgcgcacgctttccgactgctggcgtgtacgcccgacgtattccaagtcggcggggtacgcatatctgggcataacctgcccgaaatgcggcagtctccaaggagacaatttcgtctacgacaactatcagggccggggaggcgtgttcagcgatcctgaagacaagtccccgctagaggtactgcccttgccggtgttcaccgatgattggccgcaaagattccattgggcgttcgactcgttcagcctcgatctggaaccatggaggatcaggttcggcaaaccggtcgcgatatggggcaacgcctggccatggagcgaatgagaccacgcaagactatgacggccgacgcggcaagctcgcggcggggaatatcagttgcggaataattccgcaactgatattctgcctccgtgccaggaaatggtgcctcgcttattcgatcagggaatcgaagccgttcgtccgcagggactcatcggccaatgatgtttgctccattgcggagatcattcccttcccggcatcgatgataggagagacctgttcccatgaatccggtacgggcacgggcagaccccagatgtgccttggttggagatgctgctgcaccgagccgaactcgtcgagtttcatgagattcatcgccgtggacgacatcaggaacgccaggagatacgccctcatattctcgtcgggaacgcggacgcgtaccaggtcgtcgctgatgacgtacttgtccgcgagtatccgcgtggcgtaggtgactttgccgatcgtgccggaacgggagatgaggatgtcccccttctgcacgcgcagcattctgacgcattccttctgtttgtcggtggcgcgcgacatgtcaaaccatttgacggtcattcgtcgctgctccaacgctccgttggcggtgagatacggtgtcagattcgtcgtgtcgcttgggtcttcgacgacgaggcttcgtgagctccatcgtggccccatgtagatgcggatgttcttgtcgagttggccgatggtggtgaccgaccaatcgggtttgtcgtcgaatttgctgactttttccaacgtcgcgttcaattcgggtgaataatgctgcgggttgaggttgagattgtcgtccaattcgccgcgttccgcggtgaaacaggtttcggattcggtgaacgttccgatgtctctgaatgtcttgtatgcttccgcgatctgggtcaggtcctcatccagctcgctggtggcggagcctttttcgtcaagtgcgaacactggttcgcccttcgaatccttgccgacccttctggattgggccatgaagatggtgtagtcgccgggtaccggatcgtcttccaaaggtttggagaggaaaaggacgcatgttcgaacgcctgtgtcgggttcgaaagtgttcttgtgcagcgtgaccaccgcatccaccttgcatcgcgacagcatccacctgcggtagttgatgtaggtgcggttgtccaggattcctttcggaaggacgatgccgatgcgaccgcccggcttgagccaatcgatgcagcgttcgaggaacaggagctccggcgcctgacggatcaatagggtgccgtggccggcatcccgatcatcatcgtccgtgatcgtggggaacgtgccttccggatcgggtctgtgtccgaaaccgaataatttgaggatgtccggatccatcatcatggattcggttttttgcccggagaacggaggattggtgatgatgatgtccggcgtgccttttggacagtggctggttatccacccgtccagattggaatacttgtcgagtgagtttccctgggtcatgccggtgttgccgtccccggtcagaagcatcgccgttttggcgatcttcacgagtcttttcgagatctcgaccaggaacaccgaattcttgcataagccgagccgtctttcccgttgtgggctgcccggtttggtgccgtcgatggctttgcgccgcttgtatctgaacgcggcggtggcgaaaccgccgctgccgccggcggggtccagcactttgtcggctatgtcggggtcgagcatatcgaccatcgctttgaccacgagccggttcgtgaagaactgtccctgctggcgtttgagtgtgacatgggtgaactgctcgtatgccgcgcccatcagatcccagtcgtccgcatcgtcctccctgctgacgaacgaatagtcctggagcacggaagccgcttcgacgagggtggagtcgccgacggcgatgtcctcgtccttgtcgaagaccgtgggatactgttccgcgtactcatggaacaggctacggatggttttcgccacggcggcccgcccgtcttcggacttgtactgttccggagtgatccagaaatgggggtaggcggtgtcggaagtcaccgtctcgtcatagatcttggcgagaaggatacgcaccatgtccatggtaaggtcggaatccgcgttctccatgcccctgccgtaaagacggttatggcacatcgccaacagtctgcgcacattacggggtcgttccaactctcctatgcgcggagtcctcccatcctcccatccttgaccgcacctcggcagaccgggggtctcctcgaggacttgaatgccgtccttgttctctctccggtagaagaccgtgccgtcaccattcgtccagacgccaccattggcgctggtgttgaagatgtacgagaccagctgggcgtatccgtcctccaccttgttccgtttgcattcgaccacgaagttgatcttgccctggtcacggttcaggcaggcggccttggacgcgtagacgacgatgtccgcgcgcaccgggttcccgtccttgtcccggagctccttcgacccatgttggatcggcacctccctccggatggtgttcgccggataatggtactcgttgatcagggtctcgatgaaacgctgcctgactttttcctcgggagtgcttttaagacaccccccccaagaatatccacgatgtcgccgttctcatcgaaacgaaccttgaatcccgtgttcgacatgcatcagcctccttgtgtccgatggctacagtgtacaatgacgccgccgtttccaacggttcacgacgggaaatatccgacaggacgaggcatggccgtggataacatgcccgaagtaaaagagaagccggcactccaataaaaatatcaggtgggacataatgtcccacctgatattctgtttcaaaaccaatcgtcccggcgcctggaggattggcggatggggactcaggcggcgaacccgcaatggagaatatcaggtgccgcattatgcggcacctgatatttcgtctccatgatgaagggcttttccgaaacggccggccgcaggccgaaagcgggaccgtccggaacggccgggaggatcagccgcgcttggcgtgttcgaggtgcgattccggaatgacggacacacaacagaaaatatcagttgcaacataatgttgcaactgatattttgctccgttcttaatgggcgcgggcaagggaaaacccggtctcattttaggagagggttttcgctcgtcttcaagcgtttgagtgtgggggatggaggcccgtatgccgggtggagcggcaagctcacgacgggaaatatcagttgccgcataatgcggcaactgatattccgaaccatagtaggcggcggaacggctcttcggaatctttgaccgaaagggaagcattacgttcgggatggtccgctgtacggaaccgttcatcgtttctggttggggcgagggtattcgagtcgtgtttcgggggagaaccggtagtggattccgccctcgaattccgcatcgaccgtgacgcttctcgaaccatcctggttcaaccggcctgtgatggtgaaccgttcgaggacaccccagccgatgaattccttgccaagatgcttctcgctgagttttcccgcctcgatggaatacggttttggatggttccgttcggcgatctccggtttgcagacgccgcacgtgcggtatcgcaggccgctggccagcaggcttgatcgggtcacgtacaccgcttggaacctttggatgtcgaacaggagcgtacgttcgtaaatctgatcgccctggccgtcggttccgactggctcgtaatcccaccgggggtattcatcccggatatcctgttcgacctggtgtctgatggtccggcagtccggcatgtggaccatggccaggcctccctcgcgtcgttgattgacgacgtacacgggttcttcgtattgcgtttcgctcatttgcgggttcttctcccttcggttttggcttgtttcccattatgaagccgtttccgctctcctgggacggatcgtctcacgcggcggtttcgatgccttcgagccggttgagctcgtcggcgtgccgcatgcacgccatctgccattcggatggcttgccgtagcgcaggcttccctcatggtcgtattcgtcctcgtgcggccgcatgtcggccaggacatgctcgcagaccagcgaatgcacgtgacgttccgaatgacgttccggcaccggggtcggctgggccacgggcctacggtcacgctcatgggcttcggcgtcccgttcgcgttggcgttcgatctgggcgacggtccagtcgttggcgatctggtcccagttgtcggcgaggcggcgcgcggaatcgacacggcggagccagaacgtgttcgcgggcagccagtcgatgaccgcgaggataagcgccaacgaggccgcacggtcgccgtcatgggctttgacgacccggctgacgaggtttccaatcttggacaaatcacgtttggtcggttccgtggtggtcaacgacagcttcgagcggacggaagcgagatggtccatcacggtcgccgcgtcggaatcccctcccgtcgtcgtgttgtttccgtcctccatgccggggagctctcccgtagggagagaggggttaatggtttgtattaatctattgggtgcaccgcatgcaccccgcggggtgcatgcggtgcacctcctacccttgtttttagaggtgcatgtggtgcaccccgcctttttaatgtccttcgaatcggcctcggattggctttccgaagcggtttcggccgtttcttcttgcggtttcgggtgtttgcgttcgcgttctcgtactttgcgttcacgttcctccccacgcagtctttccctaacatcctcggcacgttcgactccgttgaattcttcgaccggcatgttcagtctcaggtcccagaccttcgatctgcgtccacgtggcacggtgccgccattcttgccaagggccgcgtgacgttggtcacccggcatgatcaggcccttatcctgcagttccctcaacgccttgcgcacggcgcgttcgctcagttcggtagcgacctgaatgttcaggacgcttggccaggtgcaggtaccatcctcgtgcgcgaattgcgcaagatagatgagcacggctttctgcggtgcggaaccgagactcaaaccgtatgcccacgacaaagcctggaaactcatctttgcccctttccaagaaagaaccgaatcatgtcattcatcgcccggttcgtggatgaaatgcctacttgttgtgttccgatgcgttgagacgccatgccttccaagggccttcctcgccacgttcacgctccaacgcgcctatatgccatttgaccggttcgctgtcggccgcgagcggcgtgatgaaaccctgcttttccaaacggtccaggatcgcgtcgagttccgccggcgtcatgtcgcacgcggtccctctcaacgcgcgcacgcccacgacggcgatgtcctcccgaggcgtctggaacgtgctgttggcaagactgacgagaacaagcttctcggccggagtgtccggcttggcctgccatgcccatttgaagacgctgatcattgtctgctcctttgtcggttgtggtgttcgttctgttttgaaagtctgtcgagggggcgccggacacgcgtcggcggcgccgttgccgttcggcgcgcatggccggcatgtcgccggcatggcggagaaagaagaaaagaccatgccggcatccatctccacgtcaccggggtccggtaacggccgatggacgatcatttcctgtacttatcgacgaccgcgagaatgtacgggtagtcgtcgatgctcggaccgaggccatgatgatggttctccaggaaacgacggatgtcgttgcggagagcgtcggagccacgcgtcgcggtaaggcattgacggatcagcatctcccaagccatgcgcttgcatcgagtcgtcacgtcctggcgcaggccctccatgtcggccgcgtacttgtcgctttccaggtccaacggctgggtgccgccggtcaaccattcctgataactggacttgtctcccgccggcgcggacaggacggtcgaatcgggatcgccgaacacgtcggcttcctcgcagagtcggtcggcaagggccgcgttgttctcgttgcggatccttcttctcgcttcggtggcgtccaaagcctcgcgttgcggcgtcgtgtccttccgcttcctgcggcgtagcggcgcgtgggtcatgccgctacggtatttgggccgctcagtacgcatccactcgcccaaccggttgccgatcagcgtgttcacgaacgcgcccaatggtttgcgttcctcataggaggcccacctgcgcaggcctcccttgagcagttccacggccacgtcgcacataatctcgtcaacggcccacgcgtatccccattcggagagtctgcgggcgacacgtcgacggttctcgtccaacgcgtcctccacttcccgcggggtcacgccgtaccgcgtgtggaagtccttgttgctcatgctgtggtgttccatggcttagaacctttccgaatgctctcttctgatgcgggcgagataccttttcgcggtgctgccgctcgcggccagtcccgcgtccactgccttcgacgcggtcggattctcgcctttagccgtaagctcgtcgatccatgcgagccacgcctcgtcatcggctccggccttgccgcgccggccggttttccctggcttcggcttttcctccgcctgggcgtcgtcggtcttctcttccggcccgtcggccggttccacggccgtcacgtccggtcccacgggttcgggagccggctcgtcctggccgtccacggtcggggcatcccgctcatcgggttggatggtgagggtcgggatgatgactggttcacgcatcaccggctgcgggatggcgtgctgttcgacggtcggggttgaggcgtcggcggctggcgcttcggcctcatcggcttttggggccgcatcgtcctccatggcgggaacgatggtctggaagtcgaacaggtccggaatctccggcttcgccggttcagccggttcgggagccgatgccggcggttcggacgggatggccggggccggcatggcggatggtgcgggaacgggagccggaacgtcagtgtcttccatgacggtcaagccgacgggaaggacggtgttgatcttgtcgagacggtctcccgcgatgatgacgatcaaatgggtcgcgtacaggagtgcgaccgggggaatgctcatgatgaccggcggcacccaggccggcaggtggaatccggtgttgagcatcgcatgcaaagcgttgccggcgatggagaagctgctgaacagtacgagtccgacccacggataggcgctgcctcggatgtggcccttcttgaatccccacgtggcccaggtgcacaggaggatcgtgccgtccacgcacaccgggccaccccagctcaggtacgtgttgatgccgcatgccacgaacacgagacgcagggcgtcgaagctcaacacgaacgcgatcagaccgatgatgatgccggccgtgatgccgggccacattttgacgcttgacctttcggcccgcgcttcctcgtctttggtgtatttcatgattcagtcttttctctctgccggtccacgaccggcgatgatggttggttcagtggcgggggagcggacccataccccttgggatccgcccgtccgatcccggtcgcatgtcaggcggtgatttcctggcagacgatggcgagttcggtgcatccgtcgatgaaacgcgaccagtcgttgtcggtgtcatcaagttccgcgtccgccccgtcgaagacgttgtcgacgtcgatgttcagcaggcgcagcatcttacacatgtcgctgatgatgccgaagatgttcgcgccgccacgggagacgatctcgctcaccgtggagcctcccggctgccacttgtcggattccagcagatgcaccatctcgttgatggcgccgcgggcgtccgacgactggctgacgaacgagtcgatgtaggagcggatgtcggtctcgcggttgcccatgtcgaggtccaacggctggtcgtcgtcggcgttgtcgaaatcggtgttgtcgatcttggcgggttcgagtccttcgctcatgcgacgcatcctgtccttgcggagcgtgtcggacacggtggactgggatacgtcgagcatgtcggcgatgtcggtctgcttgttgccggcatcggagagttccacgatcttcttgcggcgttcctcactcgacatgctgcccgcatccacatgctggcgtttgcccgccgcgtcacgcactctaccttccgcgggagcgataccggcttgacctctgacacggttaacagtcgtgtgactgacaccgagcagagcggcgatgccacggttggtgatcttgcccggagtgaacccagtgatcaggtcagtgcgctgctgaccagtaacccgaatcttctccgcggcgaagttgtcggcgcagtatgcgatccaacccttcatgcccccgtcatagccgagagcgacccagatatggccgtcaaaagccttttccaccgcgtgcaccaaatcgtattgggcttcggcggcatgcagaatcttgactttgatgtcttcggtggcctgacgagcctcctgctcggtgtaattggtctcacccggagcaagaggatgcgctgtcagctcatcatcttggaagtttccggcgagagcggcaaccgggttggtctcgaccaggtcggcatcatctatgtcgtccacaatttcgggggtgacggtcggcgtgttttcctggtatcgggtttcattcggtgtggtggatgtggaataatcagacattgagctggtcctttcctcagagttggaattgattgcatctgcgtaggtttcgttgaaatcgctcattgtgatctcttctttctgcgattggttccttggctggtgaccgtggaaccttggttaattgggaaatgctggatgggattgactcgccgcccgtatgtgagctgcaactcatgtgcgggcattactatttgagcgatatcggcccatcgccaagtggttggtataggaacccgacgaaaagattggaatggctatgacaggagatgactcccttgcattggattccatcacgtcggactacagattcatgttggagcatgacgtctccatgttggagattgctcttgcggctgtgtccttcgaagattgcagtcttgatgacgccgttccattggatcgggtctccgtggcgtacgattgctggcttgaagcgttggaagcgcttcatcctggccatcgtttccgcgaattcagtctttcggatgcggagcttgcggacgacggtctgcttgaacgtctgctgttgactgttttgttcgatggtggttcttgccggttcatacgttccgtggttgccgtggtgaatggctaccgggcccaccgcggttgacggtgcgtattgccggtggtgttttatctcttttctgttattggtttgggaaatgctggatgggtttcatccgccgcccggatgcgaactgcaattcgtccacggactctaaatgttttacacaggtgtcatagcttcctctctcatacgcatgtcggtaagcccatacaaataatctgtagagactccgaatatcactgccgtcttccaaatgtcattcgcagtgaacttcaccgtgcccgacaacttcccagaaattgccggctgtgaaagatgcagcatctttgcataacgttcctgagacattttggtttccgccaaaagcccagcaacccttctcgctgtgataagtttatcagggtttttataaatcatatttatgagtataagccatgcttatattttttcaaatatggcgtgtcataataaatatatggccaagcattcaataaagacagaagcatctgaacgactacaagaaatagtcaccaagaacatcagggttcgacttgccctttataacgtcaagcaaaccactcttgctgaagcgctattacaaacgcaagcgggcttgagtgccaaaataaaccggaaatcagagtggacagttgctgacatagcgaatgcagccgcattcttccatgaaccagtagagaatttaataacttcttctaccttggatgcaatcagtggcggctcggaatatcaggtggaacataatgttccagttgatatttcccgtcgtgagcttgctgctccggccggtgtgcgttacctgcgtaagccggacgagaatgagggaaggtcacatggcgcaatcggaccgcgcgcgttcgtcatgccgttgatggatgtggatcaaatgaatttgggtccccgcttctccgcgaggacccgttttgagctcccccactgatgtggaataaaggtgtttcgtatctgatttcttgattttgggtggatgtcgcgttctgtttgtttgagtccttctatggtcgtcgcgtctgcaccactctctctagtgcagtgaaaactgagttgtgtagacgctaagtctcatttccaattaccgaatctgtagttcttcggttcgacggtcgggatgcggttcactttcggagagccgtttcatgtctgagctccgcggctattctttcgggactgaacctagaataagaggtccattccccacggggctggatgtgaaaaagccgccggcgattaacgatttaccggagccattgtgcctagatatttccaaatactccggatgctcagccaagcatctctccagatcggtaatcgtgcagacgacagtgtcaggccatgccgatgcaggaactttatctttcctgaaatcactgatagtacggtctctacgaccgaaaacgagctttccgtcattggtttttgccagcaatgaaagctcgccagtactggactgatttcttttcatgtctcctgcaacataaatacaagccttgtcttcaacgtcatttagctttgttagcaattcatttgcggtcaatcttgcttcgtcctgggtgtgctcttcagcatatcgggacaggcaattagtccctgttgtttctgaaatctcttgccatttcactaatctgttaaaccgttctcgcttttgttcgtccatgaaagcatcaacaacgtgaagggagcatttgttcggaacacaagcattccggatgagctcattaaccacataatcggtctccggcattgagtagcccatgatggtcaggctttccgcttgctccaatgcgtcgtatgccgaacgccaaagcagacggtcaaacccgtttccgtagaatgacgctttgttgctggacgggggaatgaggaatcggtccattcccgtcacagccagcttttcgttttccctcgcgtcaagcttgttctgagaaactgtttcgtcatattctctttcttcccgaattcgtttcaagatcacttcgccgtcattgccgtagctgtaccagtttagggaaccgtgcggcttgatgatctgcatgctattcctgcatgggaggttttcggagaaatcaatccaccttgtcatggacgcggcctcgggtcgtggatacactacctcatcgcttacgatctgtttagctcgagccccaatgctccacagcaatgctggacgctccgtgttgatcgccatttccaacaacgtgtcatagttgaacgtaattatgattgcgcgctcatatgcccatagattcaccagttgtcggagccagagtgggcattcctgcttacagcttttcactacgtcatcgtctagaacactgccgatggcgtcgatcatctccatcgcttccgctcggcgacgcatgttctcatggtcaggcagaaacggcatatcctgagtgcgcatggacagccactgctcaaaggattcgccctccctgaacgaaatactttcacgggaagccttgggcagcaggttcaaagcttgctgcccaagagcgttcagcagtggcatttcgtcacagattgccttggagaatcctgcgcccagaatataaacaggacggtggtcggttatgtcttcttcacctgcagtcatgccatagattttatagtaaacagccacttaaggtcgcgtactgcagttccctccatatccgtcatatatcggcgaagatgccagcaaatcgagctgtactatgtcgccgcttaatttgggacggtgcgcatctgtcgtcaacgaggcctgcgattctgtcgatggctgtaggccggctttggggcaggtctttccgaatggatagaatcccctatgagggggatgttggaaagagaagaaaaacgaaggagagatgattatgggctcaaagaccacggcctcccataaggccgtcccgccgacccgaatttcaaatgggggggcgtaattccagcatagaactattgcgcatcgtcgcaatgttcatgattctcgcccaccatttcgtcgtccacaacggctatgacgtcaagaatcttccgctgggtcctgaaaggatcttcttccagcttgtcatgcagggcggcggcaaagtgggcgtcgtcatcttcttcaccatctccgcatggttcttcctcgacaaggaacagaccatcaaatcgaacctcaagcgcatatggattttggaacgcgaagtgctgttctggagccttgcgctcatggcattctttctggttttcgaccgtgctgacttcggtatgaaaatgatcgttcgcagcgtcgctccgaccatcatgggattatggtggtacgtcactgcatacgccaccttcctcgccttgctgccattcctttccaaggggctacgcgcgctcggcgaacatatgcattacgcgcttgccataacagtgctggcgatctggggactgacaagcttcattcccggaacttctggagtgaacgatagcgtgttcggcttcatctacctattcatcctcatctccgcgtacaagtggtacatgaagccgttcacgctcaaacagacttggctgatgaccggaaccggactggggttcttcctcttgtacacatgcgcttccgttatgttatcgttgttcggaatcgataagggcaatcttcatcaccggaccgttcaagctgcccgtcatcatggtgggcttcggcatgtttctgctgttcgaccggctttccttccgtagccggctcatcaaccgcatagctcagtctgcgttcgccgtgtacctgatcaccgaccatcccgccacgagaacgctactctggaaacatctgttcgtactggaagacctctgccgacaacccttcgcgatcctgcagattctcggcatcctgctgataatctaccttgcctgcaccctgatcgacttcgtacgccagggactgtttgctctgacggtcgaccgcaaccgcggccattggttcgaactggtctggagcaagaccgtggaatggattgaatggggcaagcataagcagagtaacgcaagggcataatccgtaagcgaatggcgataacgcccgtcttcttgcgcagattcggttgtgagttccgatgaaaaggacatggcccggctttggtacgattttcagtcgcttacacatgaaaaccgcgattggaaagaaggccggaagccatgtccgataaaatcatacagttcgacgacgccatgttcgagtccaagctcgatgctttggtccgagtcaaggtcgagcagaccatcaacgccatgctcgacgccgaggccgacgagatcgccaacgccgccagatacgagcgcaagaccgaccggagggcgttccgcgccggccactacgagcgcacgctgaccgccaaggccggcaagttgagtctcaaggtgcccaaactgaagggcgccctgttcgagtcggcggtgatcgaacgttaccggaggcgcgaatccagcgtcgaggaggcgctgatggagatgtacctcgcgggcgtgagcacacgcagggtggacgacatcagccagctgctgtggggcgagcggatgccatcccagacattgagcgacaaactcaagaagatctacaaggagatcgacgagtggcggaaacgcccgttggaatccgagtacccgtacgtgttcgtggacggcgtgtggcacaagcgatcctggggcgggcacgtggagaacgtgagcgtcctcgtcgccatcggcgtcagcacggagggccggcgcgaggtcatcgcggtcgacgagggcatgcgcgaggacgcggccagctgggagcagttcttccgaagcatgatcgaacgcgggttgaggggcgtcagactggtggtcggcgaccggtgcgccggactcgtctccacggtcaactcgatgctgccgaacgcgaaataccagcggtgcatggtgcgcttcatgcgcaacgtgctctccaagacgccgcccagtcacagggaatgggcgtccgccgccctgaaggccatcttcgcgcgggaaaaccgcgaatccgccatggccaaggcagggacggtcgcgggcgaaatggaggaacgcaagctcaaggcggccgcgaactgcctccgcgagggcgtcggcgagaccaccgcctatctcctgccggagttccccgcgaaccatgggatcaagctgcgcacgaacaacatgatcgagcgattgaacaaggagatccgccggcgcacccgggtcgtgggcggcttccccgactccaacagcgcgctcatgctcgtatgcgccagaatccgctacgtcacctcacgctcgtggtcggaccggcgatacatggacatgtcccggctcgatgacaacgctaggcgtagcggcatgaaagtcacgccaacagctggccaacagccaatctgcgcaaagaagcgggcactacccgcctttgagcttgcgttcgtagtggccggccctgtatgccttccgctccccagtgcgctcgtatctggcggcgttggcgatctcgtccgcctcggcgtcgagcatcgcgttgacgatccgctcgaccttctctcgcaccatggtgtcgagcttggtctcgaacatggcctggtcgaactgtatgatttccttggacatggctccgtgcctctttccaatcgcggtttttcattgtctggcgactgaaaatcgtacccggcacggtccatgtccctttccatcaaggccgaaatccgaaaatgcgcaagaatccggacgttatccattgccttggtgctttctgtttacgtgcggcagtcttcgcgatgtatccccttctatatcgggataggagtcgtttcgatcgagacggcggcattttcgggactctcgattcctgttaccgataggggagacccggagcatcaaaatgcatgaaaagcggagcttggaatgcgttttccttgccatggtcacatggtttcgtctgtttcggcacgttctgtgctccgtaaatgtcacacgattccattttttggccgttttttggaatcgtgctacaccgcacacccccgtagtcgcgcgaaagtgtcgggaaagccggttcgggggtatgaaataggtgggaaaaccgcatttcggcaggaaaaatgttgcacgattcgaaatttgccccgaaaatcggaatcgtgcaacaaaattcgtcgtttccttccgtgggtcctcatctcttggcaggttcttgcggcatggtgtccgctgcaagcttggtgtttggacgatgaggcgagaggctcagtggcgggcgcagggcctgccgatcgcgatcgtggaggagatcgcgttcgagaacggttggatcacgcgcggccagctcatggagtctgccgagcgttacggcaagagcccgtacggccagcatctcaagggtatagccgacggcgagatcatgctcgtccccaaccaaaagagctgatccctcgagacggatgatgcgttaggggtgctgcctcattgaggcagcaccctgatgacactttgactgacggtgcttcttatggattgcgtcgatgagcggcacttcgacgaggagtgttttgactggagacgttccaatgggcggcgcttcgactggcggtgaagagggtcatctgccttatgagtggcggatttgggcggcgtgaaaatgtcatttcgcttatctgtggcaggtaatcggcagagatataccctttaactgtggaaaatgtacccccaaagtggcttttgcccgttatgacctgccatatataggcgaaatgggagtttccatctctcggaatctgccgcgtataagcgaaatgggagtttccatctcttgaaatctgccacatataagcgaaatggggagctgggcacatacattccgtcactttcagggcgtggcggaatgatgatgaaagcctgtaccggtcactaccaatgatttgaggaaattcttggggtatctatatctggcaaggcctaattatcgttgtatccgtgtttgcgggtgtccagtgcctgcttccaataggcttctcgggcgaggacgacgtttttgggcacggtggaatcgtaatgttccaaaagcgtgtaacggaaatgcgtctctacgtacgcttctcctgctgctccacaagtttgcttagttctgtattgccgccgtggccattatctatgtagtttttccaccgctgatatatgccgttccttccggtggcgattcccacatacagtttcccattatcggtattggttattatgtacacgccttgctggcgggacagcgtattcttccagcttgccttgtcgttctcccaaatcgccttaagttgggcgtaggaaaggctaacagcaggtgttggcggccttgttcacttggcacggtcggccggtggcactttttcttgcggtcagaaacagcccgcccaaaatcagccactgaatatgccaaatattgccaataagtctcgtgcgcgcacgatatcgacagggaatgttccttatttcacggcccatctgtttgagttcccaaaaatgtgttcaatgtatgaagggatgaggaatagttcgagggggaagattattgttggaaaggatattgtcaacgtgagatggggaagttcagtgacttctgtagagaacgctaatgtgcagcagcctaccgcaccgcaaggggtagttgaggaagcggatgacggcatcactctgatggatctgttcaaaatcattcgtaagcatctggtcaccgcgatcatcgcattcgtggtggtagtggcaggcgtgagcgcctataccttcctcgctccggcgaagtatacggctacggctcagaccatggctacttacaatgcttctcaaaatggtgtcgacattaaccagcagtccgctggtggcagctacatttccaaccaaatcacctcatatccgacgcttgccaccacttcgaaggtgctcaagccggtcatcgatgatctcggtctggacgaaaccgtgacggatctcgccggccaggtcaccgtcaccaatccgaccaacaccgcattcgtgaacattgccgtggtggatggagatccgaagcaggccgcggacatcgccaattccgttgccgaatcgctgaagaacgtcattgaaagcgacctgtactccggagataagtccccggtgaagctttccatcgtgcagaaggcacaggtcccgacgtctaagtcttcgccgaagactgccctgtatttggctgtcggtgtggtgctcggcatcatcatcggcgtgttcgccgcactcatcaaagacctcctcaacaccaaggttgaagagacttccgacgtgcgcggcatcgtccgagcatcctcccttggctccgttccgatggacgcttcgcttgatgataagcgtccggtgctggtgagccagcctaacggcgctattgccgaggaattccgccgtatccatacgaatatcgacttcctgcagaccgaccgcaccgaaggcgtgggccagctgcttgtcatcacgtctgcgcagccgtccgaaggcaagaccaccatggctatcaacactgcggtggcccttgctgaagatggtgcgaaagtactgcttatcgacgctgatcttcgccacccgtccgttgctcaccacttgggcattgaaggtgccgccggtctggcgcacgtgctgtccggacagatgggcccgaaggacgtggtgcagagctactggaagccgaacctgcacattctgcctggcggcaagaggccagcgaacgctggcgtgctgctgggctccgaaaccatgaagctcatggtggagcaggcgctcacccaatacgattacgtgattattgataccgccccgttgacggtgtccaacgatggcgcggtattcggccgttgggccaagggccttctgctggtggtcagccgcaacgtgtgcgagaagaagtccctgcaggaggcggccgacacgctcgccaccgcgcaggtgccggtgcttggcttcatcttcaatcgtgcagatccgaagaagaccaatacgcattccaattattactattactatgaggatggtgcgccgcgcagcagccatcgcgcgaaggggaagaagcggcactgatggttcccttctccatggaatgaggggtgtatggcaactgagaacgatgattcccggtctatgaacggtattctgtccaacatatctcgggatgtggtggacaccagctgggatattcctccgctgaccttccccaaattgcagcctactgattcggaagaagccgatggtgcggatggggcttcgcttgctgagccccgcaccatcgcttcctccgtacctgcgcaaacggaacagccggtttcggctgcgccaacaatcgcggatattcccagtatgccgctcgataccgtcgatttcgatgatgcggttgcaccagccgatgccgaggaaaccgccactttgccacccctcgtctcttcgacagatgaacaggacgtcgaagcaactcaggcctttgacacttcggatggcataacggacctagaggagctggccgcggaagatccggaacatgatccgctgaaaaccattccggtcgcaccgaaagagccgtctgcggacaagcgaaagattattgccattgtcgctgcgattgcggcagtggcggttgctattgccggtgtcatcgtggtacgcaatcgtatcaattcgaaagaacagcgtgcggcagtggtggtatgtgagaaggcgaaatccaaatactccaaagccaacgaaaaactgcaaaacgccatcgaacaggcaaccagtctgcagggcactgcggcaaaccaggtggcggatgccgccacaatcgaccaactcactcaggccgtgaccaaggcgcagaacctcaagacggtcggcggatgttcggtgttgctgtctgaaaccacactgcgtgcgcacgcccgtagcatgagcaagcagatcagcaatatcaaagaacaggccaaggccgttaccgcagcagccacagctgtggccgccagcaagcgagctttggaagtgaataagacgactgccgcattgcagaagaccattgccgacgcaaagacgttgcttgacggttctgcaggccaggttgcggacgagtcgacacgtgacgcgcttgccaaggcgattgacgctgcccagaaactccttgatggcaaaagcaccgatgttgcggccatgcagaacgcttcgaaggtgatttcctcgacttctgacggcgtgaacaagtctgtggcggagcaaactgcggctaatgcccagtcgaataccaattcgaataccaataacggcactacgaaccggcgttacacatatacgtggcaatttggtccgggctctggaaacggtgtgaacggtggtggttcgaccggtggcaataacaatggtggctcaaccggtggtaatggcgattcgaccggcaacggtaacggtggttcgaccggcggtaacggcggttctaacgacggtaatggcggttcaaccggtggcaatggcgattcgaacggcaacggtggttcaaccggcggtaacggtggtaatggcgattcgaacgacaatggcaatggtggttcgaccggcggtaacgacaactcagatacaggtactgctggcgaataagccataccggagaaggatttggatatagcgaatggtacccccataggtccctcttaatttctggggggggggctgtggtaaattgtttgccgtatgcagctgaaggggagggagatacatgcaaggcgtgaataccggtgaatccggcgcaccaaacggcgagcaaggtatgaggactcaagagattcatatcgtctcgtccaatgcgcatcgacaggcatacgcgtccatacagaatcagcgtctgcaaaagcagttcgagccgatgactttttccaataccccgtttcctgcggaaaaggaaggacataggcgcggcaaggctgaatcgactccccggtggcgtttcgccttcgtcgccagcctgatcgccatcgatttggcagtgatgctgctttcgttgaccgtcagccttgtaatcaacggtgctgctttcgatgccatcggcgatgtgatgccgttttggcttttcctcattctgttcagcctgatttggttgctgtgcttggcattcgcgggcacataccaccgccatgttatggcggacggctatgagctgtatgccaaaatcatcaatgcgtcgttgctgaccatcatctcatactgcagccttgcatttattttcaaacttgcattgccccgtactgcgttgattatcgcgccagtcatcgccttcttcttggatatcatcgcacgttggcagatgcgtcaagcgttgcatcgtcaccgcagcaaaggctcttgcaattacagaacggtggtcatcggatcttccgatggcatcaacaaagccttgcagaccatgcgcaactgcatgaattgggggtacgaaccagttgctgtatgcccaattgaagcggatccagcttcaaaagacgcttatgtggttacctcatacacaccggatgccaatatcgaaggctccagcaaacttaaggtgattcctttcaactcggcattcccacgtatttgcgaaagcctcggtgtacaggaagtctatgtggctgacgtgctttcgcgtgattccgaaatgttgcatggtctttctcttgcggtggagtcgctgggtatggaacttgccttggcggtctccctggcggatgtgagcggtcaccgtttgtatctgcgaaacaccacggaacagccagttctgttggcttccctgccgcagtacacgggagctgcgaacgtaatcaagcgtttgctggacatcatcggctcactgtgcgcgctgattatttcctctccgattcttctcggcgtcgccatcgccatcaagtttgatgatggcggtccggtgttcttctctcagacccgtatcggactgcacggcaagccgttcaaaatgtataaattccgttccatggtcaccaatgctgaggagctgaagaagaaactcgctgaggaaactgggcaggaagaccggttcatcttcaaaatgaaagatgatccgcgtatcaccaaggtaggtcacttcatccgtaagacttctttggatgagttcccgcagttctacaacgtgctcaagggcgatatgtctctggtcggtccgcgcccggcattgccggaagaagtggcccgctatggttccctatattccgcccgactgctggtcaagccgggcatcaccggtccgtggcaggtgtccggccggtcggatctttcacaggagcaaagcgaatatttggacgtctcctacattgagaattggtccatcgctggagatcttgcgattcttgccaaaaccgtgatggtaatcttcactggccgtggatcgtactgagccaataagtgggttttctgtgattttccctctgttcttgtgacggaacagagggaaatttcatttggcggccgaaaaaaggggtgccatgtggcacaataatgcgctggaatagtcaaattgagtgcttaatgatttgaggagcaaagcatggggcaacatgctcaagcaatacgggaaaaacatacggcacggaatgtgacgcttattgtacttgcggtgctgatcgtgctacttgccattgctgcagtgtttggtatgcaactgtataagcaggcaaaaagcgtcaaggcacacgaatcgcaagccatatcctcactatccgcaatcaatgaccctgcaaagctcaaggatgccgccgcgttgcaggcgtccatcgcgcaggctcagcagcagacggcgcaggccaagcagattgcgcacggttcattatggaacgtgactgcgaaaatgccgttcgtcggcagtgacatcgccactgtgcaaggcatgacggaagtcgtggacaatcttgcacagcagacactgccatcgttgaccactgcggtgcaacagcttgccggggccaatctttccggtgcggaagggcaacttaatctgcagccaatcgccgatgcgcaaggtaacttcgacaagctcaaccagcaggtgcagcagcagaacaagcagtataacagtcttgccgagccgaaaatcggcatggtgaagaaagcctatcagcagggcaaggaccagcttgacaatatcgccgatttggttggacaggtcagcaacgccactcacatgctgccttccttcctcggccagaacggtgcccgcacatacttgctggcggcacagaccacatccgaaacacgttccggcggcggcttggttggctctctcggcaccatgactgcggataatggcaaaatcgcggtgggggacttccacccgaatggtgagttcgtcaatggcaacaacggcaccgctgaggaacatgcggtattcaacaggccgttgggtttctccttcgacgtgcgagacaccttcgcggtgccggatgtttcccgcaacgcggaaatgctcaacgcttcatggcagcgttcgcaatatgcctgcaacatcgacggtttgatttccgtggatccggtgttcatccagaaaatggtggagatcaacggaccagtcaccttgtccaacggcactgtgcttaccggcgagaacaccgccgaatacatgctcaacaccatctacaaggacgttcctgtggcacagcaggacgaatacttcgagtacattgccaaaacggtgatggacggcgcttttggcaacatgactgtggacaagatgatgaaggtggcgcaaagcatcggtgatttggccgagaaccgccacttctacgcctacacgttccacgatgacgaagcgaagtacttccaaggtgctggactcgccaagaatgcgcctgagagcgagaccaatccggaaacgggcatttacatcagcgagcagaatccttcgaagatgggttggtatatcgaccgtaccagcgaagtgaccaagacaggtgacaagacctaccacgtgaagtacacgctgaccaaccgtatgacttccacggaaatggctacctgcacgagttacattctcggtggtgagcagaagggcgttggtggcgtgcccgtggcgccgagtggcacatccgcgcagcgtgtgctgatttacgcgcctgcaggtggttcgattggatcaatcgccgtgaccggtgatgtgcgtgaccgtagcaatgccaccatggacggcaagccattgaactccagtatggcgtacatcgcacctggcaagagcgtgacgtacgagttcgacgtgaccgtgtctgacaaggccacggctgatatgaagctcgatcagacgccgtgtggcaaaatgaccaatgatgtgaaatacaactattgaaatatggcgcggtaattctcgacattattggtgcatgatttccttgaattcatctcaatgaaaacttgttcaatgaagtctatgaattattgctatattcttggaaatacagggggtatttctgccggaaagcggagataccccctattttattagtgaaaaaagggtgtatttatgcgaattgttgtattatattgcatgtaattaatatcctatattttcaaggggttggcatgtctgttcttgacggatttgaagcagtgggagaaaagaccaccaccaataagatgaccatgacggtcatggaatcatccgttcgcttttccaaaggcgtgaccgaagcgctcggatgcccggcatacgtgaaattgctggtgaatgacaagcagaagaagatcgcagtccaggcatgcgacgccaaagacgagaacgccatcaagttctgcaagaccaagcgaagcaaggccgatggcgtcgactctgacgctgcaggaaaggcttcttccgtgaccgtgcgtaccaccgatgtgctggtagcggtgcagaagtatttcactttcccgccggtcgcagacgaccagatcgcctatttcgccatggatggcgagtcctacccggatgagaaggttgtcatttttgctgtggccgatgctgcaaagggtgtatccggcaagcgcggtccccgcaaaggttcgcatcatacggccaaagatggcgagtaagtgaacaatattccgctcagcttgaaaaatcgcatatagtacagttctcttgatgtgagtgctgtactatatgcagtatcttgataggctgtgcgaaacgtccataaacgctaataatgagtacgtatgcatccagcccaaaaatcctgaaaaagggagcttggaatgaatgtggcaggtagtgggcgtgtaggatcttcgttcagtattcgagtcgctcaaaataacgtgcttggttggcgatggacggtggaaaaagagcatgacggctttttcgagcccgttgcgtctggccgttcgctcacgcgtaagatggccaaaagggccgcgataaaagcgatgaatgaattgcgtgcataaacaaccgtaacgccatgaatggcctgcatctttccatatgaaatataaaagaggcatataagacaggagaggctccgcacaatgtgtgcggagcctctcctgtctgaaaaactaaaactcagtagcagtggttggcgagccagtaggtgtaggcgccctggatggagccgtagcgctgtgcgcagtagccccagaaccacttgagctgggtctgatagttggtggcccagtcagcgccggcgctcaccatcttcgaaccgggcagagcttgcggcaggccgtaggcaccggaagacgggttcgtggcggaaacattccaaccggattcgtgggaaatgatgtacacggtcgcggtgaaatcagcctcggaatagccgctggacagcagataatcgtgagcccactgctgcatttcgccagccggcacggtggtgccgatcgacgctgcggccgcggacggcgtggacgaggagccggtgccgacgaggatcaccttgtcggtcggagccttcttcacgaaagagctgatcatattggaagacatgaccttgccgccggacttggtgacgaggttcgtggtctccataacaccgttcgcgccttcggtctcgaccttctcctggcccttcggcaggctggaggtctccttcttgaccgtgttgaatgcgatatccgtatcagacacctcaacggaagcgccggcacgttcgatcttgatgacggtgttctcgttcaccttcgtatccaaagacggggaaacggtgtcttccgtatcaagggtgatgtcgcccgcgtcaagcacggacttcacgtcggtgaaatgcatgccgggaaccacgcgggtcttgccgttgatcttcacggtgacgtacgaagtatctccggaaagcgcctcacgggcgttgccacgggaggcttcgatgctgtcggtgacggaatacgcggtgacctgcttggcaggagacttctccgcggtggcgtacagattatgcgacacgatgccgccagtggccaacagccccactgccgcaaccgttgcgacaatcttcaccatctgagatttgcccggcaaggcaaacgtagttggttgggcatgtttcttatggctagccattctgctcctacatcgggtacaattcctcggcggattccgtgcctagggcacggcgcacaaccgctagggttccgccggaatgcgcgcaactgcatatagtctaccgcaccccaaggaacttgaagataacgtatgcaacgcgcaggcgacgggccgaatcatcgttccgactgactacttggcgttttcactttggcgtctccgctggaagcggtgtccccatcggaagcggccgcatccatatccaacgccttggcctggctgatcagatcatccaaatcggaagcgcgcaacgcgccggcctgctggaagatgatctgctgcttcttgacgaccatcagcgtcggcactgcctgaaccttggccgcggcggccagatcgggattctgatcgatatccaccttcgcgaaatagacgtccggattcgcctcgcttgccttctcgaacgttgggccgaacgcgcggcacggaccacaccacgtggcccagaaatccacgaacaccagatcattggattcgacgacctggttgaaatcctgcgaagtgactgcatgcgttgccatatgcgttccccatttcccggcttacgctataagccgatttcaaaaaacaatatcgtgcaatgctgcgcaatattgcgaaagcccgtttgcgaaaagtatatagccgcacgccacgcaaacacactgccgcacccgattgcgctatgggaagaatcggaagcacgtgacattcacatgccgtgcgtgataatggaaccatgccagtgatgaatgatgaagtgcccgacgagggcgatttcgacgccaaccgccatcgcggggaattcgacgacattacgccggaggatttcatccgcggaatgggcaaccctccgggatggctcccatcggacgaaatcaaccgcatgcgccacgaaataccgattccgtacgtcgtggtcgtgccggtgcgcaccgacgatctcggcagggtggcgcaaatcggctcgctgctgcgcgtcaccgacgacggcggtatcgaacgcacattgatcgccggacgtgtgctctatcacgaatcgttgcgtgaagcggtggcgcgcaacgtcgcaaaagatttgggcgatatcgccctgccgcagctgccgatcagcctgcagccgttcaccgtggccgaattcttcccgacacccggcctgtccgactattacgatccacgccaacatgcgatcgcgctgtgctacgtggtgccgatcgccggcgattgcaagccgcaggacgagacgctcgatgtggaatgggtcgacccgtccggagacatgctcgacaccttcgtcgggcagatggccaatggttacggcaccatcgtgcggcaggcgctcgcatggaccggcaagtaggacaagccgcgcaagcggggcaaaagccaagcaaactaggcgaacaggcagataggggaggattagaaaaaaatatggcgattgaactgaacaacaacatatatacggacggcggcaacgataccgaaaccacgccggtggtgctcgtgcacggcttcccggtggaccaccgcatgtgggacgagtgcgcggcggctttacgcgaccaagctgtgaaacaaggcgtgaaaccatttgcgatctgggctccggacatgcccggcgccggcgaagggccgattccgtccgacgaagacagcggcggcaaggacgccgacggcgcgttcccatacggactggaccgcatggcggacgcgtacgtggacctgctgcacgccgccggctacagcaaagccatctgggtgggcctgtcgatgggcggctacctgattctcgacatccaacgcctgcatccggaagcggtggcggcgctcgccctgtgcgacacgaaagccgacgccgactccgccgacatgcgattgaagcgcgtcgcaatcgccaccgactgcgaaacgaccggcacacacgagccggtcatgggattcgccgtgccgtcggaagccgactccaccgtgaaacagtcggacgcctactgcaggcagttcgaaacgtggatcaacgaacagcccgccgacggcatcgcctggcgcgaacgcatggccgctggccgtcccgacctgaacgacgtgctgccgaacatcaacgtgccagtcgcagtaatctgcggcgacaaggacccgtccagcccgccggcagtgatgaagccggtcgccgacgcgatgacgaaaaccgacgtgacgatgacggtgatcgacgactgcggccacttcagcgcgtacgaacaccccgaccaggtggccgccgcgttgctggaactggtgaagcgagtcggctgagccggctgcgacgattatctgtggcagaccatccggcgtatcgacaagatatagagaaaatatataaaacgtatatacgaaatatgtactacgtatgtataacgaatatattccgtatataacacgcatgaaagaggcaacacaaccatgagcgtgttctcaccactggcattgacgcagaccctgccgttcctgccactcgcccaaggagacatcgactacgaagtggcacgacgcggcgaacccgacctgttcgccaaagtcctggcggaaccggcaacgaaagtcatcctcgtcaaagacggcaaagtggccgtgccgcacggccaaggcgccatcgccgactacgccaacgtgaaaatgcgcctcgcccaactgccgggcgcgtacgttgccgcggaactcgaatcgcacccatcggcgctcgcgatattcctcggctcgtacggcggacgattgggcgagcacgtcgtcgccgtggacgtgacgcacgtccagccgaacgatacgacgattacggctgcgacggctcgcagcgggggagcggacgacgcgttcgccgaagtgccggcgcatgaatcgcaggaaaacgcgaaatcgctgctggaaagcgcggcaacccgattcgactgggtggacctgcgcggattcgcgccccacgccagcgcacgcgaagccggacaggcaacctccgccatctcgctcagcatgtggcacgcccggcagcgtcactgcccgacgtgcggcgcgcccgtcgaaccggcgctcggcggctgggctcagcactgcacgaacgacgaggatggcaatcgtttgctgttcccccgaatcgagccagcggtgatcaccgcgatcgtcgaccatgatgaccgtctgctgctgcagcacaacagcgcgtggcgcaacaacggcctgtactcggtttcggccggattcgtggaggctggcgaaaacctggagcacgcatgccggcgcgaagccaaagaggaagtcggcatcgaaataggcgaactcaaatacctcggctcccagccgtggccgttcccctcgtctctcatgatggcgttcaaaggcgtggcggtcaccaccgacgtgcacgtggacggcgaggaaacgttgcaggcgcgttgggtcacacgcgacgaatacatgagcgaactggtttcgggacgtatggaggctccgggcaaagccacgatcgcacgctacatgattgaggaatggctcggccacgacctgccgtgacaagacctgccattaaaaggtggtatcggctgagcctgtcttcggggcggttgccgggggagcttgtttaggtattcgtttgggcactcgtctgcgtatcatgctgcatggtatgtaccgtgaagagagtgaatgaggaaaccacatacatgtctgatagaagtgggcagaacgatacggacaacagtttcgccggcatctcgtttgaaggggtgaatgccgtgccgccgcagtctggtgagaacggcgatacgatcaatctcgccgacgtggccgatgtgtccgaacaggacgacgtgtccaacgccgccaccgagaccatgccgccgttgaatttcgcatcggaccagacccagccgttccagtcattcccgacggccggtgccgccgaaaccacgcctgccggaactgtccccaacggagctgttcccactggtgccattcctaccggtgacatgccctcatccacgcccgctcccgccattcccgtgctcaccatgccggtcgaaggagaagccgtcgtggccaagaaacgcaaactgccgctgatcatcaccggaatcgtgctcgccgtgctggtggtcgccgcaatcgccggcttcttcaccgcacgctggtacttccaagacaaggccgcgccgggcgtgaccttcggcggaaccagtgtggccggacagaccgccgaccagctgaaaaacacggtgacggccgccgtgaagaacaccaccgtgaacatcaaggacggcaacggcaacaacgcttccggcagcctgagcgacctcggcgtgagctacaacgtcgacaagacggtcacggaactgctcgccgccaagcaccagaccaacggcgcactcgaatacatcaacgaagtcaacccgttcgtcaagaagaacgtgccgctgaacgccaagtccaacaagctggccctcaggacgttcgtcaccgacaaattcgtgcaggacaccgaccgcgcggtaccgtccaccgcatcgtacgatgccaacgcgcgcgccttcgtcgcagtggaaggccgcggcggcaggtccccgaaggtggacaacgtgatcgacgcggtcgccaaagccatcgcgaacccggggcacagcggcagcgtgacgatcacgtacgaaaccattgacgtgccggtcgcactgcctgaagcccaaaacgtggccgaccaggcaaacgcgcgactgaatgcgccgattgtgctggacaacggacaaggcaagaccttccagattccagccgaagtcgtggcctcatggctgaaaaccgacgccgacctcgaacacggcacgctttcgctgtcctacgatgacaacgccatcaccaactacgtgcagcagcaggtcccagcccagctcaaccaggacgcggtcgaccaggaagacgccgtcgacaacagcggcaaagtgctggccaccatcgtcaaaggcgtgaacggcgtgaaggtcaagaacatggaggcgctcgcaccgaagatcggcgaagcgctcaaaaacggccaaggcgccaccattccggtggacggcgacgtgcagaacttcaaaaccgtgcagaagaagagcgaataccgcatcgtggtggaccgtaccgcgcaaactgccaccgtgtatcacaacgacgaggccgtcaagaccttcccggtgtgcacgggcaccaccggcaagcacgaaaccgacctgggcaccttctacatctacctcaagtatcagatccaggacatgaccggcctgaacgacgacggctcgcgctacctgtccaagggtgtgaagtgggtaagctacttctacggcggcgaaggcttccacacggcaagctggaacaattacggcatcgcccacggcgacccggcgcactacggctcccacggctgcgtgaacatgtacgaagccgattccaggtggatctacgacaactgtccggaaggcaccatcgtgcaggtagtcggcgccatgccatccggaccggtacgctgacccgttacgcgtggcgcgggtgcgcggcgttcgcatacgccgtacaatgggcggcatgagcgaagcaaacgatagcaaagtgaacctcgacgtgcccgagcacctcgaatactccgacgagcacgtgtgggtggattcctccgttgaacccgccatggtgggcgttaccgaatacgccaccgaacagttcggcgaactcgtgtacatcgatttgcctgaagtcggtacgcaggtcgaagctggcgacgaagtggcggaattcgaatcctccaaggcggtcaccgcgctggtctcgccggtggctggcaccatccgctacgtcaacaacgaggctgcggacgatccgagcattgtgacggacgatccgtacggcgagggctggattttcaagatcgagcttgaggatgacgagcctgacctgcttagcgctgacgagtatgccaagattgtggctgactgaatagcacggacgcctagttttaattacggctgcggccggcgggtgcgatgcgcggcacactcaaggccgttcggccgggcttacggtcgcgcatcgcacccgccggccgcagcctttttatgggaagtgccttgcggggccctgaaagttccctgattttctcggtggcgttactgtttgttcgaacgcgacctctatagtgggcatatgagtgaaattcagccgttgccgcagttcccgccgcagcacgaccagcagcgcgaacagcagcgtatgggggagcggatggacgattcttgcgatgacatgcccaccgtgccgattccggcacgcaaggtggtcaccaccttcgacgcggcctccagacatgagcgtcttgaagtcaaaccgccgctgaccaggctgttccgccgcacgatcaccaaagcattcagtgtctggctgaaattctcgaccgcattggtgcggtcgctcgactggtatccacgtgtcgaaccctacgtcggctatggcaccgaacactactcccgactgatttgccgtaccgtatacggcccgttcaaacggcaggccggccgcctgattcgcggcatccgtggcatgctgatggtgccgtccccgcataccaaagtgcggatcgccatcgatgacgtgcccatcgaaacagtgcaggtgggtgcgtcggaagtatacgacgcgatcgacagcaatcctgatatttccagcgaattcgcggcatccgacgatgccggctacctcgacctcgtggccgagcattcgctcgaaccgggcatccacaacgtctcgtacaaagtgcgcagccgcaagccggtcaacgccaatcttttcaccattcccagcggcaccaaagtgggcgtgatctccgacgtggacgacaccatcatggtcacgcaggcgccgcgtctgatgaaggccgcctacaatctgctgctgcttaatccgcgcaaaaaagtgccggtggccagcatgaacctgctgttcaaccgcatcgcggacatgttcccggacgcgccgttcttctacctgtccacttcgccatggaatgtggaaagctcgatccgccatttcattacgaaccacggttttccggaagggccgctgctgctgcgcgaccttgacccgaggccgaaaaccttcattccgtcgggcgtgcagcacaagcttgaatacgccgagcagctgatggcggattttcccgatatgaagttcattctgatcggcgacgacgggcagaaggatccgaccacatacgccacgatcgcacgccgctacccggggcgtgtgctggcgatcggcatccggcagctgtcaccgcgcgaagtgaccggcaatttcggttccgtcgccgggcgcgtggccacgcagccgatgccggtcaccgacgtgccggtattcacgggaacgaccggatcgaacatcatgaaaaccatgctgccgttcctgaaacaacagatgggcgtctgactttttcgtacgcccagagcaggggttgcgtgccgcgtgggattgggaatgcaatgccggtataatcgcgtgcatgactgattttcggggtgaacagggcgcaacgggcgcgcgagaaagcgacgaaagcgtgcaagacaaatgcgggatgccgatcgcgaagcgtgtgccgaaggagcgcgtattccacggcgacaccttcatcgacgagtacgaatggctgcgcgacaaggaatcgcatgacgtgcaggattacgtcgccgcgcagaaccggtattgcgagcagcgcatggaaccgttgaaaaccctacgctccacactgttcgacgagctcaagtcgcacgttcaggaaaacgacatgtccgtgccgacacgcatggatggctactggtatttcgtacgcacccaggagggccagcagtatgcggtgcaatgccgtgtgccgattcgaagcgcagacgattgggatccgccaaccattgaaatcggcgtgcctatcgacggcgaacaagtggtgttcgacaccaatgccgaagcgcaaggccatgatttcttccgtatcggcggcatggatatttccaaagacggacgttggatgctgtacggcaccgacaccagcggcgacgaacgttacgatttccgcatccgcagcttggaaaccggcaaggaactgccggaagtgttcaagggcatcggtggcgcctgcttcacaccggacgcgcaatgggtgttctatgtgaagctcgacgacgcgtggcgtccatacgcggtgatgaggcaccgcgtcggcacccccgtcaccgacgatgtggaagtgtatcacgaacaggacgaacgattctgggtgggcatcggcctgtcgttcgacgaacgcaatctggtgatcggcaccggatcgaaaaccactaccgaagtgctgctgctttccaccgacgatccggaaggtgaattccgcgcgttcattccgcgcgagcaggacgtggaatacgacgtgagtttcagccgtttcgaaggtgccggcgaacgcggtgaggatattccgctcgccgtggtctatcacaatgcgttgaacccgaatttcgaaatcgatgtgatcgacatgcgctcccatgagcccccgtaccgtttgggtgagggcgtgcgtgtggccgtcggttcgccgtacggatgcgagtatggcgacgaggtcgaaccgggcgcttctgggatgccgatcggcacaccgtattccaatccctgcaatccagccattttgcagggtgcgcatggtcttggcattgaggggatctcgattcaccggcattatgtggcgctgcagtaccgggcggaaagcctgacgcatattgcggtgatgacgaaggatgccgctgcggaggattttcttgcggggcgtccatggaagttcaccgagctggttccccacgcgttggaagacgattgggatgtcgacgagtcggtggacgagatcaacgaggaacgtgccgaagtgtggggcgcgctcgaccaattggccgccgcgcaaggcgaggggtcggccgtgcatggggtttcccgcaaggcgatgacctcatcggatggcgcgaccgccgatgcgatgccgggggagacccggcgcttgtattcgattggtgtgggaggtaatccttcgtatgatgcgccccgcatgcgctactcgttctccagttacacgcgtcccggcgaactgcatgatatcgatccggcgaccggcgaggatcgcctgttgaagcgtgccacggtgcttggtggatttgaaccgcgcgaatacatggagcgcagggtgtgggttaccgcccgcgatggcgagcgcattcctgtttccttggtgtggcgcagggatgtgcccgcgtgtgattcggcgatgttcgttaccgggtatggcgcgtatgagatcagttcggatccgggattctcggtgtctcgcatcagcatgcttgatcgtggtgtgctttatgcggtgccgcacattcgcggcggcggtgagatgggtcgtgcctggtatgagcaggggcatttgctcaataagaagcattcgtttgaggatttcgttgatgccgtgcgtgcgttgcagcgtgccggtttggcgtcgcctgctcgcacggtggccgatggcggttccgccggtggcctgttgatgggtgccgtggcgaatatggctcccgaatgtttcgcgggcgttgaggcggatgtgccttttgtggatgcgttgacgtcgattcttgatccgtcgttgccgttgacggttacggagtgggatgagtggggcgatccgctgcataatgcggacgtgtacaggtatatgaaggaatatacgccgtatgagaatgcgccgtctgatgcaaatgatgcgcgggttgcggtttttcccaagattttcattaccacgtcgatgaatgacactcgtgtgctgtatgtggagccgatgaaatggttggcccgactgcagcgtgcgggcgtggatgccgtggcgaagattgaggttgagactggtcatgggggtacgtctggaaggtacaagcagtgggaggagatctcctatgagaatgcttggtgtctttcgatgatgggtatcacgcattgatccggtttgtgggacctttcatgttcggatgaggtcggtttcggaacggtctgttgttatgtgacggggtgcaccgtatgacgcaccccgttttgcaaacgcttccatttgcagtttgtttcatgaaacattgaaacagctcgggtgattgttttcggcgtttcttgcataatcctccgatttaggggtgttccgtcaaacgttttttccaacttttgacggcatgttaaaccttttataaggtcatgcttgcacctgttttcagagtgtttcattgtctgtgtggggtggtctagtagggtccagagaaatagcaggtttacgggtaaaaccgactagattgcattgcgaccagggggaagaatggcaggcatgcataaagccgtaagtgagcggcatggaatgacaacgattgccgcgttggtggcaatcgttgcgatgatcttcgcaagtgtgatcgcagcgccgcaacgcgcgtatgctgagggatacaatatcagcgatctcggttgggttgacaaggacgacacctccttcgaaatcagttccgacggaggcaagacgtggaagccgtacatttccggcatgcaggtcaactacggtgatcagatccgcaccgaactgcattggaaagtgccgaacgacgtcaaaatcaacgagggcgacaccttcgtctacgaccttcccagcaatctggaatacaaatcgaacgagaaatacccgatctacaacggtggcgacgtggtcggctactacaccatcgacggcgacaaaatggtggccacctacacccgcggcgaatcggcggggtccaacatcgaagcgttcgtgaccactgacggaaccatcacctcgaacaaaaccggtggttcggctggcggcgataccagctttaccttccccggatatggcaccatcaccgtgaacgtggagggcaaacacagggtcaacgtggtcaaacgcccggcaatctccacttccgacgcatccacctacgatttcgttttggaagtgacctctacaggcacgaacaccggcgtgaccatagacgacaccatgggcggcctgctgaccttcgtggacggatccgtgcacatctacaccgacgccgactgcaagaacgaatacacgggcgcatggcaatcctccaaaaccgacgaccataatttcaacgtcaccatcggctccatgggcgacggtgagaaactatacgtgcgctactcggtgaacgccgacaaagacagcgtcatcaaggcatgccgcgaggccggcaattgcagcaatgccaccgaaaacaaaaacaaggtgacctattccagcaacgaagacgtcaacaagaaggaaaccagcaactccatctggttcaactacagcgactggtatgtgaacaaaagcgcaaccgcagcaaaagacgaaaatggcacgcaaggcttcacttggaacatcaccatcggcgctggcgaaggccaatccgtcgacggagccaccgtcaaagatctgctcgacaagaacaacctcaaggaaccgaccggagatctggtgctcagctgctacaacagcggcgactggaaatccgtgtgtccgaccggctcgcccggcgcatatacggacgacgacccgtacaatccgcagcattacatcaaacttagctggagcgatctcgtagcaggcaccgtgaccctgccctccggcggctacgaccatttccaaatccagtattggaccgaagcgaaaaacgtgccggtcgaaggaagcggcgaacaccagaaatacaagaacgaagtcaccgtaaaacctcaggatggaaccggcaaaacagccacggccgaacctcaactcggcacggacgcggtcgaactgaagaaaacatgcacgtcgccggcatccgaagcgaagaacctgacgtgggtgaccagcatgaaagccttggaagacctcaccaacgccgaactgaccgacaagctggatgtggacgacagcggcaaggatctgggatccaagcaaaccttggtgaaagacagcattaaagtgtacaccgacgccgccctgacgcagcaatacgcgggcggatacacgacagaggccaccgataggggattcaccatcgtgttcgcatcattgcccaaaggcactacggtgtacgtgcaataccagtccaccgtcaacgacggtgtgaccgacgaaaccgtgtggaaccgagcttcggcattgaacaaaacctccacggcgaaacaccagcatcgcggcgacgtgctcggcaaggaagacgccaaccagtattgggaccaatacgggtacggctacaccgccaactccaaaggcgtgatccgctggcgcatcaaagtgcatgacgtgatgtcggacgccgaaaacatcgtggtgaccgatacgttgcccgtccacacgcggtacgacgcgaaatcgttgaagatcttcgacgcttccagcaccacaaaaatgctgtccggagtgagcgccaaagacaacggcgacggcacggtgaccttcaccatagccaagggtaccccggcgttcagccaggcgaagacctcggctggtgtgctcatcgtgtatgagacgagcatcgacccgatcaccgcacctgattggggaaattacgagaacaaggcgcacatcgacattgatggcagcgccggaggcgacgcttccgccacagtgggcgcgagcaagccgaaacttcttgacaaaaacggcaaatacgatgccacgaccgcgccgaacgtgaactacacggtcaaagtcaacccgaatgcggacacgcttaacaaaggcaacaacctcactctgaccgacaccatgggtcaggcactcgacctcaacgccaacagcgtgtcgatcatggactccgacaatggaaccgccatcaacggtgcaacatggtcatacaatccgcagacccgcgaactagtgttctccattcccgacgcccgtgcatgcaccatcacctacacggccgcggtgcagctcaaaccaggcgaaagcttcggatcgctgggcggcaacaaaatcgtgctcgccgggtatgagaacaacggcggaacctcgcagaacacaatcaccggaaccgtacagcagagcaaaggcggcatgaaatacgaccagagcacactgcagatctacaagtacgcggatggcgatctcggcaagccggcgggcagcgccaccttcaaagtggaaagcgtcaccggatgcaacttcgtgtcgtctacggccgatgccgacggcacctgcaatggtacggttggcaaagaaatcaccaagcagctgaccacaggagcatccaacggactgtccgaccgactgcagctggactacgacaccgtatataaggtcaccgagctgacaggtccggacggcaaagtgcccggcagcactgattcgcaatacgagaaatccgctccgctctatgtgatattccccggacatgacgcgcagaccgctgccggtgcatacgacggacgatacgacaacaaaaccgttaccgtagacgggcaaagcggcaaattgatcgtcgccgtagccaaagacagcgacggcaagacgaccacattgggcaactaccgttggaactgcagcaacgaccacaaaacgaagttcaaggtgcaattcacaaaggtggatgcggcgaatgccggtgtacccgtcgacggtgccaccatgcagctgactcgtgtcggatcgtcgcaggtggaatccgattggacatggaccacctccggcagcgagacgaaaacgctcgaactcctgcccggacggtacaagctgaccgaagccaacgcaccggacggataccaagtcatggatccgatcatcattctggtcggcgaagacggcaccatcaccgtcgacggcaaaaatgtgaccggtagcgacggcatcggtcacgtgcaggcggaggacgcaccgaaaaccacgtcgttgactgttacgaaaacatggaacgacaataacaaccaggacggcaaacgtgcatccgtcaccttcgatttgtaccgcaagaccgacggcgatgccgattatacgaaagtcgacgggcaaagccgcatactcaatcccgacaagaacgataacgtgcaatggacgggactgccggtgaaagtcgacggcaaaaccgcggcctacatggccgtcgaaaccacgacgctgggcgggtacgactcgcaatgcgctgacgtgcaatacaacaccgacggttcggctgccaccgaacaatgcaccaacacgcacacgcccgaaaccacgtcgatcggcgttgaaaaagcatgggacgacgccgacaaccaggaccagaagcgccctgacagcgtaaccgtgcatctgttgaaaaacggagaggaaaccgatcaaagcgtgacactcgatgcggttggaaactggcggaacgacagcgcgttcaccaatctgcccgtctacgaggatggcaagaagatcgtgtataccatacgcgaagatacggtgagcggctacaccacgcacatcaccggctcgcaaacccaaggtttcgccatcaccaacacgcaccaccccgaaaacgaggaggtgtggttctccaagcaggacctcaagggtacggagatcgcagatgccaccatgcgcctcaccggtacgctgaatgatggcaccgaattcgaaacgcagccctgggtaagtgagcgggataagtcgaagagcatcaagctcaagcccggcatctacaccttgaccgaaaccaaggcgccggatggttatctggtagcggatccggtcgaattcaaagtcgtgagcgacgccgtcaccggcaagctcagcgtgcagatcaagcaaaccgatggcacatatgccgacgtgcaggacaataccatcgtgatgaccgaccagtaccggacgcatcaggtgaccgtcaataaaaacagtctcaccagtggcatcaccaatatcgacggcgcgcagatgagcatcaccggcaccaccttggatggcaaggcgatcgacgagatcacctggaccagcaaaggcggcgaacccggcgaactcaccctgctacccggcacctacaccctgcgtgaaaaggtggcgccggacggctatgaaaccgcggatgacatcgtattcagcgtcgggctcgacggcagcgtgaccatcgacggtaagaagcaggattccaataccgtcgtcatgaaagacaagccgggcaaaagcggcatcctgttctccaaaaccaaggtcggcggcggcagcgagctggctggagcggaattctccataaccggcaaaactttcgaaggcaagacgatcgacgagatcacctggaccagcggcggcggactgccgaaacaattccagctgcaggacggcgtctacaagctcaccgaaaccaaggcgccggtcgggtatgaaaaggcgaacgcggtcaacttcaccatttcccgcggcgaagcatacgtggacggcaagctggtggatggcaacaccatccgcgtcgaggatcgcgtggatacgaccatggtgcgcgtgcgcaaaatctggtccgaccacaactattcggagcgtccgacatcggtgacattccacctgctgcgcaactccaagcagctgcaagatgcgaagtacacgcggacgttggacaacaagaacaccagcgactggacgtacacgtggaccgatctgccccgatatgatgcggacggcaacaggtacaactacacggttgacgaggaactgacccaagagctcacaggtaaggaataccgcgtttccgtgatcaaacgtccgtacatcgacggcgccgaattcacggtattgaacattcgggagccggaaacggcaagcatcacggtgaacaaaacgtggaacgatcaggatgacaacgatggcaaacggccgaagacgctgaccttccatatttggggaaccagcaaacagccgaagagcggcagtaccgacgaaacggaagacgtgaccgaacaattggtggtgcaaaccgtgcgaaccaacggcagcaacacgcaatcgtggacgttcgaaggtcttcccaagcagaacctgtacaacaatccgtacacgtatacggtaaccgaggaatccgtagatggctatacggcaagcgacgtgacgctcgccggcggtacggaaacacgctgtgcggtgacgagcacggtcaaatcctgcgcgttcgatgtgaccaacacgcatacgcccgaaaccacgacattgagcgtggacaagacgtgggatgacactgatgcgcccagcaatgtgaaacggccgggcgacaaggccacgatctgggtgctttccagcgtgtggaccgatgcgaagaaccagacgctgcccggatggccctcaccgcaacacaacagcgagtgcaagaacaccggcgcgacggatggcacgaatccatggggtgtgagctgcatggtgctgacctcggagaacgccaaagcgacgcaggccaccacggccaacgtcaacggggctgacggaacaagcgaagcgaccacttcgcaagaggtgagcgcgaacacgtggacctacaccttcacgaacctgcccaaatactacaagggcaaggaaattcagtattcggtgaccgaagaggccgtgaagaactacacgccgacgctcaccggaggcaaagtcgctgcggctgacggcgccgagggcaaggccaacgagtcgggcgaatccgacaaggcggatgaaacaagcgaaagcggtcagaatgcggaatcctgggcgtacacgctgaccaacacctacacgccggggcataccagccacagcgtgcataaagtgtggaaggactacggcgacagcagcaaacgtccgaaagcggtatatgcgacgttgtatgcgaacggccaatccaccggcaagacggtggcgttgagcgacggcaacaactggcaatacacgttcaccgacctagatgaaaacaaggtgtacacggtgaaggaaaccaacgaaaagggcgaagcgatcagcggagtggacggctactgccagccggtcatcagcgatgaccgaaaaaccggaatctccaccatcaccaacaccatctccatcgtgcttccctccacgggcgggcaacgatggtgctacggcacacttctcgcggtagtggcgctcggcatgatcggcatgggctacggcatcgccaaacgtaacaagaccaacaaggaaggagacgcgcgatgaggcgtcacggagcgaaacaggggaatcggatggattaccgcatggcccgtcacgcggctgcacgacataccggcatgcgttcggtgcgccgcatcgcggccgcggcacttggcctggcgctttccctcgcggggctcagcgcgcaatcggtggcttttggcaatgacgatccgaccaatccggcagccactgacgtgaccatgatcgcattccagcaatcatggaagacgattggcgacgaatgcacgaaaacctatggtccggaaggcgtgaaatacgtgcaggtctccccgccgcaggaatccatccaaggcacgcaatggtggaccgtctaccagccggtcagctacaaactcgactcgcgtttcggtacggaagacgagttcaaaaccatgatcagccaatgcgacgcggctggcgtgcaaatcgtggccgacatggtgctcaaccacaccaccggacatgacgtgtcatgggttgacgaccagtatggcgtggccggaaccgaatacaacggatcatacggacgatacccgggaatcggcatctaccagtatgaggaaagcggcaacaaccaccaatacggccttcccagcggcgacttccacacctgcaagtcgaacgtgtcagacaacatctccgactacaccaacgccgacgaagtgtggaactgccgactgtcgaccatgtgggacatcaacaccggcagcgaccgcgtgcaaaacatccaagccgaatacttggcgcacctatgggaagacggcgtacgcggattccgcatcgactccgcaaaacatatggatcccaacgacatcgcatccatcaaacgcaagttcatgaccaaagcgggcattacggacgaacaaagcttcccatggtcgcaggaagtcatctaccataatggagaatccgaaaaattcgcgccggaacgatacgaaaagaacggacaggtcaccgaattctcgtacgcgtactcattgttgaaggatttcaacggatccatcaccaatttgaagaacatcaccagcgatctgctcgacgacgccgataatgccaccgtattcgtgtccaactgggataccgcacgcggttcggaaacactcaaacccgtttccggcgcccgatacgagctcgccaacgcgttcatgctcgggtacgactacgggcatccgaagatcctttcagactacgcattcaatgaaagcacccaatatgatgacggcgtcaaggattcgactgacaccaccgtgccgaaaatcagcatggacgacgtgtgctccacgcaaaaggacccaacgcagatggagtatggcgattggaactgccaacagcggtggacgtcaatccgaggcatgatcaaattccataatgccgtgaacggcaccagcgtaagcaactggcaggaatccggatccaacgacatcgccttcgaaagggttgacgccaacgggaaaagcaagggtctgctcgcattgaacaacaccctgcaggagcatgacgtcgactatacgacatcgttgccggacggggaatactgcaacgtgtacgcttcccgcacctgctcgcaaaccgtgaccgtcagcggcggtcacgccaaagcgaccatcggcaaacgaagcgccattgccatctatgccggtgcggtcaagggcgcgtggacggaaaccacggaacctagcggcacctacgctccgcaatacaaggattcgccgaacagttcgctgataggtgacaaaaccctcaccatctactacaagcccgacgaatcgtgggacgggcaggtgtatgtgcgttacacgtccgacaacggcagcggtagcattgcgatgagcgcggtcgatgtagccgattccacgaatgcggcaggctggtataaggccgatctgccggaaggggccaacctaagcgcggtgaaataccatttcgcatccacacaatccggggaatctgactccacggactggaacgggggcaagcggggaacggaatatacggcacaggtcggcgccactatgatcaacgtcagcgggcaccggcagcagacgggcgtgccctacacgcgcaaccatgcggcgaaaaccaaagtgaccgtcaacttccgttccgtctccggcgtcggtgagaacgcatccggcgtgaaggtgtggaacggcgacgacatggaaagcgccacgtatattccattcgaaagcacgccaacgcaatacggcaggaaagccagcggcgaactggacggcgatctggcaacagtgcatttcagaatcgtggatggtgccgatgcgactggagcgtccgcgggaaccgtcgaacaatatgaggcgagcgtgtggaaactcgccaaattcggtgacgcgcatgtgagcggtgccatcgaagcgtgggtggacggcgcgcaacccgataccgcttccgaccgatcctcggaaaaagcgtctccctcggcgacaccgcagccgaatgacatcaaaaatccgaaaaacctgaccatcaaactgcattattaccgtcccgacggcaattatcaggaatacagcatggaatccgacgcgtggaaaggctgggatctgtggtcttggtatgcggaaagcaccagcggcgaatcccaggaattcacctcccatgacgaattcggcgaggtcgcggaatacacgctgagccagacagccaaaggcgtgcgcaacccatggttcatcattcgcaacggtggctcatcatggaccggcaaggactgcgacgacaacgatcgcgagattccggaatccgtgatcagcatgaccgcgggaaacgtggaaaacggcgtcgcggaattctggatcgtcagcggggatccgaccgtgtacacgcatccggtgaacgtggccggaataaccttcgacacccaaggcggcagcagcgttcccgcacaggcggtcgccatcggaggcactgcgagcgttcccgaaacgcctactcgcgacggctacgtgttctcgaagtggaccacggacgtggccggtgaacatgagtatgatttcgccaccacggtgagcgcgccgataacgttgtatgcgcagtggacggaagcgaaaaccgtgaccttcgacgtccaaggcggcagcgagatcgccgcacaacaggtgcaaacagggaaattggccgtacgaccggaaaatcctgagcgcgtgggatacgcgttcgcgggatggtataccagcgccgacacttcgggtagcgaatacgatttcacggctgcggtgaacgatgatgtgaccttgtatgcgaagtggacgccgaacatgtacgccgtgaccttcgactcgcaaggcggcagcgcggtcgatgcgcaacaggttgcgtacggtggttacgcgacgcaacctgccacaccgacccgtgacggatacacgttcgtcggctggaccacggatgcggccggcaccacgccgtacggtttcggcatgcccgtcaccggcgatatcacgctgtatgccaagtgggatgatgcgggcgcgacgtaccataccgtcaccattcatttgaatgacggcgacgattattcgtcggacctgccgcaggatatgacgttgttcgtcaaggaaggggagaagcttacgatccccgattccgctccttcccgcggtggatatcgtttcgcaggattgaccagcgacgaacagcggaagacggactatgatgctggcaccgccgtaaccgccgacatgaccttgtatgccaagtgggtcaagacatggacggtcaccttcgacacggccggcggcagtgccgtgaacagccagaccgtggacaatggaggagtggccgttgcgcctgatccgtcgccgacacgcgacgactgccggttcaccggctggcagtatgacggcaaaagctacgatttcggctcgaaggtgaccggcgacatcaccctgaccgcgcagtgggtgcgcaccgcgcaccagtggaccataaccttcgatctgaacggagggcatgcgcccgccggcaaggatgcgaagaccctgtacgccgagcggaaagtctacgacggtgattcgctggtctcgcccacggcggacatcgccaacgagcctcagcttgacggctacaccttcgaagggtggagcacggtgaaagacgacgcgctcgcagtcagcgtggtctcctttgattcgtccgggaaatcgttgatgcccatcgatcgcgacggcacgctgtatgcgttgtggtcgcgggagaacagggtagtgaagccggaatcgtccggttcgacgggatcttcgacgagctattccggcgcgtattccgattcctacacgggattgaacgggttggcagcgttcgatgccatagtgagacaatcgggcaaattctcgggcacgaatttcggttccgtcgccgaggattatgtgaaacccaagagcgttcgctgagtgttggaatccaagggtggggtcggccttcatgtcggccccctttttttcatgtacggtgtatggattgttgcgtccggatcattgaatcgttcgttgttcgtggcgtttgaagccgggtgaaaccgtattcgcacatgaacgcggcaaggagtgtccactagttgagcgttacgtgtccacgtgctggtccgttgactagagtcgcgtgctatgagtgattctgcaaagaagtacaccatcgccgtcattccgggcgatggcattggcaaggaagtgactccgtgggcccagaaggctctggagaaggcggccgaaggcgtcgccgaattcgagtacgagcatttcgatctcggtgccgagcgctatctgcgtgacggcgcgatcctccccgaggaggaagaggaccgtatcaagaagaccgatgcgattctgctgggcgccgtcggcgacccgcgtatcaaggccggcatcctggaacgcggcctgctgctcaagctccgcttcgacctggaccagtacgtgaacctgcgtccgtccaagctgtacaagggtgtcacgtcgccgctcgccaacccgggcgacatcgacttcgtcgtcgtgcgtgaaggcaccgaaggcctgtactgcggcgccggcggagccgtccgccgtggcaccccgaacgaagtcgccaccgaagtgtccatcaacaccgcctacggtgtggaacgcgtggtgcgttacgccttccagctggccatgaagcgcaagaagcacgtgactctcgtgcacaagaagaacgtgctggtcaacgccggcgacatgtggcagcgcatcgtcaacaaggtggccgaggaatatccggaagtctctcacgattacctgcacatcgacgcgaccaccatcttcatggtgaccaacccgtcccgcttcgacgtgatcctcaccgacaacctgttcggcgacatcatcaccgacgaggcaggcgccgtggtcggtggcgtcggctattccgcttcgggctgcatcaacgcgtccaatgagtatccgtccatgttcgagccgatccacggttccgctccggacatcgccggccagaacaaggccaacccgaccgcagccatcctgtccgcagccatgctgctcgagcatctcggattcgacgacgctgccaagaagatccacgtcgccgttgaggctgacatcgaggagctcggctccaccacgcgttccaccgacgaggtcggtcgcgacattctggcgcgcatgtgagacgacatataaagatatgtgacggcatgtgacggttcgaaaagccgagaaatcggctgattccgacttccgtcccatcctttgagacgcccaccgaaaagggtttttcccgaatcggcgggcgtcttcgcatattcggggatttttcaggggccacctaaggtggaatcgggtggaaatgggcaaactttgggatattgttgaggcatgagtgataacaacgccgatttcaatggtgccggtcaagtcaacaatccaacgtcggataacgcagcccaggccgactacaaccaaccgtacattccacaacagaacgatgcgcagatgaaccatccggagtcgcagccggaaacccccgcatacggtcagaactccgccgcatacactcagcccgctcagccggccgagcctgccgttccggcgtacgatccgaacgcttccgcatacagccagtatggccagaccgcacagtcggcccagaccgctcagccgtcatacggtcagccggcgactccggccccggcgtacggtacggctcccgtctatacccagcccgctcagccggccacgcccgctgctccggcgtatgatccgaacgccgcatcgtacaaccagtacggtcagtatggccagccgtcccagcccgcccaatctgcgcagccgtcgtacggtcagccggcagccccggcgtatgaccccaacaacgcttacgcccagccggattacaaccaagcgaactacggacagcaaggctacgcggccccgtcttacaaccaatccgcctacacccagcccgcctacgcgcagcagccggcatacggccagcccgtcgcaccggccggatacgcccagaagtcgaaactggccgccggtctgcttggcatcttcctgggctgcttcggcgtgcacaacttctacttgggcaacaccggcaaggccgtggcacagctgctgctgactgtcatcggctggattctcatcatcggcccagccgtcgcaggcatctggggactggtggaaggcatcctgattctgtgctcccactacggctcgcaatggcaccgtgacgctcaaggcgttgaactgcaggattgatgactcgaggactttacaaacagccgggcggcaaactcgttggagtgactgtccggctttctcatgccgattcggattacgccgattcggattacgccgattcggactatattgattcggctcatacgaatgccgtgaaaacggttccatacgctgggccggctgcatcatcgactgttatcgaatgccatatcgacggcgatttcttcctcgacggggacgatgccggaacgcggaatctcttgcattccatggaatgtgcgctggaacagtgcgcggcccgttgcctcagcggttcgatggtttccgaacgtgacgtgaccgccgccgtcgaacggacgatgctgcaccatccggacgtgcgcatcgtcggcatgggcgcgcgtggcatcgccatcgcctttcaacgtgcgattgacggcatcgatggcgccgatggcattgccggtatcggcggtaatgatgttacgaaagtggaaccacgcgacgacctgcgcattcggcggcataccagcccaatggaaaccgcagaaaccgcggaaatcgcaaaaaacattgaaaacgctggaaccgcggaaagtgacgaaaacgctggaaccgcggaaagtgacgaaaacgctggaaccgttggaaccggcgacatcgccgaaaccggcaattgggcggaatacgcgcgacgctggcacgcactcaaaccgaacatcgtgcacgacgacccccgcaaaccgcaggaacaaatggacctcgacgtcgaatgggcacgcgaagtggctgccggaacccgcgaacccaccctgcgtttctgggaatgggccgagccggccgtggtcatcggcagattccagtcgctcgaagacgaagtcaacgtgcacaccgcgcaagacgaaggattccacatagtccgccgctgcaccggcgggggagcgatgttcatcgaaccaggcaacaccatcacgtactcgctgtacgccccgctcgacttcgcccacggcatgagcgtcgaggaatcctacgaactctgcgactactggctcgtcgaagcgttacgcgccctcggcctcaacgtacgattcgccggactcaacgacatcgccacacaatacggcaaactcggcggcgccgcgcaacgccggttcgcgcccacccacggcggacccggcgcgattctgcaccacgtcacgctcgcctacgacatcgacgcggaaaagatgacccgcgtgttgaacatctcacgagagaaaatgtccgacaaagcggtgaaatcagcggcaaaacatgtcgatcccatgcgctctcaaaccggcatgggccgagacgaggtagtggcgcgactggtcgacgccgccgttcgagttacaatgtagcccgaatggtcgatggtgcccgacttaacgagcgttggcatggatgtcgacaacggaaaacgcagaagcacgtcggaacggaggcacgtcgatggtcaccccgaatggaaccaatgggatcaatggttttggtggtttcgacgatgagcgtgagacgttgctgcacaccgcgctgttcaagcaggtttcgtccgaagaagcccgggaactgctgccgtatctgcagcatgccgaatacgacaagggcgatttcatcttccgcgagggagacaccgaccatcgcatgtatctgctggaggaaggccgcgtcaaactgaccagacaatcctccgacaagcgtgtgcagctgctgagcatccacgcgtacggcgaagtgctgggcgagattccggtgttcgatccgcatggcggaccgcgtaccgcttcggcggtggcgatgaccaacggcacgcgtgtggtctggctggaacatgacgcgctgttcgactggctcgacgaacatccgcgcgtggccgtggacatgctgcaggtattggcgcaccgcatgcgcagcaacaacgaacgcatctgcgatctggtgttcatggacgttcccggacgactcgccaaaacactgctcaatctggcatcacgattcggcgaaccggtcgaagccggcctgaaggtgccacacgatctgacacaggaggagatggcgcagctcgtcggatcctcacgcgaaacggtgaacaaggcgttgatggatttcgctaaccgcggatggatcgccagggaaggccggtccatcatcatctaccagccgggcatgctgattcgccgatcaagacgatgacattcggctggttttcggctgatttccaacttttcctaagaaattgtctgttttgtgagaaacccgtgacggcttccggcacatgcgttggcggggatgtgtttagtagacccgccactttagaatgggcgtcatgcccaagaagaagacccttaccgttcaacgtgtgctcgcattggtaatcgcatacatcacgttatgcgtgggcggcggcgttgtgacgagtattttctttatgcccgctgtgttcgccgccaataacgcggccaaagccgtcattccgtcccttgcggtcgaaggcatcgatttcgatgtgacctcgctcccgcaacgctcgacgatgtatttcaacgacggcaagaccgctttcgcggaattctatacgcagaaccgcgaggtcgtgccgctgaagaaaatctccaaagccatgcagcaggccgtcgtggcccgtgaagacaagcgcttcttcgaacataccggcgtggacgtgcagggcgtgttccgagcgttcttccaaacctacgtcagaggcggcgaccagcagggcggttccacgctgacgcagcagtacgtcaagaacgtgctgtccacccaagcccgtgaagacgacgatccgatcgccgaataccatgcgacggaagacaccgtggcacgcaagctgcgcgagatgctgatctcggtgcagatcgaaaagaaatactccaaagccgagattctgcagggctacctcaacatcgcgcagttcggccgcaacaacctgtgcggcgtggaaatggccgccaaacgctacttcaatgtctccgcttcggaactgaacgtgacccaggcggcgaccatcgcggcaatcaccaagaatccgcagaacttcgatccttccgtggaagccaaccagaaggaagccgaacatcagcgcaacatcgtgctgcagctgatgcacgaccagggctacatcacctccgaaaaggaattcaaagacgccatcaacacgccgttgaaggacacgctgaacctgcaggacgtgagctccggatgccagtcggccattgaaaacaccggcttcttctgctcgtacgtggtcaaccagatcctgaagaacaaggcgttcggcaaggacgacgaggctcgcgagaagctgctgaaggaaggcggtctgaagatcgtcaccacgctcgaccgcaacgccaacaacgcggccatgcaggcggcgaacagcaccgtgccggccacagacccgtccggattcgaagtgatgatagcggccgtgaagccgggcaccggtgaaatcctgtcgttcggcatcaaccgaacctacgacgccacggatgacgcccgaacggacgagaccaagacctccatgaactacatggtcgaccaagaggacggcggcggtatgggcttcaacgtcggctccacctggaagcccatcaacatggtggcgtggatgcagaaaggccactccatcaacgagtcgctcgtcacatccaccgtctacgacacgtcgaagttcaactgcaacggctacggtttcgtcggcccgtggagggtgcagaattccggcggcggcaccacctctccggaaagcccgctgcagggtctgatcaagtcgcacaacaccacgcaggcctcgatggcgtcgaacatcggtctgtgcgcgatcgccgacgcagccaaggagatgggctaccacaacgccatctccaacgcgtccgacatctactccgctaactcgttccagccgccaatgaccatcggtacggtgcaggcgtcgccgttgaccatggccaacgtgtacgccaccatgggcgccaacggcgtggaatgcactccgatcgccatcaccaaggtgaccgaccgcagcggcagcaaggtgaaagtgccgtccgcgaactgccatcaggccatcgacccggacatcgcgcagaccgtgtcctacgtgctgaaccaaggtgtcgtgcagcctggcggcgaagcgtcgaccacgcagcttgacaacaatcgcaagaccttcgccaagaccggtaccaacgagaacacggtgatggccaccgcaggtttcgtgccgaaccaggtcgcggcgttcgtcgcggtcgccgacgcgcaggacccgatcaacaacaccttcgacaacaagaccatcaacggcgtgtaccgcccgtcttggtacggcatgtacatcgcaacgccggcgtggaagcagttcatgaacacgtatcttgccgccatcaacgcgccgatcgacaacgattacggaaagggtgccgacaagtacacggtttcgaagggcgccaccagaacatacaaccagtaccaataccagcgccagcagaacagtcagcagcaaagccagcagcagaccaaccaaggccagcagcagcaatcgcagcaacagcctgctgagcagcaaagtgaccagcagcatcaatagttgcgattgtcggctattcatgccgactgcccgcattgactgaccgcactgattgcccacgtcaccggagcgtaaatcgcatggcaaagtgaacagtccatgaacgcccgccccaaccggcgggcgttctgcttacaatgcaatcggtaccatgcccgtcgcgtgggaacgcggtgcggatatcgacgattcaggcgataccaacgattcataagagagatgacaatgagcgaagacaagaagaacggcaagcagaacaagacggtcaaaccgttcgatccgatgacgttgcgtggcgtcaccgtgcgcaaccgcatctggctgccgccaatggacacgtattccgcattggcacaggacggcaagcccacgccattccactaccagcattacgtttcgcgtgcgatgggcggcttcggcatgatcatcatggaagcgaccgccgtcgcgccggaaggccgcatttcgccgtgcgatctgggattgtgggatgacggacagatggatgcgtggcgttggatcgtggccgacgcgaaggcagcgggtgccacgatggcggtgcagctcaaccacgccggacgcaagggttccaccggctgccacgcgatcggtttcgatggacagagcgtgccggaggagcaaggcggatggcggacggtttgcccaagcgccaacgcatacggttccctggcttgtccgcgcgcactgagcgtcgatgagatccacaccatcgtggaccagttccgcgacgccgcctggcgtgccatgaacatcggcttcgacgcggtggaagtccatgccgcgcacggctacctgctgtcgcagttcctcgacccgctcatcaacgagcgtgacgacgagtacggcggatcgttcgacaatcgcgtccgcatgctggtcgaagtcgtggatgcgattcgttccgtcgtgcccgataccatgccggtgctggtgcgcgtctccgccaccgattgggccgcaggcggttgggaccttgaccagaccgtcgaactggctaagattctgaaggcccacggcgtggacctgatcgacgtgtccaccggcggattgattcccgacgtgaccattccggtgaagcccgactaccaagtgccgttcgccgaacaggtgcgcagtcgcgcgggcattcccaccaccgcagtcgggctcatcaccaagccgaagcaggcgaagaagattctgaagtcgggcgccgccgacgccgtggaaatcggccgcgccgccctgcgcgacccgtattggccgctccgtgccgcccacaaactggacatgccggtcgaggaagccccctaccagccgccatacctccgcggcgccttccgctgaccctccttcccctcccccttttttcttattgcgaaaagtggataacaccccaacgcaacataacaaaaaaacgagtgggagggcgggcgtcctgttcacgaccgtaagcctggccgaacggccttgagtgtgtcgtgaacaggacgcccgccctcccacggagacgcgcctctgttttttacttattaatcgcctttatattgtcgaaaaatcgctttttaaatcgcaacttaaatcgcaattaaaaaagtttcacgcgtcgatgccgaccgcctcgctgacatgttcgaacccgtcgcgcctgagcagttcggccagtccacgcttcaacacggtgatctgctgcggaccacggtacataagcgcgctgatgaacatcaccagcgacgagccgcaacgaatcttctcatacgcctgctgcggggtgaagacgccaccgatgccggcgattgcgaaccggtcgccatattcgcggtagacctgcttgatgcgttcgttgctggccgcgtagcacggcgagccggacagtccgccctcccaatcgcgcggaatggacatgccggtgcggtccttctgcagattggcgatcgacagtccctgcacgttgtgctcggcgagcacgtccagcagatccttgaattccggccacgtcttattgagcggcattttgacgagcgtcggctgcggacggtcgattttgtccagttcggtgaacagcttgtcgagcgcttccgggctttggttgaacggttcgccggccatggtgttcgggcaggagatgttcacttcgaccatggcggtgcgtccggccgcgcggcgcatcgaaatgcagtaatcctcgatgccttcgtccagatcgccggtcttgctgtcgttcgtgcgggcgatcgaaaccgacacctgcatgctcttcgccttcgtccatgcgttctcggcgcgcggaatcaccaccgcggaaccctcgttggcaaggcccacgtgcaccatcatcgaatcgtattcaggcaggcggtggaaccatgggcgcgggttgccggggcaggggcgcgacgtggtggagccgaccgtttcgaaaccgaagccgacgttgtcgagcagcaccggcatctcgcaatccttgtcgaggccggcggacaggccgaacggattggcgaagtcgacgcccatcacgttggtttccagtatcgggtcggtgtagtcgagcatttcgcggcatagccacatcagcggtggaatgttgcgggtgaccttgcagaaatcgatcatctggctgtgggccacgtcgggcgtctggttgaagatgaaatgcggtttgatgatgtgcttgtagccgaacgtgaaaaggtcggtggtggctttgttcactgcgtcgtgccaaaagttttcggaaacgtatgtcatggttccttattctcgcacgttttcattggtttcgcatggcattttgggcaaaagccggtgtgtgtcggtgtggcatataggacgttcgtttttgttcgttttaggctgaatttgagtcgattgtggtgcggctttgagcgaaacacgcgcgaaacgctcaactcagttgtatttttgagtgaacatgtgcgataatgttcatatgatttcgtcacaacgccagcatttgattttgagccgtctgcgtacccgtggtgcggtgcgcatcactgcactgtccaaggaattgggcgtctccgcgatgaccattcgccgtgacatcgccgatctggcggacaagggtctgctgaagcgcgtgcacggcggcgccgtcagcaccagcacactgctgagcgaaccgctgttctccgtaaagtcgcagatggacatcggtctgaaggacgccatcgcacaggaagccgtcaaatacgtggcccccggcgacgtgatcgccatcggcggcggcaccacggcgtacgtgttcgcacaacatctgctcgaatcgcagcaatcgtcgggcatcaccattcttaccaactccattccggtggcggagctggtgcaggcgctcgaatcgaaagacgtggaagtcatcgtgacgggcggcgtgaccacccgttccaactcgctcgtcgggccgatcgcagacaaagtggtcgcctcgctgcgcgtcaacaccgtattcctgggcacgcattccgtgtccattccgcgcggtttcctcatgccgaactcgctggaagccgcaaccgatatggcgatgatggacattgccgatcgcacgataattttgaccgaccacaccaagtggagctgcacgtcactgtcgctgttcgcacgttttgaccaggtggatacggtcatcaccgatgacggattggaccccgattcggtgtcgagaacaagggatttggtcaaagagctcgttctggcacgccaggccgagccggttcaggaaggtgaataatcacatgagtgatttcgtcaactacactccgggagaatatgcgaaggagcatatccgtatcacgccgaccacgcttgccgatggccgcgacttcttctatctcgatgacgatccggaatacgtttccggcgtcaagactcgcgaactgaaggatccgcgccaacttccgtaccgtttctccaaccagctcaacgccgcgggcgaggaagtgccgtacgcggctccggaaatgcgccgcgacccgctgaccggcgattggattccgatggccaccgcgcgtatgaaccgtccgatcaccgcaggtccgggcgcgacggccaaaggcaatccgctggccgcgcgcaagccgggcgatccgtaccaggacggcgaagtgccggacaccgactacaacgtggtcgtgttcgaaaaccgcttcccgtcgatggtgcgcgtgccgggccgttccgaagccgtggaatacgtcaacggcaacccgctgtgggagaagaagctcgccgcaggccgctgcgaagtgatctgcttcgacccggatgaagacggcctgccggcggacctgccggtctcccgcctgcgcaccgtcgtggaagcatgggcgttccgtaccgccgaaatctccaagatggagggtatcgagcagatcttcccgttcgagaaccacggtcaggaaatcggcgtctccctggcgcaccctcacggccaggtctactgctatccgttcatcgcaccgaagatggaagccgaactcaagcagaccgaagcctaccatgagaagaccggcggcaacctgctcaaggatctcatgaactccgaaatcgaggccggggagcgcatcgtcatgcgcaaccacagctgggtcgcctatgtgccggccgcggcacgctggccgctcgaggttcatgtggccccggtgcgcgacgtgctcaccctcgacgagctcaacgaccaggaacgctgggatctggccgtcatgtactccacactgctcaagcgcggcaacgcgttcttcgacaagggcgatggcaagggcatggacctgccgtacatcgctgcctggcatcaggccccgatccacgacaagcgccgcgagaactaccgcctcaacctgcagttcttctcgttccgccgcgccgccaacaaaatcaagtatctggccggctccgaatcaggcatggccgcatgggtgtccgacaccacgccggaactcatcgccaagcgcttccacgagctcggaccaatcgatatcgaaggctgaaagccaataaaacccaaaggacaaaacaccaatgactgctgttgaattcattgagccgctctcgcatgacgagggtgtgaagaacgcgaccgacctgttccgcgccacctacggtgaggaaccggctggcgtatgggccgcaccgggccgtgtgaacctgattggcgaacacaccgactacaacgcgggcctgtgcctgccgatcgcactgccgcaccgcacgttcatcgcgctcaagccgcgtgaagacaccaaggtgcacgtggtttccgacgttgattccggaaacgttaccgaagccgacctcgatggtctgcaggccggtggtgtggaaggctgggccgcctacccggtgggcgtggcctgggctttgcgcgaagccggcttcgatgcggtgcagggcttcgacgcggcattctcctcctgcgtgccgctcggttccggtctgagctcctccgcagccatgacctgctccaccgccttggcgctggatgatgtgtacggtttgggttatggcgcatccgatgccggtcgtgtgacgctgatcaacgccgccatcaagtcggaaaacgacatggcgggcgcgtccaccggtggcctcgaccagaacgcgtccatgcgctgcactttcggccatgcgttgcgtcttgattgccgtccagagctgagcccgctggagaacgtctcccagcaggaattcgatctcgacaagtacggtctggaactgctggtgcttgacacccaggctccgcaccagctcaacgacggccagtatgcccagcgtcgcgccacttgcgagaaggccgccgaaatcctcggcgtggccaacctgcgtgtggtcgccgacagcatcgccaagtccgacgatccgttccaggcgctcaaggaaacgctcgacaagctggaagacgacacgatgaagaagcgcgtgcgccacgtcatcaccgaaatcgcccgtgtcaactccttcgtgcgtgccttcgccaacggcaagatcgacgaggcgggccgactgttcaacgcgtctcatgattcgctcgctgcggattatgaagtgactgtgcccgagctggatattgccgtggatgtggctcgtgtcaacggcgcgtacggcgcacgcatgaccggcggcggcttcggcggctccatcatcgcgctggtgaacaagggccagggtcacgagatcgcgcagaaaatcgccgaccgctttgagcaggaaggcttcaacgcaccgcgcgccctgccggcatacgcagccgccgcggccagccgcgaaatctgattggaacaacggctggcgcaaccgcaatatataagtaatatattttgtatatataaagtatgtatgaaatatgtacttgcgattgcggggtggacgattgcggacgcggccgtctcagtatgtaacgcaatcgggtaaaaggcacgtgttttggcacgtgccttttctatacttaaggacacgtccggcaatcgccgggacggtattggatattcacacctcacgtttagggagttccatgaacaaggcaatcatcaccgtcgtcggccaggacactgtcggcatcatcgcccgcgtctgcacctatctttccgcgcaccaggtcaacgtgctcgacatctcccagaccatcatcgacggtttcttcaacatgatgatgattgtggattattccaacgcggacgaggaattcggcactgtcgtcgacgatctcgacaagctcggcgaggagatcggcgtgcgcatccgctgccagcgcgaagagatcttcaccaagatgcaccgcgtctgatccgcggcacacgtaagccatgcaagcaaccgaagccacgaatcgtaccaatcgtaaggaaaaaccatgctgaatatcatggaggtccacgagaccaacaagatgatcgagcaggagaagctcgacgtgcgcaccatcaccatgggcatcagcctgctggattgcgcagccgacagcgtcgacgaggtctgcgagaacatctacaacaagatcaccacgtacgccaaggacctcgtgtccaccggccaggccatcgaacgcgatttcggcatcccgatcgtcaacaagcgcatcaccgtcaccccgatttccctggtcggcgcaagctcctgcaagagctccgaggatttcgtcaagatcgcacacgcactcgaccgcgcggccaagaaggtcggcgtcgacctgatcggcggctactccgcgctcgtgtccaagtccatgaccccggccgaggaaatgctcatccgctccctgccgcaggccctgtccgaaaccgacatcgtttgctcctccgtgaacgtgggctccaccaaaaccggcatcgacatgaactccgtcgaactgctcggccacatcgtcaaggacatcgcgcacgccaccgcagacaatgattcctacggttgcgtgaagttcgtggcgttctgcaacgccccggacgacaacccgttcatggcaggcggcttccacggcgtgaccgaaggcgacgcggtcatcaacgtcggcgtctccggaccgggcgtggtctcccgcgcgctggacgaagccaagggcaaggacttcgagttcctgtgcgaaaccatcaagcgcaccgcgttcaagatcacgcgcgtcggccagctggtggcccaggaggcctcccgccgactcggagtgccattcggcatcatcgacctctcgctcgccccgacccccgccgtgggcgactccgtcggcgaagtgctggagaagatcggcctcgaacaggtgggcgccccaggcaccaccgccgcgctcgccatgctcaacgaccaggtgaagaagggcggcatcatggcgtcctcctatgtgggcggcctgtccggcgcgttcattccggtctccgaagacaagaacatgatcgacgcggccaacaacggctgcctgaagatcgaaaagcttgaggccatgacctgcgtatgctccgtcggccttgacatgatcgccatccccggcgacaccaccgcggccaccatttccggcatcatcgccgacgaggcggccatcggcatggtcaaccagaagaccaccgccgtgcgtgtgatcccggtggaaggcaagggcgtgggcgagatggccaacttcggcggcctcatgggctacgcgccgatcattccggtgaaccagaccagctgcgaggccttcgtgacccgtggcggccgcattccggcgccgatccactccttcaagaactgacgttcttacgaaagaacccgaccttcctgcacggagggccgggctcttttgcgtttgtaaaactgtttttacttaccgccggcaaagttcaactgtcgccaggcttcgtagatggcgatggaggcgcagttggtgagattcaggctacgcagcgaaggacgcatcggcagacgcacctgctcggccacatgcgggccggccatgatgtccatcggatcggggatattgcccggttccggaccgaacagcaggatgtcggtcggcctgtattcgatgtcggtgtacagcttggtggcgtgcgcggtgaaggcgatgatgcgcgaatccggcatcgattccaccagatcctcgaaattcgggtgcagcaccacatgcgccatgtcatggtagtcgagccccgcacggcgcagcttggtatcccgcagattgaaacccaaaggttccaccaggtgcagaatcgttcccgtcacggcgcacaggcggatcgcggaacccgtgttgcctggaatacgcggggagtagtagcacaggtgcggggtggaggtctccgccttcgccgcgtccttcgcgctcagcatcgcgtccaccacggaaatcggattgccgtgcgcgtcggtcaccagttcgtccgggccgtaattggacttgcggtacccgtattcgaacatcttctcgaccttggcttcggccgcctgcgtctcggcgtcgcgcgttgcgccctgcgcgttatcggtatgttcttcgttcgtcataaatgctaagaataggaacgatgaacgacacgaacaccacatacgacaccgccgtacgtgacgccgactttgacgactttgccgattccgccaccgccgtcacctccgatgcttccgatgctgacgaaatcgcaacgacgctcgcgcaatggtggcagaccaacgcgcgcgacctgccatggcgattcggccgcaccacaccgtggggcgtgctcgtttccgaagtgatgagccagcagacgcagatgggccgcgtcgtgccgtattggaccgcatggatggaccgatggccggacgcagccgcgctcgccgacgccccgaaatccgacgtgatcaccgcatgggggcggcttggctatccgcggcgcgccctgcgattgcaggaatgcgcgcacgtcatcgcatacgattacgccgacgagctgccgcatacgtacgacgaattgcttgctctgcccggcatcggtgattacacggcaagcgcggtgctgtcgttcgctttcggcgaacgtatcgcggtggtcgacacgaacatccgccgtgtgctgtcacgtgcgttcgtcggcgtcgaatcgctcggcggcagcgcaagtcccgcggaacgcgcgctggcgaaacggctgctgccggacgatgattccgcgaaatgccgtcgtttcgatcgcccgtccgtcgtgtggaaccaggccgtcatggaactcggcgcgacggtgtgcactgcgaaatcgccattatgcgaagcctgtccgatcgccggaaaatgcgcgttcctacgcaacggaagaccgggattggggcagcggcgtacgcgaccacgccaacgattccaaggtacggaccggcaggtgcgcgggctggtgctgaacgcgctgcgcggcctgccggatggcgagacggtgcttgatcgcaagagcgtcgaacggctgtggaaagaccacgtgcagctggacaaatgcatcgcgtcgcttgacgaggacggtctgatcgaaatcctgcccgggggaggggtgcggctgccggtgtaacgtacacggcatgcgtggtgcgtgcggccgcggtgccgcacggaggatgacacgctagactgggagccatggctcacaagacctccccgcggaccggtaagaaacgtacgaaacaacagcaggcgatgtatcgccgccgccgcatcgttttcggtatcgcgacggtgctggtgctgagcttcatcgtattctgcctgtattcgctgacgcagggcgtcgtcgctgtcaaccgcgaaatccaccatgccgatgtttacgcgatctcccgcaaggaggtgccgtcgccgacccaacagcagaaaagcagcgtccccgattgcgacgcatccaacgtcgcgctgtcgcttactccggccgcatcgagcttcggtgtgggcggcacgatggacttcaccgcttccgtgaaatacaacggttccggcaaggctggctgtctgatcgacgtgtcccaggcgggcatggtgctgacgatcaagtcgggcaaggacgtggtctggaaatcgaacgtatgccccgtggacacggattaccggctgatagccaagggcgacgaggtcaagcagacgatcacttggccgggcgtgcgttccggcagcgaatgcgccgacgcggcggacctgccgaacgtggaccgtggcgtgtattcggcccaactgtcggtcaaaggacatgcgaaaaccaagtcggaaccggtcggcatcacagtggaataaaatctacaggttatgttattctaatgactttgcgtagatgcgtgtcatatagcgggcacgctgacaaggaagaggcgcccgcgtattaggcatatggtggccaatgagagcgcttccggggaaacatatcgatacgattagcgagcgataaggaacgtccattggctgaggctacgacgaacaccaccaccatcatcgcacgcgccgaccagcatgatattgatctgcacaaggcgtcggaccgtgtgaatttcggctccatccgcgagcccattgatgtaccctacctgttgggtgtacagactgacagctttgactggctcatcggcaacgagcgctggcagaagcgagtccaggaggatctggagaacggcaccaacaccgtgccccacacctccggtcttgacgaggtcttccaggagatctccccgatcgagaacttcgctcagaccatgagcctgaccttctccgatccgtacttcgaagaaccgcgccacaccgtgcaggaatgcaaggagaaggattacacctactccgcgccgctgtacgtgaacgccgaattcgagaacggcgacaccggcgaaatcaagtcccagaccgtgttcatgggcgatttcccgctgcagaccccgcacggcaccttcatcatcggtggtaccgagcgagtgatcgtgtcccagctcgtgcgttccccgggcgtgtacttcgaccgttcccaggaccgtacctccgataaggaggtcttcggcgcgaagatcatcccgagccgtggcgcatggctcgagttcgagatcgacaagcgcgacgtcctcggcgtgcgcgtggaccgtaagcgcaagcagtccgccatcgtgttcctcatggccatcggcatgaccaaggatgagatcgccgacgccttcaaggactacccgctggtcatggacgctctcgccaaggagaccgtgcagacccaggacgaggccctgaccgacctgtaccgcaagatccgtccggccgacaccccgaccccggaagccggcaagaacctgctggactccttctacttcaacaccaagcgttacgatctggcccgcgtcggccgttacaagatcaaccgcaagcttggtctggaaaaggacgtcaacgaccgcagcctgtcccgcgaggacatcatcgccaccatcaagtacttggtcaccctgcatgcgggcgataccaagttcccgggcaagcgcgacggcaaggacgttgacctgcgcgtggacgtcgacgatatcgaccacttcggcaaccgtcgtatccgccaggtcggcgagctgatccagaaccagctgcgcaccggcctgagccgtatggagcgtgtggtccgcgagcgtatgaccacccaggatccggaggccatcaccccgcagtccctgatcaacatccgtccggtgaacgccaccatcaaggagttcttcggcacttcccagctgtcccagttcatggaccagaacaacccgctggctggcgtgaccaacaagcgtcgtctgtccgctctgggccccggtggcctgtcccgcgaccgcgcctccatggaagtgcgcgacgtgcacccgtcccacttcggccgtatgtgcccgatcgagtctcctgaaggcccgaacatcggtctgatcggctccctggcaaccttcggacgcatcaacccgttcggtttcatcgagaccccgtaccgcaaggtcgtcaacggccacgtcaccgacgaagtcgagtacatgaccgcagaccgcgatgccgagcacgtcatcgcccaggccaaccaggagctcgacgagaacggcaacttcgtcaagaagcaggcccttgcccgagtcggcgaagaggaagcggtcgatgtgccggtcagctccgtcgattacatggacgtctccccgcgtcagatggtttccgtcggcgcctccctgattccgttcctggagcacgatgagggccaccgagcgctgatgggcaccaacatgcagcgtcaggccgtgccgctgatcgaatccgagcgtccgctcgtgggcaccggcgccgaatggcgcgccgccgtcgattccggcgacgtcatcctggctgagaagccgggcgtggtgacctacgtgtccgccgacatcatccgtaccatgaacgacgatggcaccaccagctcttacaagctggccaagttccagcgctccaaccagaccacctgctacaaccaggtcccgctcatccacgacggcgaacgcgtggaagccggcaccgtgctggccgatggtccggcaacccagaagggcgagatggcactgggcaagaacctgctcatcgccttcatgccgtggaacggctacaactacgaggatgctgtgatcatctcccagcgcctcgtgcaggacgacaccctgagctccatccacatcgaggagtacgagatcgacgcccgcgaaaccaagctgggtgccgaagagatcacccgcgacctgccgaacgtcggcgaggacgcggtggccaacctcgacgagcgtggcatcatccgcatcggcgccgaagtcgaagccggcgacattctggtcggcaaggtcaccccgaagggcgagaccgagctgactccggaagagcgtctgctgcgcgccatcttcggtgagaagagccgcgaggtgcgtgacacctcgctgcgcgtgcctcacggcgagaccggcaccgtcatcgcggtcaaggaaatcacccgcgaagacgccgaggaagacggcgacgaactgccgaacggcgtgaaccagatgattcgcgtctacatcgcacagcaccgtaagatcacccagggcgacaagctctccggccgtcacggcaacaagggcgtcatctcccgcatcctgccggaagaggacatgccgttcctcgccgacggtactccggtggatatcatgctgaacccgctgggcgtgccttctcgaatgaaccttggccaggtgctggaactgcacctcggctggatcgcgcacgccggctgggacatctccctcgacccggatgccgaggccgcttggaagaagtacgtgccgcagggcgccgaaaagggcgctccgggcactccggtggccaccccggtgttcgacggcgtccgtccggaaaccatcaagggcctgctcagctgcacccttccggaccgcgacggcaacaagctcgtcggccccgacggcaaggcgaccctgttcgacggccgtaccggcgaaccgttcccgaagccgatctccgtgggctacatgtacatgctgaagctgcaccacttggtcgacgacaagatccacgcccgctccaccggcccgtactccatgatcacccagcagccgctgggtggcaaggctcagttcggtggccagcgcttcggcgagatggaagtgtgggccctcgaggcctacggtgccgcctacacgctgcacgaaatgatgaccaccaagtccgatgacgtcgacggccgcgtgcgcgtctacggcgccatcgtgaagggtgagaacctgccgccggcaggcatcccggagtccttcaaggtgctgcttaaggaaatgcagtccctgtccctgaatgtcgaagtgctcaacgccgaaggcgtggccatcgacatgaaggacgaggatgacgatccgtccacttcctccgatgacctcggcttcaacatcggtgcgcgtcctgacgccgccgccaaggaagaccaggttgccgaggagcccgaattccagtgattgaaaggattggccgcgctgcagcacagcgtgcagcgcggccaatccccgaacaacgtgataagcattaagaatcgatagacaggacaatagagtgctggacgtcaacgaatttgacaaactgaggatcggactggccaccgccgacgacatccgtaactggagctacggcgaggtcaagaagccggagaccatcaactaccgtaccctgaagccggagaaagacggcctgttcggcgagcagatcttcggacctacccgcgactgggaatgcgcctgcggcaagtacaagcgcgtgcgcttcaagggcatcgtctgcgaacgctgcggcgtggaagtcaccaagagccgtgtgcgtcgtgagcgcatgggccacatcgagctcgccgctccggtgacccacatctggttcttcaagggtgtgccgtcccgactgggctacctgctggacatcgcgccgaaggacctcgagaaggtcatctacttcgcggcctacatggtcaccaaggtggacgaagagcagcgtcatcaggacctgccggacctgcagcaggagttcgacaacgagatcgccaacctcgagaagcgccgcaacgccgaaatcgaggagcgcgccaagaaggtcgaagccgatttggccgagctcgaagccgaaggcgaagccaagggctccgcacgcgccaagctgcgcaacagcgccgagcgtgaaatggccgccatccgtacccgctacgacgagcagatccagcgtctgagcgccgtgttcgaccgcttcaagaccctgaagccgggagacatggaaggcgacgtcgacctgtggcgtgagatggaagaccgctacggcgattacttcgaaggctgcatgggcgccgaagccatcaagaagcgtctgcaggacttcgacctcgaggcagcctccaagcagctgcgcgaagagatcgacacgggcaccggccagcgcaaggcccgcgccctgaagcgtctgaaggtcgtcaacgcgttcctgaccaccggcaacaagccggaggccatggtgctcgacgtgatcccggtcatcccgccggacctgcgcccgatggtgcagctcgacggtggccgtttcgccacctccgacctcaacgacctctaccgtcgtgtgatcaaccgtaacaaccgtctgaagcgcctcatcgagctcggcgccccggagatcatgctcaacaacgagaagcgcatgctccaggaagccgtcgactccctgttcgacaacggccgtcgtggccgtccggtcaccggcgcttcgaaccgtccgctcaagtccctgagcgacatgctcaagggcaagcagggccgtttccgtcagaacctgctcggtaagcgtgtggattactctggccgttccgtgatcgtggtcggcccgtccctgcgcatgcaccagtgcggtctgccgaagccgatggccctcgagctgttcaagccgttcgtcatcaagcgcctcgtggaccagggcttcgcgcagaacatgaagagcgccaagcgcctcgtggaccgcgccgactccgaagtgtggggcgtgctcgaagaggtcatctccgagcatccggtgctcctgaaccgtgcacctacgctgcaccgtctgggtatccaggcattcgagccgatcctggtggaaggcaaggccatccacctgccgccgcttgcctgcgccgcattcaacgccgacttcgatggcgatcagatggcagtccacctgccgctgtccgccgaagcccaggctgaggcccgttccctgatgatggcttccgacaacatcctgaagccggcagacggccacaccgtgaccatgccgagccaggacatgatcctcggtctgtactacctgaccaccgtcatcgacggcgccaagggccagggccgcgtgttctcctcgctggaagaggccgaaatggcgctcgacaagcacgagatcgacatgcaggccaaggtgctcatccgccttccgcaggacttcgtgctgccgaaggactgggagccgggcgaggtcaaggtcgtcgatccggaaccgggcagcccggacgtggtcaaggaggagcgtttccatgacggctccgtcctgttcgccacctcctacggccgtatcctgttcaacggcaccttgccggtcgactacccgttcgtcaacgagcaggcgccgaagaagcgtctgagcaagatcgtcgacgacatcgcgacccgttactccaccgctcaggtggccgtgacgctagacgccctgaaggatctgggcttcacccgcgcaccgtggtccggcgtgtccttcgcgttctccgacgttatccagccgccggaactggacgagtacatcgaaaagtacgaaggcgaagccgacaaggtcaacgagaactacgaaatcggtatgctcaccgaagaggagcgtcgtcaggaactggtcgacctgtggaccaagtgcaccagcgaggtctccgaggcggttgaggaacacttcgattccaagaacaacctggccatcatcgtgcagtccggtgcacgaggaaacatgatgcagatcaaccagatcgcaggtatgcgaggcctggtggcaaacccgaagggcgagatcattcctcgaccggtcaagtccaactaccgtaagggcctgtccgtgctggaatacttcatctcccagcacggcgcacgtaagggtctggccgataccgcactgcgtaccgcagagtctggctacctgacccgtcgtctggtggacgtctcccaggacgtgatcgtgcgcgaggaggactgcggcaccaagcgcggcctgaccatgaaggtcggcgaacgcgatgccgaaggcaacctgcacctggtcaaggccgccgacggtggcccgtactcccgtctgctcgcggccgacgtcatcgacccggccgacggcgagaccgtgctgtacaaggccggcgacgccctgtccatggacgtgctcaacgatctcgttgcccacggcgtggaagaggtcaaggcccgttccgtgctgacctgcgaatccaagcgtggcgtgtgcgccaagtgctacggctggtccctggccaccaacaagctggtggacgtcggcgaggccgtcggcatcgtggcagcacagtccatcggtgagcctggtacccagctgacgctgcgttccttccactccggcggcgtcgcttccgcttccgatatcacccagggtcttccgcgtgtcaccgagcttttcgaagcccgtaccccgaagggcgaggctccgatcgcggagttcgccggcgtggtcaaggtggaagacaccgagcgcggccgtcaggtcaccctgaagccggacgacgactccgtcgagccgatcgtctacccggtgacccgtcgtgcgccgatgctggtcaaggacggcgaccatgtcgaagccggcacccagctcatcgaaggctccgtcgacccgaagaagatcctgcgcatcctcggcccgcgcgccgcacaggtgaacatcgtggaggaagtgcacaccgtgtaccgctcccagggcgtggatatccacgacaagcacatcgaggtcatcgtgcaccagatgctgcgtcgcatcaccgtgatcgactccggcgacaccgacctgctgccgggcgaactcgtggacaaggcacgcttcaaggccgccaacatggaagccgtgaagaacggtggcaagccggccgccggccgtccggagctgatgggcatcaccaaggcttcgctggccaccgattcctggctgtccgcggcctccttccaggagaccacccgcgtgctcaccgaagccgccctgaaccagaaggtcgatgacctgaagggcctcaaggagaacgtcatcatcggtaagctcatcccggcaggtaccggcctcgcccgttaccgcaatgccacggtggagcccgacaaggccatccgcgacaccatctacccgaacttcggtttgggcggcgaaggcaccgacagctccttcggcgacaccgacctgtccgatgtggacttctccaacatcgacttcggcgacctgaagctgggcgatgacttcaacccggatgacttcctggacgacaacggcggccagaccgatctgggcgacaccctgtgagattcccctcacgatagtcgacagacgaatcatctgacatagcgaaaggcggaaccgaccaataccggtcggttccgcctttcgctatatctatatgtcgtgggattgcgaggttgtggattaatcgcgggggagggtttcgcagtcgtcttttgatgttacttgatcttctccgaaagcgtggtttccagatccttcaacgaaccgctgagatcggcctccttcgcggccttttgcaaatcggactgatccagggtcggcgaatcgatgtcggacatcttcgcatgaagatcctgaagcttttcgtaatcggcggacccatactcgatatcgttgagattcagatcggccatctgatccacaatgtccttcttcttgctgacgctttcctgcatatccgcgccatactcggcataggacttgatgggaaccttggccagatcgccggcgtcggcggcacagctttcgagcgccttggaaagatcgcgatagtgcgaagacatgtcggcggagtcgaatttcggcagcttcgtgcaggtatgcgtcatcttcatgagcgcgggcatggtctgggccagatcgttcatgtacctctcgtatttcgcacggtcccgctcgaacgcctcgtacttctccttgacgtccttgtctttcttcacggccttcatggcagccagcttgtcgctgtcctgcttgaaggtcttcaacttcttcttgccctcgtcataagcggaggatgaatcgttgtccgttgcgctcgccgccgagctgaattcctcattgatggctgtatagctgctttccaacgcctgcgtttggaccagcgcttcctcgtaatcggaacggctgacgcgattcgtaaggaagaacaccgctgccagcgcgatgacgacgactgcggccaccgcgccgatgataatggcgaccggcggcttatttttggccgcggcgccggcttgctgggaaggaaagttgccgggcattggcggttgcggctgtccgtattgaagcccgcccggctgtggctgactgtagtttggcgcctgcggctgcggaggctggttatactgcggttgaccattctgcggttgaccatacggaggagtgttcgccgtgagaaaagtccttcttagcctttttccttttttttgaatgtcgaatccgtgaacacggagggaaacatcgacgtgtccgtctcttttgacgagttacagcataatattttgagatggaatatgcgagcatcgtattgcagaatgagtatcgtcagacggcatggacgtcaccttcctacaatgggaatatgagttttctaccttacccgccgccgcccgaaccagggtggtatgacgatgacgtcacggtgatggcgcaacccacagccgaacccgtcgacaatgccgccgattccttggaaacacgcgaacggctcgccgcacagaacgaatcggacgaccacgatatgcaggatgtttccgttgcgaagggcgacgctgccatttcggacgaggacgatatcgactgggacggcaccgtgctttccgaagccttcaccatgaagcagccgaagcacacgtacgtgctggacaacgagcagaccggacagcaggtgatcgtggatatgggcgtgctccttggccgcaagccttcggccgaagtgcccgccggcgccaaatcggtcaagctggaggatccgacgcgcacaatctcacgcaaccatgcggcgatcagcttcgaccaggatggcacgctgtggatagaggattacggttcgctcaacggcacgtacatcatccaagacgatgtcgaaaccaaagtggaacacaagccgatgcagctggaggcgccatgcacggtgcgtatcggcgaccagttcttccaattccgcaaacagtgaggacgtttgtcagtgaagacacgattacgctgacggactgcgttgacgatttgcgttgacagcgtcggcgcggacggttagcggtaagacgataaggggttgtcacggagattcccgcgacaaccccttatgtttcaaatggtctgataatcggcgttagctcactgctggcgcagacgaatggccgcgttgatggccgaatcgttcaactggccaagccaggcaagcaattccggatagatgtacggattgcgcgcaagacacggacgaagctccggcgcttcgctggcgatacgggccatcagcatctgatcggtggtggtcatggccagttccgcggtgaaccccgcgtctgccggcgattcctgggccgcggcatactgctgttcggcatactgctgttccggttcgttctgcggctggctcgatgaataatcggccacttcggacaaatcggcgggattcatgtatgggtcgacatactcggtcgaagcctcgttagacgccgcataggcagcgtcctgaccgtattgctggttcaccggctgttccggctgatactgctgctcctgctggaactgttccgccactgccggctgatactgctgttccggctggacctgttcggcaaccggttcggccattggctgggccgtcggttcggcaatcggctgcggctgcacgccattttgcggaaccggccagcccatcgccaccagctgctggcgggcgcgctcatcgccgaattcggcgacccaacgcttcagacccgggtacgctcgcggattggcaacgacattcgcaccgaattccggattctcgtacgcgattttcgccaggaacacgggatcggcgttcggatcctgcacggccgccaccgcggcatcgaaatcgaccatcatgatctccttgtctcgtggtctgtaaccatcttattgaatgactcgtaacgtttgcaacgtaccgtccagcgcatcgtcgatatcctcgtcatcgccgatcttgctgacgttccaatcctcgtcgcacggcatatcggaacgcatgtccaccacgatgacggtgatgttgtcgcggccgccggcgttcagcgcggcatgtaccagcatgtccgcggccatctgcgggtcggcgtacgccgccgcgatctcggcaagctgctcacggccgatctgcgcatgcagcccatcggaacagatgatgaaccgtccgtccgcacgcgcggcgtaccagtcaggctggatgccggcaggcgcgccgacacattgcgtgatgatgttgcgcggaatgcaacggctcgcctcatcgggcagcatctgccccgaatcgatggcgttctgccgttccgaatggtcgcgggtgatgcacgtcagcgaatccgccagccacacgccattgccgtcggcgcgcatatggtacgtgcgggaatcgcccacattgacgatgtaacaccgttcgtcggaacatatcgcgtcatcgccgacacgcgtcggcagcagcacgccgctgatggtagtgcccgcaacgccgccgagctgctcacccagacggagcacctcctgctgggcaaggatcagcgtttcgtcaatcgcgtcaagatcgcgcgtcggcagttcggccaaacgcgcgaaccgttccgcaacatcggaactggcctgcttgccgcccttgccgccacccatgccgtcgcacaccacatacacgccgttgcctgcgcaggcgctgtcctggttgtctttcctacgcaagccgatattgctgttcagaccgacctcaatatgtttgacgttcatgagttccgccctttcacaccgattttccgcaagcggattttccggaagtggaacacgtccgcaagcgatagtttcgcccgccacctgcggaacgtcggcagcgagccgagcatgaactttcgttcttcggcgatgtcatgccagtagcgttccgcatgctcctgcgtgacatcgcctccggagaaggccgcgtaatcagcctccctgcccagcgcgagcagtgtatcggcttcgaagcccatctgttcggcgatggcctgcgcctgctcgtttctggtgccttggacgtcaaggccgctttgccgggcaagcgccgcgaccgcctgccatccggcagcgacgcgttgcgatgcgctgccatgtctgcgcgcccgagccagggcgatcgacttgatggcgagcagcaggccgcagacgatgagcaccgtccacagagggctgccgtagatggcgacttttctgacgattctgccgaaacgctgccagaacaggctcgtcggcgtctcgtcggccatgctgccgccaagcgacgttttgcccttggcttggttgtcgtcacgcagcggatcggtaagcggcaccggaggctgacgcaccaaggtctgcggattgggcggagtgagattctggttctcgtcgggaaccttcgtttccttcggtgtcgggtagaacgccacccatccgtaaccgtccagcttgatctccacccaagcggtcacatcgttgccggtgaatttcgtggtggtggttttgccatgcttctcggtgcggctgtcactgatctcgccctcgtcgttcttcggcaggaagcccagcactacgcggctcggcaagccgagactgcgggccataagcgccatcgcggaagcgtattgctcgctgtctccgaccatcgcactgccggcgagcagctggtcgatgcgatagttgccgtgaccggccctggacgggtaatcgccattcaaaccatgggagaaccagccggattccctgagcttgtcggcaagagcctgcgcggcctcgccgcccttggactggccgcccgcaatcgcggtggccagcttatccacgcaatcgggcacatcttccgccttgggctggctgatggaggaagcattcgccttggcgatctccttatccgtcggcgtccgcggaatgacgccggtttccgtataggacaatcccggagaggtgcgcgaagggtagatcgccgacatggtgtcggtgttgtagtagaacgaatcggcgtccgacgatgtggcgaacttcacgctggaagccgcgccggccatcggcagccaatagtcgctcaaaccgtcatcgaccgtgaatttcgcggtgaaccgcttgccggcggcgttgtttgcgatggaatcgcccacacgatggtagttggaggaatccgaagccatggtggaatcggacaggttccacacattgccgtcgaaacggtccataaccgccaaacgcaccgtggaaccggccggcagatcgtcgacggtcagcagcacatcgtccttatggttcttgatatacgaacgcatgccgctcaacgggctggtgtaatcgtacgggctcagcggcggatcataatggtcgcgcagaatggtgcggttttgcccgaccaccaagcatccgccgatcgccacagccgaagccagcagcacgatgactacggaactgagccaacggcccaattccaacagtttccaacgcgcgctgacccaaaccaccagcacgaccgccataatcgtgccgatcgccatacggtagaagccgctcgacgtgccaagcagcgcgcagatcgcaagattcgccacgacgggaacgaccgcgaccatcgtaagccggccatcctccgcaaccgcgaagataccggccagcagcgcggcccacaggcagatcgtccacacggcgagcagcgagccgtcgccggtgccggtcggcgggtcgatggccagcaggtatttgaacgagccgagcatccgcatccacccctgcgtcaacgtgcgcaatgtgggaatgacatgggcgatggtggtgccattcaggaagatgaccgggccgaccaccagctgcgcacacgccatgaacagcatctgccaccacaggcgcaacgcgggaacgagaccggcaagcgccacgagcgagccgatgatggtggcggggattgcggcgctcgtccaagacagggcggagccgtatacgtcgatgaggttgctggctgcggcgatggtcagcagggcggcgaccgtgaggcttgcgtattgcgcggcgtgcggctggttggtgttgggcatggctggggacttgccgctgcgggacatccagatgacggagtgggtggagttcgcccatgagccggtgcctgtgccggtgaggttgccggtgaaattgccggtgttggtgaatgtggtgctcatgccagcacccccatgatcatggggaggtcgttgaggtctcccacggttgccaaggtgaagtcggagtagcgtttgatggcgcgcggttggccggttgcggcttgaagcaccacgcaggttgcggagcgggggagtgcgaggaccatgtgtttgatgtcgtcgatggttttgagcctgccgacggtgaagaagtagaaggatgcgtcgggggcatgttcgagagtggtttgcgcgaggttgggattgtcgtcgatgtcagggtcgatgccgctgcagccatcgagaaattccgtggcgttgcgcggaatggcgtgcgtggaaccggcatgcgcggtgactggccggttctgctgcaggcattgcacgccgatggaggcgtggacggatacggccagttcgaattcctgggaatcgatgtaatcatccgggttcacgctgatggtcagagcggtgtcggtacggcgggtggcttcgtattggcggatcataagcgatccggttttcgcggagctgagccaatgcacgttgcgcacgtcatcgccgggctcgtattcgcgcaggccgtagaagtcgaggtcgtcgtcgacgatttcgccgcttggctggccttccaaatcgcgtggaatgccggcgttcagggtgctgagcagcacggtctgcgggtggatgaacacgttgatctggtccacgagtttcttttcgtggcggatcagaccgaacgggtcgcctttgcggatggatagcgggccgatgggcagcaccgcacggctgacggcggtgaattccacggtcgtcagccgtgactggcctgcggcgagcatgggaatggcgaaccgttcgtggttgtctccgatgggcaggtcgccgcgcgccgacgtggtgggggtgcggcccggattgtccacgcagacgtcgactttcaccgtgtctgacaccgtgacgcgtctgctggacacgtcgatggtggcttggaacgaggtgttgccaagggaaagcatgaccgccgcggccagcatgaccgcgaacaccaccgccatggccagcagctcatgccaccccagcaggacgaacgccaccagtgaggcgacggcgagcgccgtcaccgcccagccaagcggcgacacgtatgaggtggccagtcgcttgatgcgatgtttgaggcggcgtagggatcgttggatggtccgtctgcgctgcactgtgtgcgaatgccgcattccttgacctttcggattgtgtggtgcgtatgccggggtggattgtgtttcaggcgttggcgcccagggttggggccggcacgtcttcgaggatctggccgatcatctgttcgggggtgtttccggcgaaggtggcttcggcggtgagggtgatgcggtgcgcgagcacgggtacggcgaggtttttgacgtcgtcgggcactacgtagccgcggttgtcggaggcggcccatacgcgcgcgcagcgggtcaaggcgagcgcgcctcgcatggaggagccgacttggatgcgttcgttgtggcgggtggcttccaccagtcgcacgatgtattcgaggatcgcgtcgtcgagatgcacggtttcgctgatgttgcgcatgcgcagcacgtcttcgccggtgagcaccggatgcacggtggcggcgcggtcggtgacgttgacctgcttcaggatgttgacgctcacgtcgtggcttggatagccgatggtggttttgatgaggaaacggtccatctgcgcttccggcagcttgtaggtgccgagctgttcgatcgggttctgggtggcgatgaccatgaacggctgcggcaccgggtgggtgacgccgtcgacggtgaccttctgctcttccatgacttcgagcagtgcggactgtgttttcggtgaggcgcggttgatttcgtcggcgagcacgatggacgcgaagatcgggccttcgcggtattcgaattcgccgcgcttctggtcgtagtaggtgacgccgaccacgtcggacggcagcaggtccggggtgaactggatacgtttgaacgacatgtcgatggagttggcaaggcctcgcgccagctgggttttgccggtgcccgggttgtcttcgagcaggatgtgcccgccgaccaccatggctgtggcgcattggcggatgggtgcttccttgccgaccacgacctgggagacgttgtctacgagcttggcgaacttctcatggaattcggtgatgtctttgctgggtgcggtcatcatggacatgtcgacgaccggctgggattgtttgacgggctgtacaggctggctgggctggacgggctgggttggctggacgggctgctgcgcgggcattgcgactgccggatcggcggccggttggcgaaggttctgcggcatcggctgacggaaccgcggctggttcggcgttgccggggcggactgttgcggcaacgccggtttggtggtgccgtgcgcgctcagcagcgtgccctccggatcctcatcggcttgcggctgctccggcagattcggcgtgtggaacgccggctgctgctggccgggttggctgggaacgcttggattatggccgatggaacccagctgggtggcgtcatcgaaatcgttgctcatgggttgctccttgcttgttgtgttgctcgtgtggatggttcgttgtgtttgcgattgctgtgatcgtccgtttcaccatctggcgtagtaggccaggccgcggatccaaggcttggatgcgccgtcgacggtggacagggcgatggaggatgccacaggccggtcattccgcgtggccgcttcgccttccgtggacgcgtcagaatccgatggttccgacggttttgatggttctgaaggttccgacggttcgggtttcggcgtgggagtcttgtacctgtcatggtccagcagtgtgccgccattgtcctcgttgttgagcgcggtgtcggtgcccaccaccttcgccttccacgcgtaatcggctccggtcggcagcacgtccttgacgttcagtttgtcggagcccaatgcccaggcgacgtcataggatttgccgtccgcggtgaaggtgatcacggttttgccgggctggccgtacatgttcaccgaaccgccgctgaccttgatgatgttcggatcattggcgtcccacgtcagcatcggcgcgttgacggcggccttcaccttgcggacgtatgccggatcggccctgccggacttggaggtgcttgccgcgccattgaaatgctgcgtgacggagcccgaggaacaggactgccattccttgagcgggaaatcgtgcgatcgttcggaagcgccggcatggtaggagccgagtccgtccgcgctcaccgtgaacccgtcggcgtggccgttctccttccaactgactacgcacacgtcgtcatgccctttgacgctgaccgattcgggcgccttcaccgcgtatttcggtgtgaaacgtacggtcgaatcgtcactggtcgttttctccttgccgaccaccgccgccttgatggtgtattccctggtgttgagatcatggtccggaatcttgaaatcgtaggatccggaacatccgtcgatgcttgcgctgacatctccggaaatctcgacggccttgcatcccgcgttgcgggtgttgcccacggattcgacggtgacggttcccgtggtgtcgtcgttcgtcacggagatcttcggcgcatcgggcttgccccacggcttgacagcgtcggacgccttggacggttggctccaattcaccttgttgtgggcgcgtaccgtagccgtgcacgagtcgccgtcggaaatcgcgttgttatcgaaaacaaaatcgattccggtggaatttgtcgtctgcttggacggtgcgttcctgccggacaaagtcacctcgtaattgtccaccgacgagaaattgccgtccggagccttccacgtgacgctcaccgtgttgcccttcacactggccgtcacatccgtcggcgcatcaggcagcttgtccggcgtgccctcgacggcgttggaatccttggaccagccgacctcgttcctggcctgcaccttgaacgagtaggtcttgccgttcttcaacccgtcgatgagacaggaggtcttctgcccgcacgagcgctcgccggacgcgtctccgccccacatcaccttgtattcggtgatcgggctgccgttggccgaaccggccgtccagctcagattcacggcgccatcctgcgggtcgccggacaccgcggaaagcagcggcgcatcaggtttgtccatcaccgaaacgctgatggtgccggtcacctcacgttcttttgttttggtggcgtcgcgcacggtgacgaccaccttgttggtgttcgcgccgatgtcggaagccgccctgatggacaccacgccgttggatgggcaatccaccgtcagcttcgacgcgccatcggacgtgcatccggtcaccgtcagcggagtgtcggggaacggattgtacgcgtcggacagcagattcacctgctcgctggaaccggccttgattttcacggtcttctcggtgacacgggcgagcggcctgttggacgcggtgacgcgcacggtcataccggcgctcaccgtacccttcgcatatttgatcgagacgggcacgctcaccgtggtgcccggcgtggccgtcttgtccgcggacacggtcaacgtgccggagggagacactctggcatccacactgccggaattcacgccgccggaatacgagtactgcttctcatcctcgtacaggcccgacgccgaatgggtcagcgccgtcagatcgatggtagtggccttctcaccggccaccacatcgacggtggaggatgagaacgtcggcggcggaacctcacgtccgatcaccgtgatcggaagcgtgagcaccgccgaattgacgatcttcaccttgtcgttcttgtctcgcttgccgtccaccgcggtgaaggtgatggacgcgggacccgcgtaatccttcggcgcggtgaacctcaacgtctggtcgttgacgtacaggtcgccgtccgcggccttcgtggcgctcaccgaatcggcgccgtccacatacgcggtcttgcccgcgcccacacgcacgtagtcggcgatgttgatggtgatggtctcacgcgcattgaccttcaacgccggcgccttcggacgcagaaccggcggaaacacgccatatgcgggcacttggatgaacgcggtggacgtgatgccgtacgtcgtgttcgtgacggtgtatggcaccgcgcgcgcctcatcggtcagatcaacggtgatgatggtggaatccttgccgcccttgacatgcgcatggtcggtcgcggaaggatccacgcccacctgaagctcgtcggcggtgccggacggattggcaatccactgcgaaacgtccacgtccacggatttcttgtcgatcgtggcggcggccggaacacggtaatcgtacgcggtcggcgggtcgatggcggcgttctcgtcgacattcaccgtcaacgtcgccgaatcggacaggccagccttgtccttgacggtgtagaccacgtaatacgtgcccgcctgcttcggcgtggtgaacgacagcatgttgtcaacgacctgaatgccgccgatgccttgcgattccacgtccttggccacggtcagatcagtattgtccccggaaatgtcgttctgcgccaccggcacggtggccgcggtgttcggacgcagcgtgatctcgtcgtcgcgcgcgtacacacccgaatcggctccggatttgaacacgcccacacgcacctgcgcggtggccctctgaccggtccaatcctccacggcgtaggagaacgtgtccgttccggacgaatcggcatacgcctcatacaccagatacgtggcgcccacctcgctgatacggcccagtttcggcgctttgttgcccaagccgagcagctgcacgtcatcgccgtcagcgtcgatgccggtgagcgtgatcggaatctgcaccttctgaccggccgccacctgcgcctcgacgtcggacggtgtcggagccgccttgttggacgcgtccttctgatgcacgttgatggtgatggtggccgaggccgcgttgccgagattgtccttcaccgtgtaggtgacggggaaggagccggtttgtctggtggcctgatagcgcacggtgtcgccggacacgaacaccagacccttgaacgtgttcttgtcatactgcaagtcgttctgcaggctcaccgtggtgccgtcggaatacgtgacatggtcgagcacgtccacggacacgatgccttcggtgcgcacctgtgtggtgatgttctcggccttcggcacggaattcgacgtggtcagcgccggcggctgcaggacgatgacgccggtcgacgatccggccgcgttggccacggtgtaggagatccgcaccggctcggtcggcacctgacgcgcggtgatatagacgcgcttgttgctcaccacaccggttttgatgccgctttgcgcgtccgcggtgacgctggtcaccgacagcacgccgcccatcgggtcgacgtcgttggcaagcggctccacaatcgcggtattgtccgcgcctagcagcgccacatcgttcgccgcgatcggcttggcggcgtctccggccaccgcctgcacctccacacgagccagaccggtcgacggaatggaaccctgcgtgatggtgtacggcacatagtaggtgccgggattggaggcggtgaatgtgatcgacatgtcggtggcgttcatggtggtggccgcgccggacggcgtctccaccgcggtcaattcggccggttcgacggacgtgccgtgcacgtacggcttgagcgcgatggtggtgcgggtgtcgggcgtggtctgtttgaccacggggtcgatgaccgcgcccagcgtgttcgccggcttcacggagaagtagatcatgccggtgccggtctgctggccgtcggacaccgtgacctcgatgcccgccctgccggacgacatcgaaccggcgttgaagaccaattgtccgtcggctcgcgtggacaccgtcacctgatcggtgttctgcggcgatgccgacaccaaggtcagcggatcgccgtcggggtcggagaagctgcccaacgcgttcgcggtgtacgaagcaccctgctccacgtcgatttccggcggagtgtcgctctgcagcggcgcatggtcgtcgccgccggccagcgtgagcgacacggtggcgctggacgtctgcccgcgcccgtcggaaatctcatagctgaaggacacgttgcccgcggcggcaccggaggcgtcgagctgcagataccggccgtcatacacgggggagacggtgatgttcgcgccatccggagcgctcaccgacgtgatgcgcagcacggaacagtcggtctgctcgtcgttgcgcaacacgtcgagaatctgctgcgatcccacgcgcgcgccgaacgaatcgtccacggccttgatctgccccgactgcgccgaacagttcttgctgaaattatgctggttgttggcgctgtcgttgttctgctgctgttgcttcgactgcttggtctccaccttgttccactggattttgatgaccttggtggactcctgcggattccacacattgccgttgaccacgtcgttgagcaccaccagacgatggttggtgcggaacacgagctgcgaggtgggattgacatcttccaacgaggaaaactgtgcgtccttgtcgttcgccgcgcacaccctgatgtaattgttggccttctgcgcccacgcggcgaacacgcagccattggtggacaccggctgcgcggcatcgcccttgccggcattcggcagctgcgtgacctttttactacccaaatcgaccatggcgatgccccgcggcgtggaaaccgccacccagccagtctgcctgccatccgtggacggcgcctgcaacgtcgcctgatcctgcaggccgatatccgcgctgcccttcggccagaacaccttgccggcaccggctgcgaccggcgtcttgccgaccacggtgaacgattcgacattcgtggcgcccttgatcgtcgcatccttgccgggcgttccctgaggcccgtcgacactgagcaccgcgccgtcggacgcgcgatagccgtagacgacaccgtcatgcgtcaccgcgatacggccacccgaccccagcttcatcttcggcgaatcggtggtcggattcatggatttcacatcatctgctgacccgacccacacattgcccgtcttgacgttgatgaacgccgcggtgttgcctccgacgacggtccgcatatccgatttgatggtggtgttgccgctttcgctgacggtggaggcctcgatgttgctggccttcgtaccttcggagatcacggtggagccatcatgctgggccacgtcgaaccgggccgcagtggaggcgacgcccgcatcggcgtcccggttgcgcacgttgaaacgggcggccttgcggtccttgagcgaagtgacccacacggtgccatcgtcgagctgcacgtgacgttgcgtcaccgaactgacgatgacggccccggcgacgatgcccagcaacagcagcagcatgacgatcggcgtgatccaccggcgactgccggaaggcagcagcttgcgcagcatcgacccgaatcgcaactgccgttcgtacgattgcgccgactggttctcggcgttcctatgcttgctcatcgactggctcttccctgattgtgcccaaactttgcttgaccgcgcatccaaccgcatgcgcctacctgtttgcccgcatgcatgccgggctgtattggttcgtatcggttcatgtcacccgcatccggccgcaaactcacggcttggccgcgcacgcgatcatgggattctcggacatctgccggtccgcgcgaaccagactcacctgcacgcacgtctgcgcgccgtcggccggatcgatttcgatactcgtcgactccgtggtggtgccctgcgcgttcgggtcggttcccgaatcgccgaccagcgaccacgcgtacgaatcgccatccttcggcgaaggattgacccacgtgaaccgcactttgccgtcggcggtgtattcgcccgtaagatcctgcacgctcggcacactgcccgacgtgatcgccgaatcgggatcgtcctcggcatggttctgggcgccatggttctgcacctgcaccttgctgttgtcggaagccgcatccatattcggcatgacgacggtgacgaacgccaacgccatcacgaccacggcggccgccgccgcaaccgtgacggccaacggcttcacccaccgggcatgctgtttcgcaatcggggcggactggtcgaatgcggaagtctgcgcgtacatgttctgcggataatccggcacaccctcgacggtggtctgcgcggcacggccatacaaggcctgttgcacgcgctgcatgtcgcgcgcgaactccaacgcggaatagtaacgatcctcgggcgtacggctcaaggccttacgcaacacccgttccacttcgaccggcacgtcgggacggttgagcttgggcagcggattgttgagaatgacggacttgagccgttcggcccgcacctgccgttgggaatcgcccagcacatcggcgtagaaatactcgtacggcgattggccgatcagcatggcgaacagcgtggcgccaagcgaatagatatcggacgattcattgccgccaccgccttgggcaagcacctccggcgcggcccacgcgatggtgaagccgacacccggacgcccatagacggacccggcgatgccgaaatcggcgagcatgggcatattgtgcgcgttgatgagaatattgctgggcttgatgtctcgatggatgatgcctttgcgatgcgcggtgaacagcgcgctcgccagatcgataccgacggtgagcatctggtcggcggtgagacggccatgctcgaggaacgtcttgtaattgccgcccggagcgtattcgaacacggtgtagccgcgcccgttgacggtcacgccgttctcatagacggaaagaatgtaggggtgtgtggagatctgccccatgaaattcgcttcggaacggaagcggaccgcggcacgtgggtcgagcgtgttcttgctgattttgatggccacctgacgggccggggaaagctgctggtacaggtacacgtcggcttcggaaccggagcccagccgtttgatcagtgtgtagccgggaatctgagggggaatgctccttgaggcttccatgcttcctctttcctgtagttcctgcccggttccgtgcgttgcgtctatgcttcgactgtactcgtcgtcacgggcaggccgtctgttcgctgttgaaccttcccgggctgcgccgctagtcaatcttattggtggcggtgtccgaaaaactttgtagagggtatcgatgtccatatataaagatggcggtgtccacgatgacgttttcaggacggcttcggacgatgatatgcgattcgtggccggaccgttcggctaagctggggagacatgatggatgtggacgatctcgatgacgcgacattggttgcgggggtaccccgcagcggcaagacccggttcgcgcttgacatgctggtcgccgcgatgaagcggcatggcgacgcgtacgccgtgatgacggtctccggcagacaggtggccgaccggctcggcgacaccgtgatccgcgaactgtccgcgatctcgcaggcacgccccgccaccaccctgccagccgtcgcgttccgcatcatgaccgccgtgcgatcgcatgccggacaacccctgccgaaactgctcaacggggccgaacaggacgtggtcatccgccgcgtgctcgccaggcatgccgaacatgccgagcacggcgacgaatgctccacctgcgcgctattgcgcacctacttcgtggtcgccgactggtcgggcatggtggtggacgacgccaccgacgccttcgccaaccagctgcgcgacatgcttgcccgcatgaacgagatcggcgcgaaaccggaactcgaagacatgctgatcgcccgcgctgccgacgagcacggcacgctcgacgaacgacgcgaacgactgcgcgtgcaatggcggctcgccttcgcgctgcgcgccgaatacaaccaggccatcaacgaggcatatccggaccaataccgtctcgacgcctcgcagctcatgatcgacgccgcggccgccgtgaacgaagccaaaacgtccgacctgccgaaactcgtcatcgtcgacgatttccaggacgccacactcgccggcttcgactttctcaccgcattgcgcaaccgtggcgtgcgactgttgctcgtcggcaaccccgacgaggcggtgcagacgttccgcggatcgtaccctgaatatttgttcaacatggcgcaatcgcgattgggcgcgcgactggtacggctggaaccgtcccatatggccgaaggcacggacctggccgcggtggcgagccgcgtgagcctgaccatcgccagcacggaatcgaccgacgacgcgctggcgaaccgccccggcaaaatgccggccatcgccataccggagacgcacgacggcagtcttgaagccgcgatgtaccgttccaccgtcgaagaactcgacgacgtggtgtggaaaatcaaaaccgaacatctcgaacacggccgcgactggaacgacatggccgtgatcgcccacgacaacgccaccgtgcgcacgttcggcgaacggctacgcgccgacggcgtgcccgtacgctattcgagcgtgacccaccccctcaaggacgaaccgttcgtgcagggcctgttctccatgatcgaactggccgaactgaaacggcaaggcatcgccacctcgtccatgaacctcgacacggccggcgcatacgtgcgctcacgcgtcgcatcaatcatgaactcgccgctgatcaccacccccggcgaacgtccggctcggctgtgcgtggtcgaatcggcgatgaacgcgctcggctcgctggccacggttttgcatgacgatacagccgatccgaccacgtccgacacgtccggacgcgcgctgctgccacagctgatcgacgattggaacgattacgtcgaagccttccacaccgcacgcgcggcggcatcggcgtcggacgcggaaaacgctgccggcatgggcctgccggcaatcgacaccgacgaccggctgatgacgggagagcgtgccgctgaggatgcggacgaaccatccttcggcatgaacgcgctgtacatcctgctattggaaggcgacactgaccgcgtgctcgacgcgatcgcctccgtactgggccgcaaagacccccaagcgcaagccttcgcacgcctgtggaaagcgctcgacgataccctgcggtcggaggcacgcctgacatcccacgaaccgcaatacgtgctcgactgtgcatggcaggcgttcggcaaagccgaaatctggcagaaaacggcgttgcgcaacaacgccgaaggccgcgcggccaacgaccggctcgacaccgcgatgcgcctgttcagctacgcgtccggcggcgaatcgaacggcgtgacggcagcgcacaccatcgacgcgttcatcgaacaggtccgcgcgctcgccatcgaagccgactccctggcgcacaccgcgccgatcgatcaggccgtgacgctcgccacgcccgccggagctgccggaaaacattggaaactagtattcatgcctgcgctccaacaaggccaatggccgaacctcgcgccgcgcaacaccttgttcggcggggaggagctcgccgacatcatgctgcatggacgactgtccgacgacatcgtcacctccgcaggccgcgaaaacgcgcagctcgccgcggtgctcgcctccgaacagaaaagcctccttgtggcgctcacccgcgccgatgagcgcgtgacggtaagcgcggtcctcaacgaagaccatgtgccgtccgacttcctctacggctacttgccggaatggttcgaccgcgaccgggatgccgatgcggaaacatgcgtgtacacggcggtcggcgaggccggcgaatacgcgggactggaagccgacccgcgtggcctggtcgccgccgcgcgaagcgtgctggcccatgtgccggccgattccccccaagcgcgcgatgccgcgcaagccttggcgttgttggcatcgcatggcatcgtcgccgcgaatcccgacaattgggcgttccttacggaacatgcgggagccgacgatatgacggaaatcgacggcaagatggaatctgacgggaaaacggagcatgccgacaaggcgaagcttatcgaacaaccggaatccatcgaaaaaacggacggccaatccgacgtggtcaccctttctccatccgccgtggacagtttgtgggcgtgcccggtgtgctggatgctggagaaccgtttcgccggcccacgcatgggcagcgcggccaccagcttcggctcgctcatccacgccgtcgcgcaacaggccaccgaagccggcctcgacctgccccaaaaccacaccgcggtaagcgacgaggacaacatcgacgaaatcacccaatggatgatcagccgatacaagaccctacgtggcgacctcaacgccatcgacgaccccgaggaacggtacaaggcgctcggcaaggacgcgaaggcgtcggtcgcattgcgcaacatcgccacatatttcgtcaagtcgaaccgtactggatacccgtcgaacaacaccgaaaccatcaccgtgggaacattggaccatgccgaagcggaacggcagttcgccgcgcgattcgacttcgacgacatcctcgacgcctacaacgccatcgacggcaacgctccgatctcccgcgacgaactcatcgccatcatgggcgcgctcgtcgacggctggccggaaaccggcatgagcgaccggctcaccgtacgcctgtcgggcagaatcgaccgtcttgaacaccgccgtaccgcagacggccgcgaacaggtacggctgatcgactacaaaaccggcaaagtgccgaacggacgctccctgttcagcgacctgcagctcgtctgctaccagctgggcctcgcattcccggaacacggcggaaaacgcggcgcgcaggcgatcgcagccatgccggacatcacccaaagcgccctgttccacgtcatggaatacgcggcacccgcgccacgcaaagggcaaggcgacgaagcgtaccaccagcaggcgctgttcgccggcggaagcatcaacgcgggcgatttcataccccgcaaatacgtgcccaaaatggccagcgtcttcaccagcggcctcgacgacgtcgaacggccggcgcaggtcagcgaagaacattggaagcaacttctggaatcgcggtcgaagatgacggtatggtcgctgaccatgatctcccgcgtcttctatgcggccgcggcgagccgggccacccgcatcaccgcgcgtccgaccgtggaacacgtcggatactgcagaacgtacggcagtggggtctgcccggcctgccaaggcgagcagaacaccgtattcgaaaggaccgtggcatgaacgggagtaacggtatgaacggaagcatatcaacgaacggggccacagcaaagggcgatgcgatgggcactgtgccggccgccacgccgaaattcaccgacagtccggaacaggccgccgtcatccaagccccctcatacgaggacgtggtcgtggtggcgggcgccggctccggcaaaacctacaccatgacccgccgcatcatcaccctcatcgaccagggcatcagtcccgagaagattctgggcctgaccttcacacgcaaagccgcctccgaactgctttcgcgcgtctccgctgccgtgacacgcaaccaagccggacgtggtacgcgcgtcgccttcctcaaaccggaagtctccacctatgacgcgttcttccaaaccatcgtgcgccaatacggcctgctcgtcggcttcgaccaaaacacgcagccattgagcgaagccggagcgctgcagctcatccacaccgtgctcgacaagcacatggaccagctcatggccttcgaccaaggcggcgacgaactcggcaaattctccaccatcgccggcaacgtgttcaccctatccaacgccatcgcaggagccatgatcggcagcgactgcaccagcttcgacgaagccgtggaacgcgtgcgcgcatgggataaggcgttcgtggcgcaagtggccaaagcgcttgaagacgaggacgttcccgatgacgagccgaaagtgggcaaggctccgaaacagaagaaaaaggaatccgacaccgccttcgaaacccgcatgcgcgaataccgcgcccaatgccaccaactctgcgtccacaagaccgcgcaattggccggcacggcccgcaaacgcgacctgctactcgacctcgtggccgactaccacgccgaaaaacgcgccctcaacatggccgaattcagcgacttcaccatcgccgcattccaactcgtcacccgattcccctccatcggagccacctaccgcaaacgctacacgcacgtgctgcttgacgaataccaagacacctccaccacgcaggcggccctcctgaccgcactgttccacgccgattccacccatcgcagcgcggtgaacgccgtcggcgaccccttccaatcgatctacgcatggcgaggagccagcccaggcgcattccgcatgctgcaacacgacttcggccacgacgccaccgacaagccctacacgctgaccgtcacccgacgtaactcgcgcatggtgctcgaagcggccaacaatctgacgaaaccattgcgcctgcccgccagacgtcgcggcagctcgcttatgcgcgaagtggacgtgcccccgctcgccaacatcgacaatgcccccgaaggtacgctcggcgtgctcggctacgccacattcggccaggaaatcgacgccatcgtacgcttcgccaaacaagcgatcgcactgcacacgccaaccgaaaacgagctcgccgacggagccaaagacaaccgtccgcacgtggcgctcctgttccgctccaaaacgcagatgccagcctacgaggacgcactggaacaagccggcctcaccacactcgtcgtcggccaggccgcactcctggaacgtcccgaaatcaaagacatcctcgccctgctgcacgtcgtatgcgaccacaccgacagcgccgtgctcatgcggctgctcgccacgccacgattcggcctgtccgccgacgatctgcaggcgctcgccggcatcgccgaacggctcaacaccgcgcaacgctaccgcgcgctcgtgtcggccggcatcgtggaggcggatgcgaatccgtccgacgccgacatccgcgccaccgtgcgcgcctaccgcgaccaagtgcccaacgccgtcttcctgatcgacgtgctgctgcgcggcgatctgcggcacctcgtcgacggcgtattgagccgtacgggagccgcgagcgtcatccacgccggtcgcgtcatccaacaggtgcagcgcacggccggccatccgttgccggaagtggtacgcacggccatcaccgcgctcggactggacatcgacctgctgctcgccgaacggatgcggcatccggatgccggcaatcgtgccacatcgcatgccgcttcgtcactcgacgcgatgctgtctctggtggacacctacttgcaggaaatcgccgcgcagggcacgccaagcctgcgcgcgttcatctcgtgggtggattcgctgcgtgacgcgtccgacgacaacgccaccgcaccagatacccccgtcgatgtggtgctcatgaccgtgcaccagtcgaaaggcctggaatggaacgccgtggccgtggtcggcatgcgcgacggcaccttcccgtccagtcaaggcgaccacctgagcgtcaaaacggacgaagaccatccgggcggtcggcgcgacggcgtatgggagccgccggaatacttcgaaaaagcccacacttggctggaagacccgtccgcggtgccggttccggtgcgcgccgacgcggatatcctgccacgattcccgcacgacgcgcccatcgggggcaatcccgtggaatcgctcgacggattggacgatgcggaagtgatcgacgacgaggtgttcggcaccttgcgaaccatggccgtcgacgatatggaaggaatggatccggcaagcctgtacctgacgcaacaggaggaatacggccgccgactgcacgccgacgaacgccgtctcgcctacgtggcgttgacgcgcgcccgctacgaggcgctgctcgtatacagcggatgcaacgagacgagccgcgactcccgtctggcggagggaaagaaaagcgccgcgccgtcgaatttctggctggagacgcgcgattcgatgaacggaatcgtcaccgcggtacgcgaaccggacaacctgtccgacgatgtggacggctccccgcacacgctgggacttgacctgcccgacggctatttcgtaggcgaacacgcccgcgatttcgagaatgccgtggtgggcgatgcgtggaacacgccgctcgaaccggtctcggacgaccatactttgccttggccgtgcgatctgagcgccgatgtcgccgacaagctgcgtgccgcggccgaacaggtacgtgccgtcgaatccgacgaaccgaatatcgctgaatccacgggaacgcagggcgacgttgccgatgaatccgccacgccatcgccggaaaccggaaactcactgctgcgtctcgccaaactgctcgtcgccgacgaacatctcatgccggaaccggacgcggctgacgcaggcgaatcgcaggacgccttcgacgaggccgtgcgtgccaaaggcgaacgtatccttgctgccggccgccaaaacgtcacctcgctgcaagcgcgcgccggctccatgggcgagcgtgactcccgcgcctactggcgtggtctggtccgtccgattccgcacgtcgcctcgccggcggcacagctcggcacgcggttccacgcatgggctgagcgtttcatcatggcggatgcggacgtcgacggcatcggcggtacggaaggtgctgccggcatggccgcgcagtcgcgtgcggaactgatcgcattgataggtgatacgcaagtcgacgcggacaacggcggcgtgcaatcgcaggacgcaccatcgcaggacgcccaattgcgagacgaacggaaactggccgcttggcagcgtcgtctcgtcgcctcgccgtgggcaaaacgacgtccagcatgggcggaacgccagctcgtcgtcgacatgccccagctcggcaccatcgtcaacggcaaactcgacgcggtgttcttcggcggtctcgacgaaacggacgagacgaaacgctacaccgtggtcgattggaaaaccggcgtaaaaccacgcaaaccggacgaaatcaaggagaagctcgcacagctcgacctgtaccgcctgctgctcgcggcgatggaaggggttccgttggatgcaatcgacgcctgtctctactatgtgagtgagcctcacgaggccgatcgggagcttgacgccctcgacaaaacagaagaagagatccttgccgagttgagctacggaattccgcagcaatccgacaacgactagtgccggtgcgcaatggctccttgaccgaagaaagcgggggagcggcgctttccggcctgcctgcgggagaaaccgctatgcaggcagcgttgtggaggaacgccgctaccctcgtgcagcatgtgtgggcgggcgcacatgccggacgcaacgacagttaaggagtgtttgatatggctgcgaacagcgcaaccgcaatcccgaacgccggcatgggtgccggaacaaacaacgcatcggcaatcgtcttccgtcccatcgtctggggcgatctggacgcggtggtcgacctgttcgaccgtacctggccgcaggatgtggacaaggtcggcgcggacatgtcgcggctgatctcccgatatttcgtgctgcactacctgctgccgaccacgttcgccaacggcgcgttcgccgccgacggcacactcgcgggcgtcacgttcatccgcgtcgccggcgaggcgccgcagctcgacgaaatcgaagtcggcgaggaaatgaaggccttggaacgccgcatcgacgccgatccggaggccgccaagcatatggcggcgctgaaatccggcttctcggtggaactcgatctggaacgcgaagggcgcgccaacgaaaccaccatgggcgagctggaactattcatcgtcaaccccgacgtgcgcggccacggtgtgggcgggcagctttggagacgcatgcaggagcatttcgccgcatgggacgtgcccgcgttctacctgcacaccgattccgactgcgacgtgagcttctacgaccacaaggggttggactgcatcgcgcaccgcacggcaagcgagacggtcgcccggctcggcggcagcgccgacggcgaagtgccgccactgttcgacgacatgttcatctaccggggaaaggtgacggcgtgacgagcgcgaaaccgcaatcgcaatcgcacgaaccgcacgaatcgcagaaaacgcaatcgccatacgcgcagcttttccgcattcccggcacgaaggcgttctgcgtgtccggagccatcgcgcgactgccgatgtccatgatgggcctcggtatcgtgctcgcgctcaaccacatgtacgacaattggacgatcgccggcgtgatgagcgccgcgtacgtgctcgccaccgccgcggtcacgccgctgtacgcgcgcctgttcgaccggttcggccagcgcaaggtcggtccggtgatcctgacggtgcaggtcatcgtcatgctgggcttcgcgttcgccgcactgatgcgcgtgccgattccgctgctgttcgtgcttgccgtggtcatgggcatgacgcagttctcgttcggcgcgctcgtacgcacccgttgggcgtacgtgctcgaccgcgccgacaaggaggacctgctcaacaccgcgtatgcgctcgaatccgccatcgacgagatcgtgttcatcttcgggccgattctggcggctttcctggccgcgtccgtgcatcccgtatcacagctgttcgtgccgaccctcgcctgcgcgttcggcggtgccgtgttcttcgcattgcgtgacactcaaccgccggtattgcgcgaaatcacggtcgtcgcggccggtacggacgatgctgacgtgcgattggcggccggcggtgccgctggtgccgcggtttccgcggaccgtttcgatttggatcggctcaagacgggcgatcgcgaccgcaggaaacgcaacgtgctcacctatgcgggtgtgctgccgctcctcgccgtgttcatcgtgttcaacatggcgttcaccgcgttcgacacgtccatgaccgccgtcatgaaatcgctgcacctcgactccgtgctcggcgtgcagctggccatgctggccgtcggctcctgcatgggcgcgctggtcttcggctcgcgcgagctcaaaggctcccgctggcgtcacatgatcatgttcctcgccttgatgaccgtcggcttcgtggtgatccacctgtgccagggcaacctgatcgtgatgggactggtggagatcctcaccggcctgaccatttcgccggtattcgcctccggcaacctcctcgtcaaggagaccgtgcccgaggaatcgctcaccgaaggcctgtcctgggtgagcaccgccggcacgatgggcgcgtcgttcggctccatgatcaccggcatcgtgctcgaccatttcgatccgggcgtgggattgagcctgcccgccgtgttcgtgggctgttcgattccgttcgcgctgatcggctggctgctggtgcgccgccgcggctgaccgacgttcgatcgtcaagcgtcatagccgcctgcctccgcgtcgaagcgtctctttagattcataagtggaacacgttatggacgcggacacgcgatttcgaacacatgcgcacggcaaacgtacgacatgcgcaacatgcgcgtccgcgaaaacatcaaggagctgcaatgatcaaggtttccgtagtcggcgccaaaggccgtatgggctcgcatgtggtcgacgccgtcgattccgccgccgacaccgaactcgcgctcgcgctcgacgcaggtgacgacctggccgccatcacccccgaaaacaccgacgtcgtggtggagttcaccgtgccgagcgtgtcgctgggcaatgtgctcgccctcgtcaagcagggcgtcgacgtggtggtcggcaccaccggctggaccgaagagaagctcgaccaggtgcgtgccgcgctcgcagcagctccgcgtgagggccagagcgtgttcatcgcgccgaacttcgccatttccgcggtgctcgccgaccatttcgcaaaggtcgcggcgccgtatttcgaatccgcggaagtcatcgaactgcaccacccgaccaaggtggacgctccgtccggcaccgctttccacactgcgcagggcatcgccgaagcgcgcaaggcggccggtctcggcccggttccggacgccaccgaaaccgacggcggctcccgcggccaggtggtggacggcatccacgtgcacgccgtgcgtcttcgcggcctcaacgcccacgaggaggtgctgttcggcaactccggcgaacagctgaccatccgcgccgacagcttcgaccgcatctccttcatgccgggcgtgctgctggccgtgcgcaaggtctccaccggaacctacccgggtctgactgtcggcctcgaccacttcctcgacctgtaaccgtaattcttttttcaaactgccgacgggtgcatgtgtcttccgtcggcagttttttatggcggatctgttccgattacttggcaaggcgtgcgatggcggcgctgacttccgccagcttttcgtcggcaacggtaccgccctccgccgcggctttggcgacgcaatggtgcagatggtcgtcgagcagcagtagcgccaccgacttcagcgcgctgtccgctgcggaaatctgcgtcagaatgtcgatgcagtattcgccgttttccgtcatctgccgaatgccgcgcacctgcccttcgatgcgattcaatcgtgcgatgatcctcttctggtcgcttgcgtacccatgctgtgtggcgttcatatcgtcctcctcgctgcgctgaaaattttatctacggctgaagtttgctcgtccttcttgccaatataccctataggggtatattgtgatggtgtttgccgaaatcgaaggccaattacggacggaaggcggctggaatatgcacatcgcaatcgcgcttattgtggcgctgctcgttactgcgggcgtgctgtggttcttcttcgcgccgcgcaaagcgtatcgtgcgccggtgcgcgacggcgtgcaggaagcggtcgtcgaagtcaaaggcgggtacagcccggccgtcgtcgaagccgaagccggcgtgccgttgcggctgatcttcgatcgcaaggaagacggcgaatgctcgtcgcatgtcgtgttctccgatttcggggtcgatcttgcgttgcccgccttccgcacgaccacgctgacgcttcatcccgaccagccgggcgagtatcccttcgcatgcggtatgaacatgctgcacggcacgttgcgcatactgccgggaaagcatgcaagtgtcggtgccgccgccggttccgcggttggttccgtcggcgccagtatgtccgattccggcgattcggacattcgcgcgactgctgacggtgcccacgcatccggttccgcggaaacaggcgtgcaatgcgcgcaaaaaggcgccgtccaaacgtccggttcgggtgattcgggcaaatcgcgcggatcggaatcggaaattcgcgccctcatcacccgtcttatcgtggcggccgtctgcacgattccggtattcggctccaccatgctcatgctgtatccgatgccgaactggctgcagttcctgctgatgctgccaatcgtcggctatgcggcattgccgattttccgcagcggtttcgccgcgatcgcccaccgctcgccggagatgaacgcgctcgtcagccttggtgcgctggccgcattcgcctactcctgcgtggtcaccttcgcaccgaacgtcctgcccgagaacgcgcgcgaaccgtatttcgaagcggtcggtgtggtcgtcacgcttatgcttgtcggccagctgctcgaagcgcgcgcccgcaaaggcaccggtgaagccatgcgcgcattggcgggtctgcaaccgaaaaccgcccgcgtggtgcgagacggcaaggaaaccagcatcgccatcgatgacgtgcgcgtcggcgacatcatcgccatccgtcccggcgagcagctgccggtcgacggcatcgtcatatccggcacctccaccgtggacgaatcgatgatcaccggcgaagccatgccggtcgccaaaaccgagggcagcgaagtgacgggtgccaccatcaacggtggtggctcgctgcggtaccgcgccacgaaagtcggcaaggacaccgtgctcgcgcagatcatcggcatggtggccgccgcacaaagctcgaaagcccccgtgcaacgattggcggaccgtatctccggcgttttcgtgccggccgtggtactcatcgccgtatggtcgtgcgcgctgtggttcgcgttcggccccgagccgcgtgtcacgcacgcgctggtcgccgcggtgtcggtgctgctggtcgcctgcccgtgcgcgctcggactggcgactccgttgtcggtgacggtctcgactggccgcgcggcccgtatgggagtgctggtccgttccgccgaagcgttggaaacgtgcggtaaagtcaatgccgtcgtattggataagaccggcacgatcaccgccggcaaacccacccttaccgatgtgctgccgttgggcgtgtggcatcggcgtcccgatgatttgctgacgattgtcgccgccgccgaacgtgattccgagcatccgctcgctgctgcgatcgttgccgcagctgcggaaaaagccgacgtcgcggacgttgcggaactcgcgcaaaccaccgattttcaggcgattgccggccgtggcgtcaccgcgcgcgtcaccttccgcggtctgccgcacaccgtcgccgtcggcaacaccgacctgatcgacgaccttgacgtcgacatgcccgacattacgtccgatacctccgaaattgcctccgagaccatccacgatacgaacctcgacgccatcatcgccgacatggaactcctgtcacagcaaggcaaaacgccgatcctggcggccatcgacggccatctcgccggcatcgtcgccgtcgccgacgtgccgaaagccgactcgcgccaagccgtcgagctgctccgcaaacgtggcgtcgaagccgtcatgctcacgggagacaatccgaccaccgcacgcgccatcgcaagccaggtcggtatcgacgaacgtcatgtgatcgccggcgtgcggccggaacgcaaggccgacgaaatcgcaaaactccaatcgcaaggctatacggtggcgatggtcggcgacggcatcaacgacgcgcccgccctcgcccgagccaacgtcggattcgccatcggcaccggcaccgacgtggccatccaatccgccgacgtgacactgatgggcggatcgctgatgggactcgtgcacgcgctcgacctgacgcatgccgccatgcgcaacatcgcgcagaacctcggcttcgcactcggctacaacagcatcggcatcgcgatcgcggccggcgtgctgtatccgttcaccggaacgctgctgaatccgatgatcgccggcgccgcgatggcgttctcgtcgttgtgcgtggtgacgaacgcaagccggctgcgcctgttcgatccggacgcggaggcggcgaaaaacaagacgtatcgggtacgcaagcccgatccgagcaagaataatggcaaccagcacagtcggaaaggaacgatcatgggactgttcagcgatcacaaggccaagaatgaagccgagaacatgggtgcgatgggcgccggacactgctgcggcggtcatgacggccacggcatggcttcgaatatgggcgattccgcggcgaacgttgcgaaggatccggtttgcggcatgagcgtcgatccggccaccgcggccgcgacccgcgaatacggcggcgtcacctactacttctgcaaccccggttgcgccgacaagttcgcccagaacccggccgcctacctgggctgagacctgattctcgtccgtccccaatctgccgacatcgaatgacatccggccgtcggcgggttggggatttttgttgaatggttgatttacggattccgattcacggacgaacgataagattcccctcccgcactccggagagcgcgtcccgccccgctacaaacgtgcgcgtgacgacgccgttaagcgtcatgccatcgcaggcgcagatcggattgcggctttccaaagcggtagcatccacaacaaaccgttcgtacgggcgaataatcgccaaatcggcccgcaatgccggcgttatatcgccacgatcgtcaagtcccacaagccgtgcggtgttgcacgacatccaccgcacgacgtcggccaaactcaagccgcgccgcatcgcacccgtcaacaccgcgcggaatccgacctgcagactggaaacgccaccccacgcggtggcgagcgtgccggctttcatatccgcgctggccggggaatgatcggtgacgacaccatccaacgtgccgtcggcaagccccgcccatagcgcgtcctgctcatgcagatcacgaatcggcggacagcatttgaccgcggtggcgttgtcgggaatatggtcgcaatccaacgtgaggtaatgcggacaggtctccgcgctgaccggcagtccttcggccttcgcccgccgcagcacgtccacgctcagaccgctggacacgtgcagaatatgcgtgcggcagccggtgcgtgccaccagccgtacgatcttgcgcaccgcgttcgcctcgcattcggccgggcgcgatgccgcgttcaacagtgttcgcaacagtcggggattttgttgccgcgttagtcgcccatttcgctggtttggcaccgtttcttctatgccgaatccgcccgatatgcgatgttgattgtgtggggtaatctgtttttgccatggtcggtcatctcctgatggtgggtcgcgttgccaagaggcgccgccactgcctgtgatggatgcatttcagtgcttacggcatctgaaattcttcattcgtcgtgacagttgtcggcggccaaacctggtgaaacccagaaagcaaggggtagcatcgtcaggagagcggatgcgccgcgtgagaatgtactgcagggaagggcgatgagcgtgacttctggaattatgctttcagacaatatgggggcttcgaaggacgccatggacgaggaaggcaatgctgccgcggacctcggcttggtggcgcgcatccgggaatccttcgattcgctgactgcgacggaacgtgaggccgcgcagttcattctgggtcatctgaccgacgtgctggtctgcaattccgtggaattgtcgcagttgagcggcatctcgcagccgacgctcagccgcctgtatcgcaagctcggctatgcgaacgcgggcgaattcagacgtgacgtgcgtcgcgtccatcgtcctggctctccggagctttcacggcacacccagtgcgacgatttggtcgccgaccatctgcgccgtgacgaggaaagcctgaaacgcacgtttgaaggcatcgaccgcgcgcaactgtcatccgcatgccaagccatggccacggccccgcatgtggcggtggtcgggtaccgcagcggctatcccgtggcgctgcacatgcgcgaacagctgatgcggctacgcggaaacgttgatattctgccgaatccaggccagtccatagccgaagatctggttgattatgcggcaggcgacgtaatcgtcatcatcggcgtgggccggcgtcttcccttcttctcgcggctcatcgacgtgatgcttgagcgcggcctgaccgtggtggtgattggcgacatttcggcgcgcaacgccgtcatcggccgtaacgtcgccttcttcaaagtggtgctgaactcccacgtgctgacgagcttcaccgcggcgttcgccctgatcgccctgatggtggacgaagtcggaaaatgcctcgtcgataccgaagacgaggtgcacgcgcgtatcgaaggcatcaacgattgcttcgatgcgctcaatgagcttgaagattgatagggaaaatctaggcgcggcacgtcccgttggaacggcggtaaacggaagtggaagcgggaatgggaacggaatgaattcaaaacgaaacatgctggcgtacgaccggtcctccaccggattgtgggtggctttgattttcctcgtatcgctgaatctgcggcccgccatcgccgccgtcgggccggtcctcgcccaaatgggaaccgaccttgcgtggggtgagggcgtgcagggcgtattgacggcgattccgctgatcgccttcgccgcggtcagcccgctggtcacgttccttgcacgccgcatcggcatcgacatgtcgattctgctggccctgctgtgcatcgcggcgggcgacgccatccgctcgttcggcggcggcgttggcatctggctgggcacggtggtgttcgcttccgccatcgccgtcggcaacgttctggttccggtaatcgcaaaacgtgactacgccggccatgtcgcgatggcgaccggcgtctattccggctgcatcaccgccggcagcgccaccgcaggtttgctgtccgcgccgcttgcgcagatgtggggcggttggcgtgcgtcactcgccttctggagtgtgcctccgctggttgtcgccgcgctgtgggcgttgcgtatcctgcacaatcgcaaagtcgttatcgcttccgccggcggcaccatcgaaaccagcgatactggcgatatcgatgatattggcgatcgcagcacgacggccaacgcacaaaacccgcattccgcacagcgaccggcatgttccacgcaatcgtcgcatggcgtgttcgcccgcgtgctgcgccgtccgatgacgtggtacgtgacggccttcatggggctgcaatcatccgctttctacaccatgtccaattggatgccgtccatctccgcatccatcggctacgatgcctccaccgccggcgtgcatctgttcatcttccaaggcatcggcatcctttccggcttggtcattcctaagctcatgaacgtgcgcggcaaccaggtctgcgcggcgctcaccgccagcgctcccatgctgatcgccggccttggcatgctgctgttgcctcacctcatgccggtatgggcgttcgtcggtggttgcgcgcagggcgcttcgctggtcgtggcgctcgcactgatcgcgctgcgcgggcatgacagcgccgaaaccgtggtgctgtcgggcgtcgcgcagtcgttcggctatctgatcgcgtcgctcggcccgcttatgttcggcgtgctggtccaggccaccggcggccaccatgtgccgctgatggtgttcacgttcgtcgctttcctgcagtgcgtcgtcgcggtcatcgtcggcaggccttccaaaatgtgacttttcgcgtctcatgaaatcgcaagcgtccgcagagggaagtaccgttagccgtatgacaagccctaagactgacgacggtacaatgcatctgctcgatcctgctcccttcggacgtatccttccggccatggtcacccccatgaaggccgacggagccgtagatttcgaagccgcgcaacagctggcgaggcagctcgtggcggatggtgccgacggtcttgtggtcaacggcaccaccggcgaatctccgaccacccacatggaggagaaggtcgagctggttcaggccgtcaaggaagtcgtggacgtgccggtcatttccggcgccggttccaacgacaccgcgcacaccgtgcgcatggtggagcagacccaggaggcgggcgccgacgcggtgctcgtggtcgccccgtactattcccgtccgtcgcaggagggcgtgttccgccactacaaggcggtcaacgactccgcggacaagccgatcatcgtctacgatgtgccgggccgtaccggactgcacatccagctggagacctaccgccgtatggccgaactcgaccacgtcaaggccgtcaaggacgccaccggcgacatcgcaggcgcggtgcgcaagcgcatggagaccggtctgacctggtattcgggcgatgacggcctgttcctgccgttcctgtccgtcggcgccgtcggcatcatctctgtgatcgcacacgcggccgccggtccgatgcgtgacctcgccaacgcgttcgatcgtggcgatatccacgaagcgcagcgcatctccgtgcagctggcgccgctcgtcgaagcgatgaacggcaacggcttccaggccgtgatggccaaggcctcgctgaaggtgcgtggaatcctcgactccaccgaaatgcgcctgccgaacgtcggtccgggcgaagcggaactcgtgcgcgcggaaaagggcatgcgcgccgcgggactgctgtgaaccgaatcgcatgatgcgactggcctgtcgcgcatgaacgccggcaggcacccaaattcctcgtttccgcataggcggagacaattagtaatagaaatccaactaggaaatggctacagaagaaaccacaaagacaacaacacacaagcgcggcagcaaggctgccaagcgcactgaaaccgcagtcaaggcatccaagaccaccaaggccgcgaagtccgagaagaccgccaccaagaaggccaagtcctccacccgcagccgtggcaacggtggctcgcgcaacggcggctcccgtggatcccgtggcggcaacggttcgaaccgtcgcccgtcgcattccgcgccgcaatccaccgcgccccagcaggacgaggtgctgatcgccccgccgaagtaccgcaagggctccatgcgcatcgtgccgctcggcggtctgggtgagatcggccgcaacatgaacgtggtcgaatacaacgggcatatcctgctcatcgactgcggcgtgctcttcccggaagaggagcagccgggcgtggacctcatcctgcctgacttccactacatcaaggaccgtctcgacaaggtcgaggcgctcgtgctcacccacggccacgaagaccacatcggtggcgtgccgtacctgctcaagctccgcccggacattccgctgatcggttccaagctcaccctcgccttcgttgaggccaagtgcaaggaacaccgcatcaacccgacgctcgtcgaggtcaagggacgcgacaagctcaaggtcggcccgttcaacctggaattcgtgaacgtcacgcactccattccggacgcgctcgccgtgttcgtgcagacccccgccggctcgctcatcgacaccggcgacatcaagctcgaccagctgccgctcgaccaccgcatcaccgatctggtggaattcggcaagctcggcgaaaagggcgtggacctcctgatgatggactccaccaacgccgaggtcccgggcttcgtcaagccggagacctccatcggtccggcgctcgaccaggcgttcgcacaggccacgcgcaagatcatcgtggccagcttctccagccacgtgcaccgcgtgcagcaggtcgtcgacgcggcccacaagtacggccgcaaggtcgtgttcgtcggacgttccatggtccgcaacatgtccatcgcagcagatctgggctacctgcgtctgcccgaggacaccgtcatcgacctgaagcaggcccatgacgtgcaggacgacaagctcgtctacatgtgcaccggctcccagggcgagccgatggccgcgctcggccgcatcgccgacggcaaccatcgtgacatcaccatcaacgagttcgacacggtgatcctcgccagctccctgatcccaggcaacgagcatggcgtctacaaggtcatcaacaagctcgtgcagctcggagcccgcgtggtcaaccgagacaacgccgccgtgcacgtctccggccactgcaacgaaggcgagctgctgtacatgtacaacatcgtcaagccgaagtgcgccatgcctatccacggcgaaaaccgccacttggtggccaacggcatgatcgccgtcaagaccggcgtcgatccgcagaacgtcgtgctggccgaagacggcgacgtcgtcgacctgtaccacggccaggccgcggtcgtcggctccgtgccgtgcggctacgtctacgtcgatggcgattccgtcggcgaactgaccgacgaagaactcgagaagcgccgcatcctcggcaccgaaggcttcgtgtccagcttcgtggtcgtcgacaccgagaccgcggatgtcatcaccggcccgaagatctacctcaacgcggtcgcggaagacgaaagcgagttcgacaaggtccgtcaccagatcgtcgagcagctgcaggacgcgatgatgcagggcacgcgcgacacctacaagctgcagcagatcatgcgacgcacgctcggcggctgggtggcacgacagctgcaccgcaagccgatgatcgtccccgtcgtcgccgacatcgcgcaggacgtggatgacgcgatgggactgaacgccgcgaaataagccgtaaatttaccataaattgaatcaaggcgacgtgatcggcacaactgatcgcgccgccttctgttaccagaaagaaggagtgacatgccaggagcaaacctcacccgaatcgaagcggaagaacgcaaaagcatcatcgccgcgccaatccattacacggtcaagcttgacctgacccgcggagccaaggatttcggctccgaaaccaccatcaccttcgacgcgaagccgggggagtcaagcttccttgacctcatcgccaacgaagtcagcgagatcaccctcaacggcgaaaccctcgacccggccgaagcatacgcggacagccgcatcgagctgaagggcctcaaggagcacaacgaggtcaccgtcaaggcgatgtgccagtactccaacaccggcgaaggcctgcaccgcagcgtcgacccgtccgacggcaacgtctacctgtatacccagttcgaagtgccggacgcccgccgtgtctacgccgtgttcgaccagcctgatctgaaggccgtgttcgacttctccgtgctcgccgccaaatcctggatcgtcacgtccaacatgcccacctcctccgtgaccgacaacgaaaccgtcaccgaggaaggcacgctcggcgatcacgccgccgaaaccaccaagctgtgggtgttcgagctgaccccgaccatgagctcctacctcaccgccatctgcgccggaccgtacgccgaatggcacaccgaatacgccaatgaggacggccgcaccgtgccgatggccatgtactgccgccaggcgctcgccaaggccttcagcaaggacgtcgactacctgttcgacatcaccaagaaaggcttcgccttctacgccaagacctggggcgtgccgtacccgtacgccaagttcgaccagatctacgtgccggaatacaacgccggcgccatggagaacatcggcatggtcaccatccgcgaccagtacgtgttcgaatccaaggtcaccgacgcctatgcggaacgccgtgtggtcaccgtgctgcacgagctcgcccacatgtggttcggcgactacgtgaccatgaagtggtggaacgacctgtggctcaacgaatccttcgccgagttcacgtccaccctcgccaccgccgaagccaccgaatggaaggacgcctgggcaaccttcagctccggcgaaaagagctgggcgttgaatcaggaccagctgagcaccacccacccgatcgtcgccccgatcaacgacctcaacgacacctacgtcaacttcgacggcatcacctacgccaagggcgcctccgtgctgaagcagctcgtgtactacgtgggccgtgagaagttcttcaagggcatcaacaactacctcaacaagcacgcctactccaacgccaccctcgccgacctgctcgccgaactggaactcacttccggccgcgacctgaaggcgtggagcgcccagtggcttgaggaatccggcatcaacaccatcgccaccgaagtcgaagagaacgaggacggcaccatcaagcgtctcgccctgcgccagaccgctccggccgagcatcccgtgctgcgcgcccaccgtctcgccgtcggcttctacaacgaggatccggaaaccggcaagatcgtgcgcaccgaccgtttcgaactggacgtcgacggcgaactgacggtcgtcgacgcggccgcgggcaaggcacgtccgtcgctgattctggtgaacgacgacgacctgacctacacgaagctgcgtttcgacgacaagagcctcgcattcgcgacaagcaacctgtaccgcttcgacgacgcgctcgcccgttccgtgatctggctcgccctgtgggacatgacccgcgacggcgaactgccggcacgccagttcatcgacacctcgctggccgcgctcgccaccgaacacgagtccaccaccttccgttacgcgctggcacaggtcagcaccaccgcatggcattacaccgctccggcagagcgtgccgagatcgtgaagcatgtggccgacgaactgttcaagctggcgggtcaggccaaggccggctccgacgaacagttccagctcgtcaccgcctacctgggctacggcgagccgggcgacgaggcgttcgtcgccaacgcgaagggcctgctcgacggttccgtggcattcgacggtctggaaatcgacaacaacttccgctggaccatcatcaacgcgctgagcaccgtcaacgcgatcgaccaggcgggaatcgacgccgaactggccaagcgcgaaaccaccgagaaccgtgagttcgcctatggcgcacgcgccgtggccggtaccgccgaagcgaaggcatgggcttggaacgaggccctgcacaacgacgagctgaccaacatgcagcttgaggctgtggccggtggcttcgcagccaccccgcgcgccgacttggccgaaccgtacgccgagaagtatttcgaggtcgccgactggatttgggagcacaagaccttccacatggcggaagcgctgctcgaaggcctgtatccgggctatgccgatccggcgaagctcgtggagctgggcgacgcctggctcgcctcccataaggacgcggacaacgccttgcagcgcattgtgcgtggcaacgtcgaggcttctcaccgcacgctgaaagtgcgcgacttcaacgccgcgctctgatagcaggggcgacaggaacgttcccgcttaagagccgtcatgtcgtcgcacgactttgattttgggtgcgattttcaaagttgtgcgacaagcgtgctggctttcataccctctaactcttattttttgctggttttcaacggaaaatgatagttagggggtatttctttatcaagtgttgccgcacgacttgattttccgccttgaaatcaaagtcgtgcgacacgaaaagggcattgcgcgccgtgaaatgctttgaattgtgaagtgttatgcgattgcgtcgtcacctgctggtttcggcggcacggttgagtacgataggtcacggaaatatcgtttgcagatagcgaggatttgagactcatgccacgtatgttcggaaccgacggcgttcgaggattggcgaatagggatttgacggcacagctggcgctcgatttgggtgacgccgcggtgcgtgtgctgggcgatgacgagcggagcgaattcgaaagccgtcgccgtgcgctggtcggtcgtgatacacgagtttccggcgatttccttgccgccgcattgtccgctggcatgtccgccggcggcttcgacgtgatcgacgccggcatcatcccgacgccgggcgtcgcatacctgacgtccgtgctcaacgtggaaatgggcgcggtgatctccgcatcccacaatccgatgcccgacaacggcatcaagttcttcgcccgcggcggcttcaagctgcccgacaccaaggaagacgagatcgaagcggtgctcggccaggattgggatcgtcctaccggcgccggcgtgggtcgtgtcagccatgacaccgccaccgcaaccaacctgtacatcgaccatctggtttccgccatcgcgccggtcggtccggacaagtcgcagccgacgccgctgaagggcctgaagatcgtggccgattgcgcgaacggcgccacgtccgtggtcgctccggaagccttgcgccgcgccggcgccgacgtgaccgtcatcaacgcgtcgccggacggctacaacatcaacaagaacgccggctccacccatcctgagcagctgcaggccatggtcaaggcctccggcgccgtcatgggcgttgccttcgatggtgacgccgaccgttgccttgccgtggatgaggatggcaacatggtcaacggcgatcagatcatgggcattctggcgcgcgccaagaagaacgcgggcaagctcaaccatgacaccctcgtcgtgacggtgatgagcaatctcggtctgaagttggccctgcgttccatgggcatcaagaccgtgcagaccaacgtgggcgaccgttacgtgcttgaagagatgctgcgaggcgattattcgctcggcggcgagcagtccggccacgtgatcaaccgtgaattcgccaccaccggcgacggcaccctgaccgcgctcaccctgtgcaacgaggtcgtcaaatccggtaagagcctgaaggaactggccgccgacttcccgcagctgccgcagacgctcatcaacgtgccgaacgtggacaagatggccgccaagaccaacgccaaggtgcaggccgcggtggaacgcgaagagaagctgctgggcgacaccggccgcgtgctgctgcgtccgtccggcaccgagccgctcgtgcgcgtcatggccgaagccgaaacccagcagcaggcagacgaagtgtgcgatcgcctcgccaaggtcgtcgccgacgaactcaccctgtaagagcccgcaaggagatatgccccatgttcggacacaactcgaaagtggacctcgaactcaaccgcgaggtcgaaaagctcatcaaaaccggcggcaaagagaaaatcatgccgattgtgcaggccggcgaaccggtattacgccagcagaccatcgcctacgacggccagttgagccgcaaaacgcttgacaagctcatcgacaccatgcgcaccaccatgctggaagcgccgggcgtgggcctcgcagccacccagatcggtctcggtctggctttggccgtcgtcgaagaccacgtatgcgaaggcgatgatggcgatccgcgcgaagctgcggaattccccttccacgccatcatcaaccccagctacgagccgatcggcaccgaaacccgcagcttctacgaaggctgcctgagcttcgacggttaccaggccgtacgcaagcgttggcttgacatcaccgcccgttggcaggatgaggacggcaacaagcatgaggaacatctgcatggctggccggcccgcatcttccagcatgaaaccgaccatttgagcggtgaactgtacatcgaccaggccgaaatccgaagcctgaccaccaatgagaaccttgaggatttctggtgcgaggatccggtaccgaccgaagcggcggccgaactcggcttcgaactgtaatcgcgtaaacgaacgagacaagaacgatgaatgcctcccaggcgaacacttgggaggcattcatcatattcgggattattggaatgttcgaaacatgagtattccaaatattccaatatttcagtattccggattcactagcacatcgtacgtatccgtgttccgctcggcatccgaacgcagatcccagccaggcttgcgcattccatacaacaccagcggcggtaaaccgagcacaagcacgactacagccacaagaatcgcatatgaaacgctatccaaaccggtgaaaccagccggtctcacgaaagtcaacacgaatgccgcggcggaagcgacgaaaccgacgcccgcgaccaaccgaatcgcaggaactcgatacgtgcggcggacttctggatgggtgttgcgcagacgaatcgcggcggcaaacatcaacatgtacatcaccagatacagcgcggtcgccatatccaccagcgtcgcgaaagccgtgttgccattggggatcaacacgaacagcaacgccagcacggtcacgataatgccttgcggaatcagaatgccttcctgcacgtcgtgggcattgcgcttctgcagcgcgggaggcatcagtcccgtgcgggcggccgctagcaaaccgcgagaaggaccagctatccaagccaccacggaagcgaacgcgcctagcgcgatgagcagcgaaatcaccggggtgccccaacccatgccaaaatggtcgaagaactccctgaacgccagattgatgccgtcgatgagccccagctcacgatgcggcacagcaaaggcgattgccaaagtcggcagcacaagtaccagcagaatcagcgcggtcgctagtgcaatggcgcgtgggaattgacgtcccggatgctccaagtcgttggcatgcacggcattgacctccatacccgcgtaggcgagcacattggatacgattagcacaatcgacgcgatgcccgtccacggcggaagcagcgcggatgcgtgcagggaggtctgcactggcttaccgatcgccagccagataatgccgaagacgataagcagcaacgcaggaaacagcgtgccgataagtcccgaaatcgacccgaccttggcgaacagattgccgccgcgcaacgccaccatcgtgcttgcccaatacaacacgatgatcaccgcggccacatatacgccattattgcccaagccacccatgccgaacacatacgacaggctgacggcgatgaacgcaatctgtatcggataccacaccacattctgaatccactgcagccaaatggcgagaaatccgatgcgattgccgaacgcctcacgcacccacacgtacacgccacctttccagccggtggccagttcggcagccaccagcgcggtcggcaccaggaaaacgaccgccggaatgagatacagcagaatggaagcgagaccataatcggccatggccggcagagagcgtagcgaggccaccgccaccacggtcaacatcgccagttggctgactgtcatcatggttttgccggttttattggcaacggttgccgtgcttgcgattgcgccgtgcccgtcagcgccgttccctctattcgccccggcatgcgcaggtatgcccgtacgattgcggtttcctgcgacggcagacggattgcgtggcgttgttgtcggtgccgtcgcagcgttcgtcgtggaacgtgcggacccgggatgtgcagctgcgcttgcatcgtgcgctaccacagcaagcggctttttcatatgaactgtcattgcagccagctttcgtaaacataatcgttgtgggaatgaacatgaatttccttaatgcgggaaacgatggaattcgtggaatgaccgcgaaatatcagtggtggaatccggatgcacgagcctcgcttggcattggtgaacgcagtccgtccagatacttcacacacgacttcaaatccttgatgaatgcttcggccatatcgtggctgaaaccgttacgcaccacaatgcgctgcacggtcacctgcgtcagatccaccggcatcggataagccggcaccagccatcccttcatgcgcagccgatcctgcagatcgtacagattccacttgcgatccggcttgtcgttgagcatccatgcgaacaccggaatgtcggaaccgtcgttccacagcgtaaaatcatccatctgctcgatctcgcccgacagatatttcgccacatcatgcgaagtctgctgcacccttcgatacccgtcgaatcccaaacgcaggaacatgtagtactgcagcagtacctgtgcgcccggacgggagaagttcagtgcgaaagtcggcatttcgccgccgagataactcaccttgaaaataaggctttccggcaggtcagcggtttcgcgccatacgatccatcccaaaccggggtagaccagaccgtacttgtgaccggaggtgctgatggagtagacgcgcttgacgcggaagtcccatgcgaggtccggctggatgaatggtgcgatcatacctcccgaagcgccgtccacatggatgcgcacatcaagtccggtgcgctcctcgatgcggtccagtgcttcgctgatctgttcgaccggctcatacatacccgtataggtcacgcccatgatggccaccacgccgatggtgttctcatcgacatacttgtcgagatcatggccgtcgagtactttgtggtcctcggaaatcggcacatagcgtggttccacgtcgaaatagttgcagaacttctcccagcacacctgcacggcgctgctcatcaccagattcggacgatcggtcggcaggtcggccttttcgcgggcttccttccaacggcgcttcaacgcgagtccgcccagcatgcaagcttccgacgagccgatggtggaggttccgatggcattcattggatcgggcgcatgccatagatcggcgagcatgtgccagcagcgcgattcgacttcggcggttttcgggtactcgtctttgtcgatcatgttcttgtcggccgcctccatgtacaggcggttcgcatgatcgtccatccacgtgctcacaaaagttgcaagattgagtcgcgcgttgccatccagcatggcctcgtcatgcaccacttggtaggcggtttccggcagactacccttctgtggaatggtaaatttcgagaacgcctgggcttccttcggacgggcgaacagcggattgatttccacgctgtcaggaacaacgcggtcgtcggcattgccgcaggtgttgtcgcagcaatgcgaattgttgttttcagtggtggaatgtgtttctgacattgcagttcctttcgttgatttggaacgtttattgcgttccgggattcaaaaatgaaagtcgattctggatttttgctgggaaatggtcacatttgcgctatgtgaaaattcgtatgacaaccgcttcgcacggaggtatctgcgcgcggtttcgtaatgaacaccgtcattcgaactcgcatggttgtgttctcacaaagaggaatgcgcacgttggtttgttgcacattcttacacgctgaaggtgggtatcggctacgatgggcaggtatgaacgaatcgacgatgaatctttcctggctggatgacgcgaagcaggacatcgaacaatggtcggcatcgatgccgaatgacgccgacaaccagccgatcgactggcgatgggtgtcttcccttgacctgcgtaacggcattggtgccgccacaagacagcacgttgatttgttggcaatgctgcggtcctcgtcgccgcaactttccgccccgcagctgcacgccctgttgaaagatgatcttgcgattcgagatcggctcgaaccgaccatcgcgcagtgcaacagcacgttcatgatggattacgaccgacttatcgcttcctatcggctgccgcgcgcgcttgcttacgcgaaccgtcggttgtgcgacgaaatcgctgttctgcgacagattggcgtggcgatgggattgtggacggtcaccgaggaacgacgtgagcgcgtgacggttccggtgctgctgcccggttcggctttggcttccgggggagtggcgttggatgatattcaggatcgaaccgctgacatcgttaacggccgcgccgcccgtcgtgccgcagagaaaagtcagaagcgagccagtgactatgccatgtcgcgtgcgaacctgagtggagtaaccagtccgggcggctccacgttgtttgattacggttcggaaacgaaatccgctgaagcggcgcagttgcgtcggatggctgaataccgcaaatcggattggcgcgacgcttatcttcctggacgcgatgtggacaatgtcatgggaatcgacatcgaaaccaccggtactgacccggcgcgtgtgtacatcatcgacgtcggctttgaatatatgaacatgatttcccctcgccctgctgccgcacctactggataccaatacgagcagagttattacgaaacgggcgatgcgtatggtcagtcgcgtctgtcgttcggcgttcctgccgcgaacgcgacgctcggtaatccgctgattctcgatttgaccggtatcgatgtacgtaatcgtgcgtccggcttccgcctgttcgatgagtggccggaggctcaaatcggtttgctgcagcgattggagcagcaaccgtacgtagcgcacaacgctcgtttcgaacatagcttcttcatgttgaatgtggctggatatgcggaaagctaccgtgcgggcaagattacgattatcgacacgttgccgatgagccgccgttgggatgaagggtcaattccggacgacgagcatccgtacggcaataacacgttggacgcgtacgccaaacgccagggtgcgcttgacgagagcaagtcggaacgtcacctcggtttggaagatacgcatatcatgctggttgccatgaaacatcacttgggtgtattgcatggcgaaggccgcggtccgtggggtgcgaatggcaagtctggcatcggtggcaagcattgcgggcgccgctggtagcatttgcgattcgtgtcgcagtttcctggttcttcttcccgtgaccgtcccgttttggctttcccttccggcttttgttacccgtaacgccgttttgcggttacaaaatgcggatgcgattgcggatttgcggggatggaatgggcgattgcggggatggtttcggtggttgcggggttggtcgggcctggtttgtcaagtttcgacacgccgatggaacgttggatttccaacggttcgcgcgttgttcatgcggcccgggttgcgcggatcgcgatcgtgctgtaagtttatctcttgctgccgctcagcgagtggtccggatggttccggtccgcgaggtgggtgagtggtggtggtttgagaactcaagagcgtatttgtactacttctttatagtcaatgattgccagttcatcgtccgctccttgcgagtggccgggaggccttgaaggacggtgaggtttttgtgcgatgcgcctttccttataaggcgatcgtcaattttcttatttcgaattggtattgccctcgatcgtctggactcgctcatcacccttcatcagcgtaagtatgatggctgcgccaatcccctatttttagaaaggcgcatctcatgcaggaaaccatcacatcagaatcgctgttctgcgactactacgcccagtgggtgaaaacgtacaaggaaggcgccatcagagacgtgaccatgggcaaatatcgacttacgcaatcctggctcggcaagctcatccctgaactcagactcaccgatatggatcgaaccgcataccagcagctcatcaacggatatgcacagcatcatgagcgccaaaccaccatggattttcaccatcagatcaaaggcgccattctcgatgccgttgacgaaggactcataccccgtgatccaacgcgtaaagtcatcatcaaaggcaagcagccacgcattaagaaaatgaagtatctcaaccaattcgagctgcatgccatgctcgcggaccttgatcttggggccgaggcaagctgggattggcttatcctccttatcgcgaaaaccggactccgattctctgaggcgcttgggctcacacccgatgactttgatttcgcacaccagacgctttccgtcaacaaaacttgggattataaaaacggcggcggtttcgtacccacgaaaaacgaatcgtccgtgcgtaaagtgcaactcgactggcaactcatcatgcaaatgtctggattactcaaggatcttccgcatgataaacctattttcgtgcacggcaaggtctacaactcaacagccaacgacgtgcttgcaaaacattgcagaaacgtggacgtgccagttatttccgtccatggtctgcgccatacacacgcatcgctgctgctgttcgccggcgtatcgatcgccagcgtgtcacgccgtctaggccatgccagcatgactacaactcaggaaacctatctgcacgtcattcgcgagctggaaaacaaggatgtagatatcgtcatgcgggcactatcgacacttatctaatgggggttcctactcttttcagatattcgaaataatcgagccactcgaagcggcatataccgtttttcaccatcttcagtaaaagcgccaaacaccgttgccagactcaattccgtaggtggttttgtggttccgtaggtggttggttctggtattggtgtctgagaatggcttaatttaagccgtttctcaaacgcctttcctccggcaaccacctacggaagcgaaaaaccacctacggaacacccgcttgggaacaaacccgccgcaagtcaccaggccaagacgaatctcggcacacgaggaaccggaaattgtcgttccggagcgcagccgcacggtcacacgccacactccggaaccaaaggcttttagaaataggtgctacagccaagcttgacggcgaggacgatgccggtgagcacggcggcggcgcgcatgatgttctcggggatatggcgtgtgaccggaggggcgatggaactgccgatgatgcagcccaggcacatggcgatggcgaacggccagtagacggagccacggcagatgaacatgatcgcggcggagatgttcgcgccgaagccgaccacggtcttcagcgcgttgatctggtggaacgggccgatcttgccgaggtcgaggatcgccagggcgagggtaccggcgacggcaccgaaatatcccgaatagatgccgacgaagctcacgccaacccacagccaccacgggtcgttgcgcagactgccattggccgtcctactggcgatcagcgccgcgcgctcgccttgctgcgattggggcaacgcctgcgcgacagcgtcgcgtgcggccgctttcttccgcgggttcagcgcgatgataagcgcgctgaacaggatgagcggcggcacggcgaattcgaagaccttcgcgggcaattccaacagcagcaagccgccgatgatgcctccgaccaagccgatgcaagcgtagacagccacacggcgtccctggcccttgagctccttgcgggcggagagcaggccgccgatgccggtgccgcatacgcccaccgtgttcgtggtgttggacagcacgggcggaatgccgaacgccagcagcgcaggataggagatcagcgaggacgcgcctaccgcgtatccgacgaatcccgcgccgattccggcgacaagcaccagcagcaatgtggtgatggacactcctgcgatcatgaccgcttccccttcgtaaaactcctacgtagtcctcctataagtaacgggagccaagcttaacggctcggctcccgcatatcacgcgtttgcccagaacgtggccgggcaaacgtcatatcagtggttgcgcttggcgatcagcgactcggtccagtaggcggcgagcggaatcagcgcccactgcagcgcgagaccgggcaggccggcggccaggtcgctcgtccatgtggcggcgatggccttgctggaaccgaacgcgaacacggcgatcgcggtggctgcggtcagcaccacacgtccggcgagctgtgcgatgaccaccttcgccaggctcggcagcttgatgccgcgcagcagaccggctaccaggccgtatgcgcacagttcgaccatcatgagcggcagcatcgccagcatcggcatgccggacagcaggaagctcacgagcggagcggcggcgccggcgatcgcgccgacggcggggcccgcgatcaggccgacgaagatgatcggcagatgcatcggcaggaacgcgacgcccagcatggtgccctgtccggagacggcgccgatgacgtggaacagttgcggcagcacgaccgctgcgacgatggcgagcagggtggctgctgtcttggtgccgagactcagtttcggcaggtcggtgcggcgcagggcggccgcgggcatggttgcggaatcagacatttgttttctccttaatgtttccttctcttcggatatgcgtatacgtcataccggctcgacgaccgacccaccgtccggcagcgcggtgtcgaccagcaaatcggcgacggcttggatattggtcgcttcgaaatagcggttttccagcggaatccactcgtcgacgaatcgttgcaacatgcgtggattgcgtcgttcgagccgacgcaactgttcggcaggatcgaccgcaagacagatcatgcaatcgtaatacctccgcaaggcggggtgcatgctgtagctgccttccacaatggtcagctgggccggttcgacggcgtacgcgacggcgaaatcgcctgtatggcaatcccatggccggtattgcgcggcttgtccggcggcgagcggtgccaacacttccgtttcgaaccgttcacggtccacgttgccgccgggttcggcgaaacgttccggcgtgcgctgttcgggacggaggaagaaatcgtccatgtgcagcacgttgccgccgaaacgcctgttgagcatcgcggcaaacgtggttttgccagacgtgcatggcccgtcgattgcgacgaacacacaatcacgttcggcaagcaacgtttcgatacgtgcgattgcgatgctggcttccgtaggcttcgcgggtttcgtgaccattgcgttcgccgtcagtcgagtacggtcagacggtacgcgcgcgaaccgatgccaagttcctcggcgtattcgaggatgtgttcgccgtggagcgaggcgatgcgttcggtgacggacgctccgtcgggggcggtgtggatgaggtcgacgcatgcctggtcgagtgccaccgggtcgagcgaggacagcacgccgatgtcatgcatgtccggttccgtcggggaggccaggcagtcgcaatccaccgacaggcggttcatgacgttcagatacatcatcttgccatgcatgtggctgatcacggcctcatcggcttcggccatcgattcgaggaatgcatcctgaggagtttccacccacttgtccttggtgacgccggcggaatggatccagcgtttgccgttcgacgaggctatgccgatggacacgttcttgagcgcgccgccgaagcctcccatcggatggcctttgaaatgcgacagcacgaaaatggaatcgtagtcgtcgatatgcttgccgacgatgtcgtaggcgatgtggcggtgcttggccaccgggatctcgatttcgccgctcatgtccatgatctggattggcgcaagatcggcgtatccgtgctttttgaacgtggcaaggcttttttcgggggtttcacgattgccgtcgtatgcggtagcgcattccacgagcgtgccgccgatctcctgcacgaggtccttgacgagcgaaggattgagattattggatttttccgattcgccggaatggactttgatggccgttttgccttccggcttgcgtccgagcacatggtaggcggcgacgaggctttccggtgtgatgatcggcgtgaagaacacttccggtgcggactgcgcgtcggtgcggtgttccagtccttccagtcgcgaggcttcgaattgcatcttgaccctccttgattctgcctgtgtttttggcttgcatctccagcgtaccaacttaaacccgacttgaagcaaacagacctcaaacccgttcgagatatgttgcaaaatatggattcccgcgcgtgtctccccatccggccggcttgtccgcatgaaccggaacacttgacgctcgtgattgatttttgcaagaaatggtggactcgcatagccaccaaggaaatggcgttcattggcatcgtcacgttggcggcctctctggtggcttcgtggctcaagcagtttccgggattcagcctgttcggcgcgttgatcatcgctctgctcatcggcatggtcgcgcagttcccgatccgcaaatggtattcgagccgttccgccgaacataaggccggtgtgaaggatgcggccgggctcatttcgaacaagctgcttcgcctgggcatcatcctgcttggtttcaagctcaatctgacggtgctgttcacgcagggtatcaagtgtctgccgatcgcggcagtggtggtgacgctcaccatcgtggtgtgctacaacatcgcacgcaagcttggcgtcgatccgcagctcgccattctcgtggcgggcggtaccggcatctgtggcgcggcagccgtcatgggattgtccggctccatcaaggtgccgccggaaaaagaggatgagaaggccaacaatgaggtgatggccgtggccatcatcgccatcatgggcaccatcttcgcattgctggaaatcgcccttgggccgttgacgggcctgagcaagacgcagttgggcatcaccgctggcgcgtccctgcacgaaatcgcccatgccgtggcggccggcgacgcgttcggcgcggtggacatcgccaccatcatgaagctttcccgcgtgctgatgctggtgttcgcggccatcgtcatcgccatctggtgggacagaaaccattccgaaataccggccgacggcaaacgcaaagtgtcgttcccgtggttcatgctcggtttcatcggcgcttccatcatcggcacgttcgtgccgttcatcggtgccatcgcaccgaatctggtcgatttcgcatacatcgtgctcggcatggccatggccgcgcttggcatcaacgtgaatttcagcgccatcgccaagaagggacagaaagcgttcctggcgagcttcctcacgtccgtgctgctcatgtgcttcgcggcgggaatcgcggcgctgttcttctaatcgccttccgttgtgccacgctgtcgttttgcggagggcagttggatttcggacagcagaatcgcaccgaaaatcagcgcgaaaccgcataacgacggcacggtcagcgtttcgccggtgaaaatcacggataccagcatggcgaagatgcattccgtgcttaagatcacggacgcctcggaagtgggcagattctgtatggcgatggtttgaaacacttgggcgatcaccgtggagccgatcaccaggtaggcgatgcacagcacgatgtcccaccgcgcccaagccatggacggtccgccttcggtaagcaccgcgccagcaccgaacagcagggcgcaccacacgaattcggcaagcatcagcgcgatcgcgtcgaaatccttgccaatgaaaccaaccaaaaccagattcaacgcgaagaaaaacgcgccgatgatagtcatggcgtcaccgaagctcatatgcatgagttccgcgccaccgccgccgctcagcgacaccagaccaatgccgaacgcgcagacgaacgcggccaccagatgctgccagctggggcgtttgcgcgtgaacgcccacaccacgaacggcaccatcacgcaataggtgtcggtgaagaagctgttgcgtccgggagacgtggtttcaagtcctttgagctggaagatgaatcccagccagtaagtcaacgcgagtatcagaccaggaacgatatagcggcgcaggcgaatcctgcgaagacgtgggaaaaacacgatggccataagcagtaccgccgaagccatgcggaagaacatcatccactgtgtcggcatgttctcctgcacatgcttgagcatggtgtagccggacccccataccgccgcgttgaccagcatcatcacgcgggcgaccggcttcgatacgctaatgccttccgatgattcctgccccgcgtctgccatccgtccccccttacacgcttccacacatccgacgtcgtattcacgtcatgctttccgaaggaaactttagacgtggctgcggaagcaacacgcgggagcatgctactgcgctttggccgcctggctgttcacccagttgtcagccatgtcaatggcttcgtcaagcgtgaccttggccgccttgtaatacttggaatccttgatgttgctgctttcgacgagcttctgtccggagtccgcggccttggacagcgcggacagcagtttgcgcccggtcagggtcagggaatcgtccttgctgagtttgtcgaccagtttgtctgccttgtcgatcgactgttgcagttcctttttggattcatccaacgatttcgtgtcggaggtgccgttcgaagaagtgctgttcgaagaggctccgttcgattgcccggatgggttattggacgattgtccggctgccgcgccatccgaatcggccttcggatcctgcaacgcggtttcggcgtttttctcttggatgcttttcagactggcgttcagggaatcggtggcgctgtccaacgttttggctacgagattgagctgcgtgatggtggcttccgccttgcagccttccgtatcgactgtgttctcggcgctggtggccgcgtccgcgaacgcgtcgatgatgtcgttcacgccgagcgcgcctcgaatcagcttctgcagttcgctgccgttttcggaagtgtcgagcacggctttgcgggccgagctgaattccgcgagcgattgccggcatgtggccaatgcttcctgctgcttgttgcggtaaacgcacacgccggcaccgcatgccacgatgagggccacgaccacggcaaggacgatcggccatgccttgcgggggctggaaggctgttcagtggtctggtactgataatccatacgtgtcaccccttgcgaaccgatagctgtcatcgttcttcgtcttgttaaccttgcctattgtacgggcttgaagatgggaatatcctgaatgggcatcctgcgcacaccaatgacgcaggatcgggctggcatatcgtctctccgcaggcgtgccgcatgtccatcacggccagcagcccccgtttgtccgctcgttcgacagccatgtccacgaaatcgaccggcagatgccgtttgtcggcgatttgccgcaccgtcaatcctgcggcgatgtcgccggcgatgcgtgcgacgatatcgttccggccgtcgccgtatgtatcagccgtacgtggcgtgcgccgccatccgtgcgcggaagcgccggaccgttccataccgctcaccatatcaaccgcaatgtttggaaggcgatgatggcgatgacgtatgccacggccaagctcagcaggacggatcgcgccgcgactttcgtgccgaactgccgtcgcatttcggcgaccgttgcaagacatggcgtgtaggcgagcgtgaacagcaggaaggcgatggccgccgccttgccgtggccgtgcgatgactggtcgaacgaggcgcgcagcttctgtcccagcgttccctccccggcttgttgggacgtcgcatcatccggttcgtccgcatggtatgactgcgacatcgaaccgaccacgacctctttggccacgaatcccgtgatcagcgcggccgaggcatgccagtcgtcgaaaccggccggcgcgaacacgggagcgaccgcgtcggcgagcacgccatacgcggaatcatgcacgtcgtcgacatgagcgaaaccgcctgcgttggcggttaccggaatgccctgcagcagccacagcgccgtgatcattgaaatgatgatcacgctggctccacggatgaagccccatagacgcagcagcaccgaacgtgccagctgcaacgcgcgcgggcattggtatgcgggaagcgccagcatcaacggttcgggttcgaggccgcggaacatggtgtggcgcagcagcacgccgaccaacagaatgaccatgaccgaagccacgtacatgaggaagaccacgagaccggcgtatttcgggaagaacgcgtgggcgagcaccaaaaacaccgatagtcgcgcggaacatgccgcgaacggcaccagcatgccggtaagcacccgttgccgggaatcggatagggttcgtgtggcggccaaagccggcagattgcagccgaagccgacgatgatcggcaggaacgcgcgaccgtccaatcccaaggcgcgcatggcacggtccatcacgaacgcggcgcgggccatgtagccggaatcctccaagattgacagcagcaggaacatgatgcccatcaccggaatgaacgtcagcacggtgaccacgccgtcaagcagaccgtccaccagcagcgaacgcagccagccgccgctcacggatggtccgaacaggccgagcagcaggtcgagtccatctgtgcaccatccgcggaaggtcacgtcgatccaatcctgcatggggctggcgagcgtggtggtggcctggaacacgacgaacagcaccgcaaggaagacgaggacgccaatcacggggtgcagcagcacgcggtcgatgcggtcggacaaggtgacgtggtcgaccgcatgcatgtcgagaccgcgcaatatgccggcggtccaatcgagtcgtgcgtcggcccgcgattcggcccagacgctcaggccgtcggcggttttcatgtcggcgtcggctgtcgcggttggcagtgcggtcagcccgtgcggaacgggcgttccctcgaaacttgcggcgatcgcgtcggccaaagccttgccgccgtctccggtacgtccgtcaatcgcaacgaccggcatgccgtccagcaaatgggacagtcgttccgcatcgacgccgcagccgttgcggacggcgaggtcgttcatggtgagtgccacgacggtgggcagcccgagctccaccaccatcgacagcaggtacagcgatcgggacagcgcggtggcgtccagcaccacgacggcaaggtcgggaacgggcatgcccgacgcgccggtcaacgcgtcgacggcaacctgctcgtcgggactcatcggagatagcgaataggttccgggagtgtccacaaactgccaattctgcggatttttcgtcgttttcgagcttttgtaccggtattgcccgcaagtgatggacaccgtggtgcctggcgcgttcatcgtacgggtcctcgcgccaagcagcgcgttgaacatggaagatttgccaacgttcggattgcctacaaacacgacgcgttttacattttcgacgtttcccatattgccggagtcgccgcccatgccgtcattcgcgggtctgttgacacgacaagcgcgatgccggcaacagccattctgcgaacggcagcagtcgccgcccctcaggttccgtagattcaacattcgcgcatattcccgttctcttcgcgttacgcaacgtcgtcttgcgcatgttcatcccgcgcgaaccgtacccggacggcacgcgcggtgccgccgtccaccgcgacacgttcgtttccgaatgcgacgacccttccgccgaaagcgctccgctgcatgacccgtaaacccgcgcccggagccaatcctatctcacataggcggaaccggtgccggtcatccaggtcgatgccgtccacgacaacgcgcatggcgcgcggacagtcgcgcagcgtcatgatggcgccgcgctcccccgcccgacgccgcaccgtgtcatcgaagcggcgagcatgcgtattatccatgttttcacacatagcaggaaacgaagcaaagcacaagagtgtttttcacggaactgaaccgcaccccaattgttggacgtcggtaagtgggatgcagtctgagaccgcgatctggcacgcatcatccagactttggtcgacgatcccattgagcaacgcattcgcgaacggcgcgtccaagagcaggacggcgaggccgttgccgacaatgccccggtcaatacaggctgtggcaacgctgccgacaatgccactgccgaaaaacgcaagcccagtgccgccacattggcggcaataacagtaccggcacaagcggcaccgacgcggttgccgacaatccgctggagctggtggaatccggttggtctgtaagccaacaggggtacgttagctacgcattcgccctgcgcaacaccagcacaaccctgcaggtacagtatccagaagtcgccatcaccggcgaaccaaagacggctccatcgtgttctcgcagacgcaaacgctgaatatggcgttcccgaatcagactatatataacgccgggcaagcgggtcaaggtaccgcaccggccaccgtggacttcgttgcgctcagtccgaatgagtacaacgtcacggaagcacaaggcactgccactttccccatcagcggaatctccaaagtgcgcaacaacgacggcggcacgaccttcaatggcgaagtccgcgccgtgaccgatggtttcaagccttcagatggacagcagatcaaggtttccctagtgttgcgggataagcaaggtgccatcatctatggagaaatggcatttgtggattggccggacaatggccaatccatgcctttctcgatactggtgtacgatttgccggactacacgtcctacgagtcgtacgcacaaatttggtagttcggcttaatcgccatcaggccgcgttacgcgccgcatcgacactagtgttgcgccgtgcctggccgaatacacggccagccatcttctcatcggtctcggtctggatgatggtgcgcatcgggcccatgcagatggccgaagccaaaccgttcaccacatcaatcagcaaatacgccagcagcttatggaccacgccaagaccaacgacggagacgcccaccagagtgacgccgaaggcgaccacgcgcatgttgttgcggacgatgatgacgccgaatcaccgatcatcctttgggaacaacgcgtcgaaggcatgttccatcacggacttacggcggatcacaccgacgagtctgccatcaccatccaccaccggcagtttcttgaactgcttcttggcgaggattcgggccacctctccaacatgctggtcgggcgtggcggcaacgaccttacgcgtggcgatgtccatcaccttcttgccggagagcgcctgcaccttggaggccacggtttcgtcgtcgaacaccaccatcgtcgaaccagtgccggtggaaaccgtacgggattcataggtggcaatcgatttcatgacatcgccgtcgctgacgaagccgacgagcctgccatcgccgttcaccacgggaaggctggaaacgttgaggcggatgaactcgcgcaccacatgcgtgatgtcatcgctgtccaggcagctgtagggatgatcgtccatgatcccactgatggactgttcctgggtctgcttgaacagggaggaggcaggggccacgtatgcgccggcgtagtgatgctcggcgggctggccttcagtggtttcggccgcgacttcggcggaggcttgcgcctcgtaggccttggcgttgcgtgcggccttctccttggcacgactggtgacggtgaagatgcagatgatcagggcgaccagcgagatggcggcgcacagcaggtaggagaacgcgatgccgctggccgtggcggacttcacaccctgggacatgtgcgaggcggtcacggatgtttctgcggtaaccagaagcgaggtcgcaatggctgccgcgatctggcggccggtgttggcgatagcgttgccatgggcgatcatgtcgttcggcaaagcgttgacgccccaagtgttgatcggcatgttggcgatagcctgaccggatgcctgcaatgcgcagaacacggcgacaaacagcactgatgtcctggtgttgatggtgccgagaagaccaagagagatggtcatgagcgcaaggccgccgatgcccacgccgcgcgggccgaatttgtcgaatgcggcaccggcgaccggactcaggatgatgccgaccgccgcggcgggcagcatgaccatgccggtgacggtggcggattggccgagcacattctggatgaagataggcaacgtcacgttggttgcggcgactgcggcgttgatcagagtgaccagaatcgcggagttgcggaagttgcgggtggcaagggtgtcaacgcgcaacaatggctcatcgagcttgacttgcttgtatacgaatgcgacgaaggccacaagaccaacgacgattgaggtaatgacgaccggactggcccatcccatcgtggaagcggacgagaagccatagagcaggccaccgaacgcgatggtcgaaaggatcacggacaggacgttgagctttgggttcttcaactcgctgacgttcttgagcatcatcgtgcctccgacaaggatgaccagtgccacgactgcgatgccaatgaacatcgggcgccatccgaaaccgtcaatcaccagaccaccgacaaccgggccgatagccgggccggcggccatgacgataccggccatgcccatggcggtgccgcgcttatccggcggatagacgagcatcggcactacggcgaccaatggcaacagcacgccggagccggcggattgcagtatgcgtccgacgagcaacagcacgaaattcggcgcgacggcacacagcagtgtgccgaccatgaaagtggcaagggctccggcgaagagctttcgggtggagaatttatcaatcagatagcctgaaatcggcaccatgatgcccgagaccagcatgtagacgctggtcacccactgcacggtgccggtggtgatattgaaatcacgcatcagtgccggcaaggccggtgacatgacggtctggttgagcagcgcgatgaacgagccgacgacgatcacgcccacgacgatgaatcgggcgtgcgaatcaataggctttacggaactggcggcggacccgaattccgcggttttctgtgaggtcacagcatttccttctgttggtaacggcatgtgtgggcgatccggccccatacttgtgtcaagacgcggggacaccgatgagtccggggtaaaggaaaagccgccatccgttccgcattcatatacggcaaacgattcgcggctttgcgtaagttgatggctatggtgagcgattcatgcgacgtcgaccgcggatgggccatcggtacatcccggcataaggcgtgtccccgctacaccagcatcgagaatagggccatttgtggattggcaaacagaacattgccgacgaacgacccacggcaggtgcgtgcgatgaacatcgcgtagcgatacaggttcatggcatctccttgatgggtcttcgtacggcagacatcgagaagcctatcatcattcagatcgacggtgaaacccacgcatgctcgacaatacacaaaatctttacaaaaggattgggcttaccgcatacgatccgcctgggtaacggtccgaggatgaatcaggggcgagacaagggttgcgtctcgtgtttccgtcatgatgtctggcaaaatagtgaagccggacatgcgaggcatcgaccggaatcggaaaggggcaaatcatgcgagttctcggcaatatcctgtggatcattcttggtgggttggccatcgcaatcggatgggcattggtgggactgattctgtgcatctccatcatcggcatcccgctcggcattcaagcgttcaagatggcgggactcaccctgacgccgtttggcaaaaccgtgcaatacggcggcggagtcggctctgccttggccaacatcctgtgggtggtgctggtcggctggtggatggcgctcggctatctgggagccggcgtactcaactgcatcaccattatcggtattccgttcggattgcaatcgttcaagatggccaagctcgcgctctggccattcggagcggaaatcgtcaacctgtagattccaaatactacaaagccgccaaagcaacccttgacgaggcggtcaccgacgtcaacaattggattgaccagcaagccgccaaggccgaataataaaacacacattatgctgctgcagcagccagtccttgcagaacaatgtcatgacaaaggcctgagaagacgacttctcaggccttatccgtgccgctcatcagtcgcttgtagcgacagctcccctcaaagaggggagccagagaaacacttacttcgagatgttgaacttgaactccacaatatctccgtcggccatgacgtagtcgcgaccctcctgacggagcttgccttcctccttgatcttcgtcatggagccttcggcggccacgaaatcgtcgtaggagacgatgtcggccttgatgaagcctttttcgaagtcggtgtggatcacgccggcggcctgcggggcggtgtagcccttgtggatctgccatgcgcgcacttccttctcgcctgctgtgaggaaggtggacaggccgagcgtgtcgtagccgacgcgtgccagctggtcgagaccggattcctcaagaccggcgtcggcgagcatttcgcgcgcgtcgtcctcgtcgagttcggtcaggtcggcttcgaactgcgcgttgaggaagatggccggagccggagccacggatgcggcgagcttggcctgcatgtctttgttctgcagttcggcatcgtccacgttgaacacgtagatgaacggcttggcgctcatcaagtgcagatcgtaaacggaatccttgtcgaaacggccttcgcgagccgccttatcaatggtttcgccggcttcgagaatggtcttcgcctgtttgacggcctccatgtaggccggttcgatcttcttgccgcgcaaatccttctccagcttcggcagcgcgttctcgatggtctgcagatcggcgaggatcagctcggtgttgatggtttcaatgtcgtcggacggatcgaccttgccgttgacgtgcacgatatcatcgtcttcgaaggcgcgcacgacctcgcagatcgcgtcggcttcgcgaatgttggcgaggaacttgttgcccaggccttcgccttccgaagcgcccttgacgatgcctgcgatgtcgacgaaggtgacggtggccggcacgatcttctccgtgtgcacgagcttggcaagcaccggcagacggttgtccggcagcggcacgatgccggtgttcggttcgatggtggcgaacggatagttttccgccagcacgttgttacgggtcaatgcgttgaacatggtggacttgccgacgttcggcagtccgacgattccgatagtaagagacatggttccttagcttagtattaggcttcgatggcgtcgaccgctttgatgaccgcaccgcggaacgcgctttcctccaacgatgcgacgcccttgatggtggtgcctcctggagagcagacagcgtctttcatggcacccggatgcatttcgtcggccaaatagagcgcacccacgccttccaccattttggcggccagacgatacgcggtggcacgctgcaaaccatatttcacaccggcatcgcccaacgcttcgatgtacatgtcggtgaaggccggagcacagccggcaatacacatggcgatgcccatgtgtgcggtgtccacgcgttcgatcaggctgattgacgaaaacaggttttcgaaggtttccgtctgttcctgcgtgagcgtgttgtcgacttccgtgaccagcacgcctttgccgacagccatcggcgtgttcggaatggtgcattgaatgtgcgcctgttcgaaagacgttccgaacaggtcacggaatttgttcagatcccagcctgccgcaatggacacgacgatggtgtttggctgcgccagcttgtcaacgatcggtgagatcaccgcttcaatctgatatggtttgatggcgatgacgaccacgtcggcggcttcggccacttgtgcggcggtatgcaccgctttcgcaccaagtttggcggcgctgcgttccagcttgtcatagtgtgccgcgcaagccacaatgtcgctgccgttgatcgtgccggcattgaccaggccttcggcgatcgcctgtgccatattgccgtatccgatgaatccgatggttggattggccatgtttctttcctttgctatcgatgctcgtcgttgctgaacgatcgtcagaacaactccgccaaatctccgcggttcaatgcttcattgaacaggtgcctgaacactgttgcaccatgcacgccgtcatgctcgaactcattggtagtccaataatgtgaacgaccgacgcgggacagcgtgtcgagctgcaatccagaatctacgtacatgtcgtcgaaatagacggcagcctgcagcggaacctcattgcgcgccaactggtcggcatcgtagatcgtgccgaaatgcgtgtcttccataagcacgtccatggccggtttgaacggacgcaacgcacgttcctgctcgaacatccacgggaacatggcctcgccggtgaaattaagcggacggatgtcacccgcgaattccggatgctcgccgcgcacgcgctgggcggcccagcaaatcggcgtttccagctcgccgttggcgtagatgaactcctgcaacggccagtacagcgggcgagacgaggtcgcatccatcacggaagacaggaattcgtcagacagttccgccgaggtcgaggccgaaccgtcgccgtcgaggaatgcctggtcaagaatccaatgcacgcgttcgaaacttggcttcatgccgaaatcggatcccaagcattggaagcgttccaccgtgagcggatcgccgttcggcaatgcgaccttgtgcgactgcagaatgtcggcgatggccgcggcacgttcgacatcgatcgggtaacgctcgtagaactgcttcgtctttgccgccatgcgcgggaacgtatgacggtacacgtcggtcgcatcggcgggaacatgaggaatgccgcccgtggtgaaactggcgataaccccttgcgggaacagcgaaagatacgtcagcgtcaggaatccgccatagctttgaccaagcgtggcccaacgtgcgcccccgaattcggtacgacgcagatgctcgaaatcacgaacgatcgaatcggcgaggaagcgcttcaaaaacgcggcaccggccttgccgccgccatccatgccctcaatcacatgcgtatcgacacgagacgaacgcccagtaccacgttgatccggcaacaccacacggaaatgcttgatggcctcctcaatccaaccatcggaacttggaccgagcggacgggggccggaaccaccgggaccaccctgcaggaacacgagcagcggaagatcatcatgcacatgttcgggagcggtgaccacacggtagaacaggctgattgattcgccatcgaacccatgaccgggctcgtggcccgtccaatccaacggcaccttgatggaacgatcctcaatatgcaatccgggcacgtagtattcgctcagcaacgtcatgcattcaccttccctttggcgtcatcggcatgttcaattcgggtagtgactttttgatggcttccatctcacccacatgcggagacaaccttacctcacaaaagcggctttatcctgccgctatttcattcctgcgcatgatggcgtcacagcatatctggcgctagggtggaacgtatgtcgaatttcaaacagcgtctcttgtcatggatgcatggccatgttttcgccggcgatctcatcatcacgcttgttataggtgttctgctgttcggcgtgaccggcggcatcacctataatccgggattgctgtttgaccttaagccttccatgcagatggcatgggaagcggcaatgcttatcccgctgctgatccgtcgatggcggccgcagaccggagcgttgctctgcgtggcattgaccttggcgcatctcatattcggcccttgcctgttgggcgccgatattctggcattgttcatgctgtattcggtgatcgtctacggcaatcccaaaaacacgaaagccttcattattctggcgttgatcatcggtcttctggcttcggcgctggtggcatggaccatgtccaatggaccgctgctcaccggaggcaaagtgcatacatggagcagctggaatgacccaaatccgaatggcgttatggtcacgaaagacactctcggttccatctacacaggaacatccatgtcggaagtcgccgacatgatggcgcaatacatgctggtactgacgccgattttcgaagtatgcattatttccaccgtcattgtagcgttctggcagcgtgcccgtctggcaaccgtttgcatgatgcgggaacgcaatgaggcaatcgccgcgcgagaccaggatgaacgcgatatcgccgcgttggcggaacgcgcacgcatcgcacgtgacatgcacgatgtggtggcgcacaccctgtcaatcatcatcgtgcagtctgatggcggtcgctatgcaggcacgcatgatcccgcggtggccagaaacaccatggagacgattcgacacgaatcggaacgcgcactgcatgacatgcaacgtcttctgggagtattcgggggttcaccgcacgccgattataacgatatcggcaatcttgtggaacaagcgcaaaacgtctcccccgacattcgaatccgacggaatatcaccggcaccgccagcccagaacaactcggcgaacaagcctcgatagcttcctaccatgtagtgcaggaggcgctgacgaatatccgcaagtatgcggggccgcatgtcgatgtgcatattaaagagtcatggaacaacggtttgctcactttgaccatcaccgacaatggtcgtggcgcggcggccaatatcgacgggcatacgccaggttacggcctgctgggcatgaaggaacgcatcgaatcggccggaggctcgttgcaggctggccctcaactcggcggaggcttcgaagtcatggccaccctgccttacggcggtaaagaacaggtgacagaagaaaccggcgaacagtatgcctcggaacagtccgaatcttgcaacacaactgccatatccagcaaagcgaaactatccgacgaagcaatcgcacctcacacagtcgtcaacatatcggcgcgaatcccagatcagccatcggagcggacgcaggaaaccaaccaaccgaccggtcgcgatcatcgttcgaatgccctgcaacatttgcgcatcaccgcacccaatctgcatgatttgctcaaatcgttgaaactgaaatccgtagaatttgcaaatacatccaattcgcgagggctgaattgggtggaacgtgtttccgcgtggacgcagcaccattatgcgctcatggattccgttggtgccgtggtattggtcatgctgctgaatcgcatgtcggttacgttcttttttgatagttcacctcatgcgcagctctcaaatgcgatcgccgcatgctgcttgctggcgctggctcttcgacgcaggttccccgagacttgcgcgcttattgtgttcgtattgtcggttgtgcaattggtgtttttgggatcgattgaggttggacatatcgtagcttcgctgtgtgctctgtattcagccgtattgtatggacgcgaacacgcatggcgttggaccggtcctgccgctgtcgcctgttcggtgctgatgggcttgaaaatcgcggccgatcaacacggatacattaccttgttcggcgccatcaccgcttccgtgggcctgacaaaaccggtttcagccgcgtcaagcagtactgcggcgttctttaccggcgttatgtatacggttgcggtgttgatactgtgcgccggcattatggcatgggcgcgttggactcgctccagtgattcaaacgcactggtgttgcaggcgcgagaggaggcgctggtggccgagcaggagaagcagcgtattctcgcggcgaatatggaacgcgaccgtatcagtgccagcattcaggctgaagtcaccgccacgttgaacagcgtgattagtcaagccgtcgatggtatccgcatgttggacgctgccgaagcacaaggcaaggagcctaccgccgacgagatttccgcagcgttcaaagccatcggagaacaggggcgcgccgcgcttaagcgtatgcgcgaactgctcggagtgcttcgtgagactggtttcagcgatgacgctcatgccggtagcgcgagcgaactgcagttgcggcccgcagcaccgctggaggagcagctgcagcgcgcgtcccgatagccggttcaagtttttcagggagatttaagggtttgtttcgcgctgtgagcggaacgatgccgataaggtggagagtatgagtgaagaacagaagattcgtgtggtcattgccgatgatcaggaattggtgcgtgccggtttcgcgatggtgatcggctcgcaaccggatatggcggttgtcggccaggcgcgcgatggcgcggaagcggtggctttggcggagacgatgcatcccgacgtggtgctgatggacgtgcgtatgcccggtatggacggcattgaggcggcacgtcggatcagcgcgttgcagcatcgtttcgcacccgatggcagcgcgcttgacgatgcgcatacccgtgtgatcattctgacgacgttcgatttggacgaatacgtgatggccgcgatcaacgccggcgcgtccggcttcctgctgaaggacacggaaccggagacgctgctcaattcgattcgcaccgtgtaccaaggcaacgcgatcatcgcgccatccgccacgaaacggcttatagagaagatgatggatggcgatttcgcaggaacggccgccgcagcgcccgtttccgcaacgtccgcttccgcttcgacggcaactatgtacaccgatccggaattggacgaactgaccgaccgcgagcgcgaggtgctcatcgaaatcgcgcatggcctgtcgaatcaggagatcgcggacaagctgttcatcagcctgcctaccgtgaaaacgcatgtcgcgcatattctgtcgaaaatcaatgcgcgcgaccgcgtgcaagccgtcgtgttcgcctacgaaaaccatctcgtataaaatcttcataaaacgtattcggcaacaaaaatgctccttctttcgaaggagcattccgtttatcgcctaagcttctgcgagcgcctcaacaggcggtactttgaccgctctgcgggcaggtgcgatgctggcgagcaacgcagccacggcggccacggcgagcacgatgccgttgacgccccattcgaaggggaacaccacggtgccgtacaggctgaacaccacgtatgcgcccagccagccgaacaatgtgccgagcaggatgccggcgatgccggagacgagcgagatgagcagcgcttcgatggcgagcgatgccctgagctggccgcgggtcatgccgatggcgcgcagggtggccgattcgcgggtgcgttcgatcaccgacagggacagcgtgttcgccacgccgacaagtgcgatgagcacagccacagcgatcaatcccaccagaagcatcatcatggagtcgatcatcttcgcccatacgatgcgttcggcgatcggtccggtcactgtcgcatcagtgctcttctccaatgcggcctgcatgtcgttgtagatgccgtcaacggaaactcccgacttgtcagtatccgccttgaccagcagcacatgggtggcggcatcgaggtcaccattggtgaaatggctttcatccacgaatccgacagctccatactgtgcggatacgcgacggtagtcggcttggtttgcttgcaatgtcagcgaacgcgtagcgtcgccgtcctggttccattcggtagagaaatcagccgtaccattggcgaactgcagttccttgccggtttgcgcattgtatgttggcatgagcacgccatcactgtcgatggaggcgttacccaagttggcacgcatgacctgcttgacctgatcgatattcttcacgccgaccagcaatgcggacgtaggctgggttccatccgctttctccaaggtcacggaaaccgccggcgcatacaacgtgtcggacacgccgttgatgtcggctacatccttgaccatttgctggctgatgtcatcgcccatggccacgatgtcgacgctataacgggtggcgagcgcaccattcatagtctctttggcgctggcggcaccggttgcgatggtggaaaccagggtgacgccgatgagcagagcggcaccggttgctgcgatgcgtcgctgattcttctgaatgttggcgtgcgcaaccgttgcggaaggtcctgtcagcgaggccaacgctccaacgcccttcatgagggccggcatccagaacaccgctgtgaccaccattccgaggaacaccagtgcggcgccggcgatggctacgagcagaatcatcgtgaattgatcgctgctcgcatcctcgccgccattggtggcctgtacccgccagatggaaaataccaccatggcgataccgaccaccaccatcagaataccgattatggctcgcgtgaggctggaacgacggttgtcggtcagttcaatcgggcgcaatgcctccaatggcgtcaccgcagtagcggaacgtgcggatcccagggatgcgagcaccgtcaccacaataccgaagagaataggtatgacggcggcctgccaagagaaattgaatcgcataccctcttgcatgatgtcgctgacgcacatgccccacatgagcagacttcccagcatcacgccaagcacggatgcgacgaagccaagcactgccgcttcgaacagcacggaaccatacagctggccttttttcgcgccgatggtgcgcagcaaggcgagtgtgcggcggcgttgcgccacgagtacttggaacgtgttggcgatcaccagtgccgccacgaacatggcaagcacgccgaagcacatgaggaatgtggtgacgatgctggtttggttgccggttaaggatttgatgctttcgtcactgacctgctgtcgcgacatcagatcgaaatgctttggcagcaacgctttcacactgttgatggtttttgcggatacgctatttccatccaaggcaaggtcgaggtataccgttgttgttccggtggtgtcgaaatcgtccgttccctgcattgcggcaagcagattgtcggatcctacgatcgcaccaccatagtacgagtaggcgccgttcggatcggaggtgagtccgaccacgcgcacgttgtccgctttggctttgccatcggtgcctaccgcatattgggaggtcagtcttacagtgtcgccaatgccgacgttcagctgtttcgccatgtcttccggcagtgcgacttcgttggagtccttcggctggtccccttccgtaatattcacgggaagcatgttcttctgtgccgcggtagagatgatctcgccgctgatggcgctgtcccccctggaaacgctgacgccggtttccaccgaggcgcggacaccgtcaaccccttcgatgccggcgatctggtcgagatggaagtcgccgacagtgctggagtacgcttcgttgagttcctcatcgctcaggtcggagctgttgacggtcaccgcatagttggcgtttccgaacatggcggtcatctgccgtgtcagggagtcgttcatggcattgccgaacaggaaggtgctggcgatgaacgccgtgccgatcatgatggcgatgcctgcgggtatgagcatgcgcttggtttttcgcatgagtttcaaagtgatggaccacatggttaattctgtttccttcttcgaatgcttctacagtgcgtttagcgggaatgtctcgcggaagccacattcattgtggcggcttcgcgttccttcatcagcagttcactcatctggtctgctgtcggcttgttcacgtccgccacgatctggccgtcggcgaacacgagcgcacggtcggcgtaagacgcggcgaccgcatcatgcgtgaccatgatgatggtttggccaagttcgttgacggaacgtttcaggaagctcaacacttcggcgcttgatacagagtcaagattgccggtgggctcgtctgcgaacaccagtttcggtttggtgatcaatgctcgcgcgatggccacacgctgctgttggcctcccgatagttcgttcggacgatggttaagacgttccttaaggccaagcgtttccaccagcagacgcaaccactgtcggtctggtttcgccccagccaaggtcaagggcatgagaatgttctgttcggcagtaaacatcggcagcagattgaagctttggaagatgaaaccgatctgatggcggcgcagcagggtgagctggtcgtcgttcatgcgggtcagatccttgccgtcgaacatgacgtgtccgctagtggccgaatcaagtccggccagcgtgtgcatcaacgtggatttgccagagccggaagggcccatgatgacggtgaattttccttgttcgaaggcgatattgacgtcacgtaacgcatgcaccgcgttgcttccggaaccgtagtccttgacaagatcgatggcttcaatggcggtgttattggctttgatggcgtccctgatgtccatggaagttcctttctttgtgaagttacttccagcatacggaacattcgacgtcaacggcatcatgcgttggtctgaaatcctgctgaaccgcgactcatccttgagtatgagatcaacgcgggaacagcgaaaactggatgatcagaaaccatgttccaagcatcgggcaatcgtcaatcgcctagcaatacgccttcgtgcggcggctcaagccaatacgactccttttccacactgacggtggacgcccaccaggtctgttccacgcctggcaatgggcgaatggattcgtccaccacgcgccataggtcctcatcgttgtcggcgatgatttcaatcaggtaatcggcaccgttcaatccgacaccactcatcgcgtacgtcacttcgtcgatggccagaagctgttcggagtcaagccgatatggaggtttcactccaagtccgaggaatgcctgtcggaatcctcccaaacgcatggggcttaccgtggccataatgcgcatcacgccggaatcttcgagttttttgatgcggccgcgaatcgccgtatgggtcacgccgagacgctcccccaacgacgcatagctggccctgccgtctttctgcagttcgttgaatgtgtgcacgaaccgtggatccagacgatgcgagggaatatcggtgccgacactcgcctcgcgtttggtcaggaagccggtttcgccatgcgcggcgagcagacggttcaccacgctgacattgtggtcatcaagcaccagccgtccgcatgagaacacctgcagacgggacaatcccggcaacgcgcgcagaccatgtttgaggaaatgatccatgccttcagccgaatacaccacagcctcagcgatgatgtcggcatcccccagagcgcagaccacgtaggtgacctgtggcatggattggagcatggcaagagcctcatccctgctcccgtcgagacgaagtcccaccagcacctggctgtaattgcccagactcaatggattgcacaccgggacgatgctcatgatgccggattcagtaagcctgcggtagctttccgtagccgcgtagacggaaatgccgattttgtcggcaagcgcctgcatggtcatacggccgtcgcattgcagggccgagaccactttcaggtcgcgtgctgtgatggtgatgcgttgttcgttctggaacattggcctgcctcagaactgccacagcatcagccagatgctgcctgccgtcgcggcgacggtgaccgcaaggatgatccaatcggagagtctcatcttcagctgtatgcggtaggtgcgtctcacgccttggaggttgagcccgcgcgattccatagcccagccgacgctttggctcattttgtaggcgcggatcagcaccgcgatgatgatgggcagatacgatttgaaccggtccaccaagcgtacgaatacgttgcgtttcttgccggtggcgtctttcttgccgttcaagtcgagtccgcgggcccgttgcgcggccgatacggattggaagatggagaagaacaccggaatgtagcgcagcgcggtggcgagcgtgagtccggccttgtacggcatgcccagggaggtgagccctcggatcagcttggtctggctggtggtgaacaacgtgaggaagcacgcgaatccgagcgccggaatgcgcaatcccatcaccgcggccatgacgaggttctctcgcgtgagtttcagccatccccactgccacagcacgtgcgtgccggatgggtcgaaaatcggccagagcaccacgatgaacacgatgatcacggcgaggatcttccacacccagccgatgcgtttcagcggcacgccgtcggtgatgagcatgagatgttcgatgatcagaacgtcaagtatgaacgcccagttgcgccataccaggcacaacaccaacatgaccacggtgatgaggaatttcacacgggggtcggcgcgatgcagccagccgtcgcccggtacatacaaatcggcgtccatcagtgtcgtccttcctcatgcttggtgactttcagcagcacatgcgtcgccgaaacgggcccattggatttacgcggtttgcggatggtccgagactgcttctgcgccgcttcggacctgtcgatcggcccatactgcacgacttttccgtcctccaattccagcacatgcgtgcagtaccggtataccgcgcgcatgtcgtggctgatcatgacgatggtgacgccgcgctggttgagtttctcgatggtgccgaggaagcgtgctgcgagacggtggtcgagaccggccgtaggctcgtcgagcacgaggatcggcgtgcgcattgcaagcacggatgacagcgccaccgcacggcgttcgccgtagccgagcgtggccggcgagacgtcttcataacggtgcaggtcgaacagcgtcagcatctcgtcgacacgtttgaacacggtggctccgtccagtccaagcgcggtaggaccgaatgcgatttcctccttggtggtggagcagaagatctgatggtcgggattctggaagacgaatccgacgtgggccgccatttcgccgacgctgtgtttggaggcgtcgagcccatccaccgtcaccgtgccctgcgtgggtcggatcagtccgttcaggtgtttggcgagtgtggtcttgccggagccgttacgtccgatgagtccgatgaatgagccacgttcgatgtcgaacgtcacgtcgtccagagctttcgatgcattgccgccgcgctcatattggtaggagacatggtccaggctgatgaccacgtccttggaccgttccggctgattctttttgtccttcttatgctttttgccctgctgtacggccttgacctgcggcagtggatcgtccgcgacctgcacgccggaggattccagcagtcctttttcacggacgaacaggctggcgtcgccgttgcgcaccaattccccattgaccatgaacagcacttggtcggcccaataggcgatatgctccgtgtcctgttccgccatgatcaccgtcatggaacgggtctgccggatgcgttcaagcacatcgaagacttcctgcttgccttccggatcgagcgccgcagtcggttcgtcaaggatgagcacgtcgggttccgccgccaatgccgccgcgatggccacacgctgcatctgcccgcccgacaggctggccggcacgcgcttgcggtagccggtcatgccgaccagatcgagcatgacgtcgatctgcttgtcgatgatgtccggtgcgatgccgcggttttccaaaggaaaggcgatctcatcctcaacgctcgcgcagaacagctgcgcttcgggatcctgctgcacgtagccgatacgttcggacaacgccgatacggaatgacggctggtgttcatgccgttgacttccaccagtccggtcatggtgccgtccgccagattcgggatgattccggccaaagccatgcacagggtggatttgccggcgccggtcggtccaatgacgcccacgaacgagcctgatttgatatcgaagctgacatgcttgaggctatccaccggcttgccgccatccaccaatggctcatactgccaactcaaatcacgtaccgtgatcatgcgctcttctccatatctttcagcacatcagcccattgcaccggccgcgaacacagccactacggatactatatgaacgaatatgtataaataaagcccgtggaatcgccgttcatcggtgaacccacgggctttatttatacaagacaataatgtatcactcgccggccttgacgctgaggttgccgagtcgcaccagcggcggataagccttgcgcaccgcggagaacagtgcgaagccaacgatcaggccgacaaccatctggaatgagttgccgatgatttcgcctagggccggaccgaagccggacaggatgccgccggcgatgaagtagccgaacaccttccacacgccggccaccagagagccgatgacgacgttggccggtttgaattcacggaccagcagacccacgagcaccgcctgcagaccgtcgatgatgaaggtgaagattgcccactgcgggtatcccgagatgaggtcggacaacgccggtccaagaccgccgatgatgccgccgacccacgggccgaacgcataggagctgaagaaaatcatcgtgtcggacaggttgaggtatccacgggtcggggtcggaatcttcacgaacatggtcagcacggtggtgaccgcggtcatgatggcgaccaacgggatggtgttgacctgaatagctttcttgatatcgttcttgacatcctgcgtcataatacagtcttcttctctcttttttaccaaaatagcaaaatcatcttgcttttcctacgatttgtaaagaaatcgcaaggaatttctttcgatgtatcaaattgcgacataccatatcgcaacaagcgaaaattttatcccatccgcgttacaagcgcagtgcaaagcgggcggcccgcaacacccccttctcatggtgcagcggaccgcccgacagttgtttcagaccaaagtcacttggccagaccggattcgcgcaaggccttgaagccgctttcgaggtcctcgatgatgtcgtcgatgttctccagtccgatggacaggcggatggtgccctggtggatgccctggtcctcgagctcctccagcgtctcctgggagtgcgtggtggaggccgggtggatcacgaggctcttggcgtcggccacattggccagcaggctgaacaggtgcaggttgtcgatgaacacgcgtgccgcgtccttgccgcccttgatgtcgaaggtgaagatggaaccgccgccgttcgggaagtacttcttgtacaggtcgttgtccttgcggccttcgatggacgggtgggagatggactcgacctccggcacggtcttcaggtagtcgatgaccttcagcgcgttctggacgtgacgttcgacgcgcagggacagggtttcggtgccctgcagcagcaggaaggccgcgaacggggacagggtggcgccggtgtcgcgcagcaggatggcgcgcacgcgggtcacgaaggcggcgccgccgagggcctcatagaagttcaggccatggtaggacggatccggctcggtcagggtcgggaacttgcccggcacttcggcccagttgaacttgccgccttccacgatcacgccgccgagggtggtgccgtggccgccgatgaacttggtggcggattccacaacgacgtcggcgccgtgctccagcgggcggaacaggtacggggaggcgaaggtgttgtccacgatcaccggcaggtggtgcttgtgggcgatggcggtgatggcctcgaagtcgggcaggtcggcgttcgggttgccgaaggtctcgaagtagacgagcttggtgttctcctggatggcgtcctcgaactcctgcgggttctcggcggagacgaaggtggtggtgatgccgtcgcgcggcagggtgtggcgcagcaggttgaaggtgccgccgtacacgttcttggctgcgacgatgtggtcgccggactgggtgatgttgcgcaccgcgtattccacggcggccgcgccggacgcgacggccaggcccgcggtgccgccttcgagggccgcgatgcggtcttcgaacacgccctgggtggagttggtcagacggccgtagatgttgcccgggtccgccagtccgaagcgggcctcggcgtggtcgaagttgtggaagacgtagctggtggtctggtagatcggcaccgcgcgggagtcggtggccgggtcggcctgctcctggccgacgtgcagctgcagggtttcgaaacgatagttcttgtttgccatgatgcgctctccttggataagggttcgttgttctcgtcttggttggccacccgccctgccgtgtagggcgcttggccaggtgttggtagcgacaataaaccggccggcgagcgcaacgcaagccgaacgttatcgcacttgcctatatccccttataaaccgttggaatcattggctttccccactcccccaaccgttgaaaaaaccattcggaaccattcgacacgccgaagtcccgcatgccggtgacccaccgtgaggaacggatgcgcgtcaggtcaggggaacggctaaagtcatgggcaggcaaatcgcaagagaggttccgatatgagcgatgagattctgtacgaccgtgatccgcggtatattccgcgcgtcgccgcggtgcatgacatgtgcggttatggcaagtgttcgctgacggcggccattccgattctgtcggcggccggctgcgacgtttgtccggtgccgacggcgctgttttccgcgcacacgcgctacgaggtattcacgttccacgatacgaccgagattctggacggttatctggacgcatggcgtcaggagaacgtcgatttggatggcgtctattccggttttcttggttccgcggaccaggtcgcaatcatcaaacgcctatacgcggagtatccgcatgccttgcggttggtggatccggtgatgggcgacggcggagaaatctacgccacgtacactcctgagctgtgtcgggcgatgggcacgctggtggatggcgcggatgcgctgatgccgaatcttaccgaggcatccattttgacgggccgtgactatccaggccaggatatcgacgacgcgcaggtggatgagattcttggggcgttgcttgccgccggcgcgaagaacgtggtgcttaagggcatcgatcgaggggatggcatgattcgcaactatgtggcgtcagcttcgacgggcgtcgccggaaaacaggagctggcgcatgccaagctgccgttcatgacccacggcaccggcgacgcgttcgcgtcggcgctgtgcggcgcggtgatggctggccgtcctctggccgaggccgcgaacatcgccggcgagttcgtccgccatgcgatggaaagcacccagtatcagccgaatcatgaggaacgaggcgtgagcttcgaactcaatctcgacgaattgaccgctttgacccgtcgttgacggttcatcggtcactcttttcgcacagaggccttggatcgtgttgtggataggtgtggatagcgtcgactcatccaccgactatccacgacacgcccgagatacgtaagttatccacattagcctatcggccttgtcatgcgtggcttctgtctgttggactagggccatgaaccattcatcatcacatgatgttccggccccaacgcagccgccggagcagattctcgattccctagcgcggcgtctgcatgacggcacgctgcgttcccgacagatcggcgagctgggagaacagtacgccgccgcatggttggaaagccaagggtggcggacgctcgaccgcaactggcattgccgatacggcgaactcgacgtcgtgtcgcgcaatccgatgggccagatcgttttcgtcgaggtcaaaaccagacgtacgatgcgctacggcacccctcaggaggcggtgaccgcttccaagcaaatcaatctgcgccatgccgccgtgcaatggctgacggcgccggagcaccgcatgccgaacagtggcgtgcgttttgacgtcgtcaccgtcgtggtgcagggagacagacctttgctgcatcatatcgagggagcgttctgatggccatcggcagcgccctttccgtaggactgatcggtttgaaagccttcatcgtccagattcaagcgttcgtatcccctggacttccctatttctccatcatcggcctgcccgacacctcattgtccgaggcgcgcgaacgggtcaagtcggcatgccaggcaagtggtttcaaatggccggaaacccgtgtcacggtcaatctctccccagcgtccatgccgaagaaaggctcttcgcatgatctggccatcgcggccagcgtgctcagcgcggccggcgcaatcgcccatgactgtctggccggcaccatcgtgcttggcgaggtgaatcttgacggcaccgtattgcccatcaacggactgctgcccatcatgctgcatgcgcgggagcagggaatcgcaacaatcatcgtgccttacgccaaccttgatgaggcccgtctcgttccggatgtcaaggcgatcggcgtgaggcatgtcggagagctcatcgaactgatgggaggcgatgcggactaccggattcccgaagccacgcatgccgtgaacgccgatgtcggcgccacgggcatgtgccctccgcccggcgacatgagcgaagtgatgggccagcaagcggccaaatgggcgttggaggtggctgccgccggaggccatcatctgatgatgaccggtccgcccggcacaggcaagaccatgctcgcttcgcgcattcccggcatcatgagtcctttgaacgagacggaacagcttgaagtggcctcgattcgttcgttatgcggcacgcttcccggatacggaatcagcgacgttccaccgttcgaggcgccccaccataccgcgtcgaccgccgcgctggtgggtggaggcgcaggattggcccagcccggagccatcacccgcgcgcatcgcggcatcctgttcatggacgaggctccggaattctcggcgcgtacgctgcagacgctgcgcgaacctttggaatccggatatgtcgcgatttccagagcgaaaggcaccacatactatccggctcgcttccaactgattatggcggcgaatccctgcccgtgcggctacgcgtacggcaacggcgagcgctgcacctgccgagaaaaggaccgcgtcaagtatttcagccggctttccggaccgatcctcgaccgtatcgacatccagatcgaggtgcctccggtggagcggataagtccggggaacgctccctccggcgattcgagccatgccatacgtctgcgtgtcatcgttgcccggcagatggcgcaggaacggttccgcgaattcggctggtgctgcaacgcgcaggctaccggcacctggctgagagccaacacctcccccaaggccatcgaattggtcaaccgcgccttggcgagcgagcggctgagcctgcgtggcgccgaccgtgccatgcggcttgcgtggacattatccgatctggcgggaaagacttccccaggacctgaggaaatgatgcagggaatatccatgagaacgaggctggcatgatggtgacgatcgacgacgagaccctggcccgcgcggtgctcaccttctgcctggacagcgccgacgcgatgatgtacgcgctggtcaaaggcaccggctccgcggcaagcgcgctacagctgatcgctgacagcggccctggcaatcacgaaaacgtgacggccgcggcctgcacgtcattggatgcggcgttcatcaacggcgtcactcgttggggacgcaccatcaacgcccgcggaatggcttcgttccatggctcgctggtgtcatggcagcaacgtctggcatcgttgcccagcaaggatccggacgcattgcgagactggttcacagcagacggcacgcagtggatcatcgccccgcatcacccctgttggcccagccaactgaacgacctttcactgcgcaccgactgggcctccccgctctgcctatggggcaaaggcgatccgaaggcgctggtgtcatgccccgagccggtgggtatcgtcggctcacggggcgtaagcgactacggtaggcaaagcgcccacgaattggcccttcggatggcgcgtgccggacatctggtggtatccggcggcgcgctgggcaccgacgccgcggcgcattggggcgcggtcaaagccatggacgaaatgagcgccgctctggcgggacgcaccgtcgccgtattcgctggcggactgaaccatatcggtccgaaaagcaaccagaacctgttcgagcagatcgaaagccattcgggcgctttgatttccgaactgtgccccggaaccgtgccggaggcaagacggttcctgctgcgcaaccgtctgatcgcggcattgtcatccactctgatcgtggcgcaggcacgtgcgcgttccggcgcgctcaacaccgcaggctgggcgaacgaactcaaccgcaatctgttcgccgtgccgggagacatcaccatgccgcataacaccggctgcaatcgccttatccaagacggcagagccaccatcatctgctcactggcggagatcgacgaactatgccatagcgcgcatcgcccgcaacatgtcgacctgccggatgacaccgaacatccgcaggaatcgacagacgaatccgacgatgccatactcgccgccattaaaacttgcgccgaagcaaacggccacgtctccgccgacgatctgctcgatctaatggacaagacgcatccgggagaatatcccatctcgcgaatcatgcgcgaactgggctccttggagcttgaaggccgcatcagcatgcggtccggatggatcatcgccgagcagcgatagcaggcccggcacctccacctcagccgcgtcgaacgtgcgaggtcacaccttgtgcgagaatcggtggtatgagtccgaagcatgttgaagatatgtatgatgcagtgatcgtcggcgcaggcgcggccggcctgtccgcagcgttgggaatgctccgtagcgagcggatgcgccagatgcgggcggacggcatcgaaccgaacgtcctggtgatatccaaactgcagccgctgcgttcgcacaccggctccgcggaaggcggcattgcggccagccttggcaacgtggagaaagacgattggcattggcattactatgacacagtcaaaggcggcgactggcttgtcgaccaggatgcggcgaagctgcttgccgaacaggctcctgccactgtgatcgcgctggagcatgccggcgtcgcgttctcgcgtaccgatgacggccatatcgcgcagcgccgtttcggaggccataccaaggatttcggcaaggaaccggtccgccgcgccgcttatgcggccgaccgcatcgggcatcagattctgttctcgctatggcagcagtgcgtggccgagggcgttgagttcgccgaggaatggtatgtgaccgatctggtggtttccgaagaccacggcaaggtcgagggcgtggtggcgttcgacacgcacaagggcgagacgcatgccatccacgcacgcaatgtgctgatggccactggcggtgccggccgtctgttccataccacgtcgaattcgtgggatctgaccggtgacggcatggcgttgacattgtccgccggccttcagcttgaggatagcgagttcgtgcagttccatccgaccggtctcgcccataccggcattctgctgtctgaggcggcacgtgcggaaggcggcgtgctgcgcgactccgatggcgaggcgttcatggaacattacgcgccggggcatgccgatcttgccgcgcgtgatgtggtgagccgttccatcatggctgaaatcgacgccggacgaggaatcgccgatccgaagaatccggatgggccgaaggattgtgtctggctggatatgaccggcatcgatgcggatcatatgcatgaggtgctgccgcaggtggtggagaccatcgaacagtatgccgatctcgatccgacccgcgactatgtgccggtcaaacccaccgcgcattacaccatgggcggcatccccatcaccaccgacggcgaagtctaccgttgggtcgatggcgaacgcgccgtcgtggacggtctgttcgccgctggcgaatgctcctgcgtgtcggtgcatggcgcgaatcgtctgggcggcaactcgctgttggacgcctgcctcttcggcacccgttcgggcaaggcgatggctgaacgtgtcgtcgataatccagtgaacgatccgatggccgagcctgccgacgaagcatctatcgacgcggtgtcgcaggctgccgacaagcgttccgcgcaggtcaaggaactgttgacgcggccgtccgatgacgacgatgcgtcgtcggacaatccgtaccagctgatggccgatttgggatccgtcatggagcaggcggtcgcggtgcgttgcgaccggaacagcatcgaacaggcgttggctacgctggacgatacgctcacgccgcgtgccgaggcgctgcatgcgcattccgactcccccacgttcaatcaggaaatcaccgccatctgggaggtgcgccatctgttggagctcggcaaggccgtgctcgccgcctccgatgcgcgtcacgaatcccgtggatcgttgaagcgtcttgatttcccggagcgtgacgacgagcatttcctggcccattccatgacggatgtttcctgccaggtctcctggcagccggtgcacatcgtggacatgccgccaaaggcccgtgaatactgacaccctgggcacggcgtatggcagactggttgacggttttttatcgaaaggcaggtatatgagcggcatggagaacggcatggaaacggtgacgttgcgggtgaacaggttcacgccgcgtcccgaacgcggccgtgaacgaggcggctcgccgttcgctaggaagagctctcccttcggcgattccggatccacgcgcaggcgtccgcgaggcaagcagtgggtgcaggattacgcggtgccggcgcgtccggaggacaccgtgcttgactgcctgctcaaagtcaagcgcaccatcgatccgacgcttgccttccgttattcgtgcggtcatggcatgtgcggttccgatgccgtgtccatcaacggcacgcctacgcttctgtgcaccgccacggtgaaggcttgggcaaagcagccgtccgacgcacaggtggatgaggacggcttccgtcatacgggcgaagacgttcaacccgcgcaaacgcaggatgccgacgatttgggtgtcatcgagctcgcaccgctgcccggtttccccgtgcagcgtgatctgatcgccgatatcgaccagatgcttgaccaaatcaggaaactcaagccgtatctgcaggccagtggcgaactcgccaccaccgcggacggcaagatcaacgcattcgaatatctgcagaatccccagcagctcgccaagtatgagctgctgagcaactgcatagcctgcggcacctgtgagggaagctgtccggtatatgcaggcggcgaggcgttcatcggccctgcggctcttatcgccgcctcccgtttcatcaatgattcacgcgacagtcagacggatgcacgtatggatgccatcgattccgccgatggcatcgccgcgtgtcagtcggtgcgcgcctgcacgcgtgaatgcccgcgtggcatcgatgtcggtgaggagatctggcagctgatcgcccaaatcaaggagcgctgaaatggataggacgtcatataccaatctcgcgaaatcgtgggagtacgtcgaggatcatgcgttctcacgccagtctgccgaactcaatgcgatcaggaccgcggccgaggaagccggcattccccaaggatccgcggcgcaggccgaattgctgcgcatgctggtgcgaatgttggacgcctcgtcggtgatcgccatcggcaccggttccgtggtggagacgatgcagctgatcaacggtcttgacaatgcaggccagcttacggccgtcgattcgtccacgcagggcatcgcgctgattcgcaaactgttcaatcgtctgtccgatgacaccgaaaccacattgcgtgccgtgaacgcgtccgcaggtgtgtttctgccccgtctgaacgccgagaattacgatttaatcgtcgtggccggcgatccggagaattatgcggcggctttcgcgcaggctccacgcctgctgaaaccgcatgccgcgattgtcttcaccgatgtacttgcctttgattcggccacatcggccggcggcgtgctgaatcccgccaatcgtgatgccaaatccatcgcgatgcgcgaattgctggaaacagtggagtcggatgaacggttcgtcactgcgttgacgccgaccggcactggtctgctggttgccgtcaagaaatagaccaatcagattaatcagccgtgccgcaatggcacgatatgttgaaagggccacgcatgggaatgcgtggccctttcaacatatggaaatcccttttactgttcctggtgggtgccgattatctggctgaccaccacggtaccgtcttccagcaccgtctcaacttcgttcatggcatcttcgtcgccggtatggtgcttatgcttcgtaccgtcctccagttcgaatcgtttggattgatggctcagcagaatacctgagatcacggctgcgaccatggaccccaccaggacgccgaaacgggcttcagccgatagttcggcatcctgatatgccagcgacgcgatgagaaacgacaccgtgaaaccaatgccgcaggcgcaggcggcggggaacatgtcgcgcacgcgcagtcccttggccatcttcagaccgcccacgtgcgtggacagccatgcggtggtcatgatgcccagaggtttgccgaccacgagcgccaccatcacggcaacgaccaccggcgagacgaacagcgccaaggtcaacgactcgaagtgcacaccagtggcgaacagtgcgaagatcggcaacgccagcagtgcggagaacggctgcagcttgtcggcgtaacgttccgcacgcggcatcttctcaccgaaacgctcatgggccggcgtgagcagtcccacgagcacgccggccaaagtggggtgcacgccggcttcgaacatcatgacccatgccagcacgcccacgatggccacggccaaccacggtaccttgcgcatgcggaccagaaagtaccagacgaccgcgcatacggctatgccaaggaaccagtaccatgcgttcaccgatgagaagaacaccgcgatcaggatgatggccagcaggtcgtccactgtggccaatgtcatcagaaaagcgcggatggatcccggcaacgctttggcgaacagggccaatacggccaatgagaacgcgatatccgtggctgtgggcaccgcccagccattggacatctgtgcgaaggagaacgacgttcctgaagcgatgacgagttgccctgatcctgccgccgcaaacaatgagatcacgccgatgaacagtaccggcggagcaagcataccgccaaccgcgcacagcatcggcacggccgcggctttgggattggacagtgatcccgtggtgagttcctgcttcaattccagccctacggtcaggaagaacaccgtcagcaggccatcctgcacccaatggcccaatcccatgtcgatattggtgtgtggaatggctatatggaagttctcaagctgttcgaacgcatgcgcggtgaacggcagattggcgagcaataggccggcaagagcgaaaccgagcataatcagaccggatatgcggtcggacgcggctatgcgtcggattgttgcccaggttcccctcttcgatgtggccatcatgctccttgtcttgcggtccccgttcgaccgcagtatccgtaaaacgtagtatcaagtgtatcggagggtcttggcgttcgtccatgccgcatattgcgctccgctgtgcgcgcaatcaattgcaggcttcacaaaaatccatggaaaataaagaaagcctcctccgcattcgcgaaggaggttcatgtgcgcgagacaggattcgaacctgcgacctgctgatccgtagtcagctgctctaatccgctgggctactcgcgcaacgttgtcttgttttcggcaactcgaataagatacacccaaatgaactccaggcaaaatctcggcgtgtcgcaggagttttcggccttacgcctcacgtagacgaggaattttctgcgtcgacaccttgagtagtttcggagtgcccgatccggtgactgcggcttcgtctacgaccacctcttcgacgccttccatgctgggaagacggaacatggtgtcctccagcgtcttctcaataatcgaacgcaatccacgtgcgcccgtaccccgccgaatcgacgtcgccgcaatctgccgtatcgccccttcggtaaaggtcaatgtcaccccatcgacggcgaatagcttctggtactgcttgaccagcgcgttttccggttcgacgaggattcgggccaaatcgtcttcggtaagttcctcaagcacgctgactaccggcagacgtccgatgaactccggcaataatccgaaatcagccagatcatcggcggagacctgcgcaagcagctcacgcttgggaacctcatggtcatgccagaccgcaccgaaaccgctttccctggcgcccaaccgttgcgccacgatgtcggcgagtcccacgaacgcgccaccgcagatgaacagtatgtcgcgggtgtcgatctgcacggtttccatttcacgatgcttgcgggtcccttccaccggcacggaggcgacggtgccttcaaggatcttgagcagcgcctgctgcacgccctcgccggacacgtcacgcgtgatggaggtgttttcgccgcttttacgggcgatcttgtcgatttcgtcgatatatacgatgccctgctgcgcacgcgccacatccccgtcagcagcctggatgaggcgctgcagcacggtttcgacgtcatcgcccacatatcctgcctcggtgagcgtggtggcgtccgctatgacgaacggcacgttcatcacatgggccagcgtctgcgcgagatatgttttgcccacgccggtcggcccgagtagcaggatgttcgatttcgccacttgcacgccctcgaacgaatcgtcatgtccatgcatccgttccttgccgattcgcgacgactcgcgcatttccatgttgacgcgcttgtaatggttgtacaccgccactgaaagtgtctttttggcggactcctggcctatgacgtgactgtcgaggtaggcgctgatctgtgccggcttgggcagttgcaggatattgagctgggcgtccttgtcccgttcctcggaaatgatgtccacgcacaattcgatgcattcgtcgcagatggccgcgcccgaaccggtgaccagtttacgcacctggttctcggacttgccgcagaacgtgcatctcggcaccgcatcgttgtagctgaccacgcgtcccattcgcaacctcttcgtttcacatatctgccgtttagaaaacacaatacccctgccgcgacccggcaggggtattgcatttgtgaagatatcattccaccgcaggctcagctgcgatgttccagcacctcgtcaacgatgccgtattccttggcctcctgggccgtcaggaacgtgtccacttcgatgtccttgcggatcttctcgatgtcacgaccggtatgcttggccagcgtgttctccagccattcacgcatacgcagcatctccttggcctggatttcaatctccgtggccttgccgaagccctggtcgatggccggctggtggatgagcacgcgggcgttcggcagcatcagacgtttgcctttggcgccggcggccagcaggatggccgcggccgaggcggcctggccgaggcatacggtctgcacgtccggcttgatgtactgcatggtgtcgtagatggcggtcatggccgtcatggaaccgcccggcgaattgatgtacatcatcacgtcacggttcggatcctggctttccaaaaccagcagctgggccatgatgtcatcggcggaggtgtcgtccacctgcacgcccatgaagatgatgcgatcctcgaacaggcgggtgtacggatcctgcctcttgtatccgtacggggtcttttcctcgaactgcggcagaacgtaacggttctgcggtgcgaacgcggcctcacgcgccgcagccctctggaagccgaccacaccggtcggtccggccagacgttcggcgcgggctacaaactgtgcttcttcgcttgccatggtcactctcccttggtggcgctcatcgtgtcgtgggtggaaacgagcttgtccacgaagccgtactccaacgcttcttgggcggtgaaccagtggtcgtactcgttgtcgcggtagatttcctcgacggtgtgtccggtctgctcggcggtcaactcgctcatggtctttttcatgtccatgatcagctcggcgttgatgcgaacatcggtggcggtgccgccgatgccgccggacggctggtgcatcagcacacgcgcatgcgaggtcaggaagcgcttgcccttggtgccggagctcagcaggaactggcccatggatgcgcacatgcccaagcccacggtggccacgtccggctcgatgagctgcatggtatcgtagatggccatgcccgcggtgatggagccgcccggggaattgatgtacagccagatatcctttttcggatcctcggcggccagcatcagcatctgcgcgcaaatgcggttggccatctcgtccttgacttcctcacccatccagatgatgcggtccttgagcaggcggttgaaaatcggatcggtgggtcctgccggcatgtcttcgccagccatgacgggcaggggtgcactaaggttgctcaccttgtctccttttccagtgttctctatagtttcacagcctaccgcttcgaagcgacggggaacaaaattgcgcccacagtggagaagccgacggcgaaaacacggttatttgcgtttcgcgccgatgcggaaggcggtaatcaggcagcagattgcaacggcgacaatcacgatcatgacggtgaacgtccaactgccgccaaccgccgtggcatggctgaatgcctcggttccttccttgcctgcgccggcctgggccacggacagcaccgtggagaacagcgcggttccggctgcgccaccgaactgcaggcaggtgttgaacacggcgttgccatccggcatgaattgcggcgcaatgctgcgcaacgcattggtcatgatgttggagaagccaagcgcatagccaagtccgaagatgaagtagaaaccggcaagcgtggccggcgtcagccgcatggagaagaccagcagcaggatcgggccgcagatcgccaggaagaacgcgcccagaatcgggcggacagggccgaaacggtcgtacagcgtgccgccgatcggtgcgaagaaagcgccgatcaacgcgcccggcagcaccagcgcgcctgccaggaacgcgttcgttcccaaggaaagctgggcaagattggtgatcacatagccgaagccgatgccgacgattggcagcagcatgtaggcgatcagatgcagcagcaccatcggatcacgcagccatcccaagcgaatcagcggcgagaaggaacgacgggacgaccatccgaagaagaaaagcgatcccaagccgacgatcaggctgatcactgcgaaaatcgccggcgctgtagccgcaccacccgaaacggcggcggcaacagccacgcccgcctggttcaggaacatcactagaccgcacaacgccagcacaatcgccgcgaactgcagcggattcagatgcgcctcttccgtcggacggtgctgttcgatgcatttgaggccgacaggcagcgaaatcagcagaatcacgggaatgacgatgacgaaaatcgcacgccatggcagaatgctcgacaccgcgccacccacggtcgggccgatggcgggcgccacggtgatgacgagcgaaccgacgcccatcagtcgtccgaccttgctgcgtggggactgttcgagaatgatgttcatcatcagcggtgtggccacgccagagccgatgccctggatgatgcgggctactagaatcaccgggaacgcatggccgaagatcatggtcagcgagccaagcaccgcaagcgccaccgcggcgaggaacaggacgcgatgcttgaatttgcggttaagatacgacgacagcggcatggtggctgcgaccgtcagcaggtagatggtggtgatccactgcacagtagcagtgttcacgttgaattcccgcatgagctgtgggaacagcaccgtcatcacggtttcggtgaggatgccgatgaaggcgagcgagccgaccgccacgatggcgccgatgagtttgccgggaatgcgttcgtccggcgtttccttgatgttttcgctattgttcctattgttatggtcggtggtttcgagcgttgtattccgttctttcataatcactttccgcgcactttttcctgcggccatgtgcgacgccgcgattgacgcatgggccttgcaaagcaagcaggcgtcaaccccagcgaagaattctagcggaacccctgacccaatgcctgcaggaaacgaacatcaggcgttgcgctggccggaacggccgtcaccgttatcgtcctcttcgtgcagaatcttccgaatccgctccaatctcggcttgacctcatgctcgtaaccgcggtcgttcggatggtaatactcgcgcccctgcaattcgtcaggcatgtactgctgcggcgccaccgcgcccggccaatcgtgcgcgtaccggtagccttcgtggttgccccagcttttcatcagcgcggtcggcgcattgcgcagatgcagcggcacttggccgataagccccgcgtccacgtcggcgagcgccgcgttgatggcgttgtagctggcgttggatttgggcgcggtggcgacggcgagcgccgcttcggcaagaatgatgcgcgcttcgggcatgccgatcatggccactgcctgcgccgcggctacggtgacttgcaggacctgcggggcggccatgccgacttcctcggatgcggcgatcatgatgcgtcgtgcgatgaagcgcgggtcttcccccgcgcgcagcatgcgggccagataatgcatggtggcgtccggatcggagcctcgcatggatttgatgaacgctgagatgacgtcgtagtggtcgtctccgtccttgtcgtaacgcacggtggccacgtccatgaccttcgacaccacatcaggcgtgatgatgggccgtttcgcgcctttttttcgttctttgtcaccagtgagcgcgccggccgcggcttcgaggatggtcagtgtcttacgtgcgtcgccgccggccatgcggatgatctcatccacagcctcgtcggtgattctgatttcgttgtcaaggccgtgtttgcttgcgatggcgcgattgatcagcgttttcagatcgtccggttccagcgattcgagtttgacgaccacggatcggctgagcagcggcttgatgacggagaagcttgggttttccgtggtggccgcgatgaaggtgacgtcgcggttttccacactgggcagcaacgcatcctgctgtgatttggagaagcggtgcacctcgtcgatgaacaacaccgtttccttgccttcggagacgagacgttcgtgcgcgcgtttgagcacgtcacgcacgtccttgacgccggaggtgaccgcggacagttcctcgaagacacggccggactgtttggcgacgatataggcgagggtggttttgccgactccgggaggtccgaacaggatgatggagctcggtgcggtgagcgagcctttcgaagcggggttggcgagtctgcgcaatggcgacccctcccccaatacccgtgattgccccaccacatcgtcgatgctcgctgggcgcatgcgtacggcaagcgggcgcgtcacatcatccggcgcgtccatcgcggcaaacaaatcgtcagtcatgctttccactgtaccgcaacacacccaacaattcgaacacacgttcgatgcatgcgttcgccccaaccggtagactggcaagcatggcagacgatacgaattatggctcgctgggcgcgttggcgccgaattgggacgagggcgagcgcaacatcgacacggatgagatctatgagcgtttcttcacctgggtggaggacgtcaaaggcgtggaaccgtggccgcatcaggaggaggccatcatggatctgctggccggcgaccatgtcattttgaacactccgaccggttcgggcaagtcgctggtggcgctcggcatgcatttcgccgcgttgtgcacgggccgccgttcctattacacggctccgatcaaggctctggtgtctgagaagttcttcgacttggttgaagttttcggccgcgagaacgtcggcatgatcaccggcgacacgcatatcaacgcggatgcgccgatcatctgctgcaccgcggagatcctcgccaatcaggcgttgcgcgagggccgccacgccgatgtcggctgcgtggcgatggacgagttccactattacggcgatcccgagcgcggctgggcttggcaggtgccgctgcttacgctgccggatacgcagttcctgttgatgagcgcgacgctgggcaatgtcgatgcgatcgccgacaagcttgaggacatgacggacaccgacgtggatatcatcgccgatgcgccacgtcccgtgccgttgacgtacgaatacacactcgacccgttggagaagacggtggaattggcgttcggcaagggcgagacgccgatttacgtggtgcatttctctcaggatgccgcgttggagaccgccaacgcgctggccagcacgggcgtgtccagcaaggagcagcgcgccgcgatcgcggaagccatcaagggcacgaagttcaccaccgcgttcggcaagatcctgcagcgtctgttgcgtaccggcatcggcatccaccatgccggcatgctcccccgctatcgtcgtctggtggagcagctcgcccagcagggactgctgccagtgatctgcggcaccgacacgcttggtgtcggtatcaatgtgccgattcattccgtggtattgaccgcgttgaccaagttcgacggcacgaagatgcgcaagctgcgcgcccgcgagttccatcagatcgcaggacgcgccggacgcatgggcttcgacacggagggtctggtcatagccgaagcccccgaattcgaaatcgagaacgccaaggctctggccaaggcaggcaacgatccgaagaaactgaagaaggtcaagcgcaagaaggctcctgaaggtttcgtaacgtggaacgagaacacgttcgacaagcttatcgacgcggctccggaaacactggtgccgcatatgaagatcacccattccatggtgttgaacgaggtggagcagggcggcgacgcccgctaccgcatcgaccggcttatcgacgattcggcgcagactccggagcagaaggagcgcctgcacgcccgcgcggacgagatcttccagaccttgttcgacacgaacgtcatcgagaccgaagaccgtgacgatggcggcaaggattatttcatgaccgtggacatgccggacgatttcgccctcgatcagccgctaagcccgttcctgctggccgcgttggaactgctcgacccggagtcggacacgtatgcgttggatgtgatatccatggttgaggccacgttggaggacccgaagcaggtgctgcgcgcgcaggaacgtcaggcgcgcgacgaggcgatgatccgcatgaaagaggatggcctcgactatgacgagcgtatggacaggcttcaggagatcacctatccgaagccgttggaggatatgctgcaggccgcgttcgatgaataccgccatgatgttccgtgggcgaacgactattggctgagcccgaaatccgtggtgcgcgacatggtggagaccgcttccgatttcaccggctacatcgcccgctacaacatcgcccgttccgaaggcacgttgctgcgttacctgtccgacgcctaccgtgcgctggcgcgtaccgttccgcaggagaagcgcgacgaacagctcgacgacatcatctcctggctgcgtgtggtggtccgttccatcgattcctcgctggtggacgagtgggagaacgcgggaacggacaccgacgcgtccgaggcggccgccaacctcgccgcgcccggcgcgaagcaggccgtggtggaggaccgtcgcggactcaccgtattggtacgcaacgccatgttccgccgcgtgcagctcatggacctcgacaagccggacgagctcggcgcgctcgacaaggactggggttacggcgtgcacgaatgggaagacacgctcgacgattactacgacgagcacgaatacgtcaacatcgacgcgaaggcacgcagcggcgagctgttcatcctcgacgaaagcaaggagaacagcgagcattcctggaaggtgcggcagatcatcgacgattccgatggcgaccacgattgggccatcaccggaaccgtcgacctggacaccacacaatccagcggcgaggttgtcttcttcgactacagcgtgtccaactgacggcgcatctcgtcggcgtcgacttcgagcggcggccagatcatgttcatgttcttgagcgtgttgcgcagcagctcggagacgacggccctcgaataccaacgattgtcggcaggcaccagataccacggcgcctgctcggtgctggtgcgcaggaacacatcctgccatgcagccatgtagtcgtcccagcgggcgcgcgcctcaaggtcgctcggatcgaacttccagcatttggtcggatcatcgagacggctcaggaagtggcgtttctgctcgtctttgctgaccacgaggaagattttgatgatggcgcatccgtcggccgtcaattgcgattcgaatcggttgatttcgtcgtaccgtgcctgccacacttcttccggctgcgttttgtagatgcgcggcatgacgatgtcctcgtaatgggaccggtcgaagatggagatccatccgttgttcggcagctcgcgtttgatgcgccacagatagtcatggtccagttcttcgcctttcggcgcgccgaaaccgtgatagtgcatgcccatcgggtcgccttggctgaacacatgtcgtacgatgccgcctttgcctgacgcgtccatgccttgcagcacgatcagcaatcgccgatgcgagcctttcacgccattggcgtacataagccgctggtaacgggcgatctccgacgagctgatggatatgaatcgttcggcatcatccttgttgccgtcaaaaccaggagtggaatcgccatctatgtccgataccttcgtgtcgtgatggaatcgcaatagctgggtcggcggcaacgtccataccgagctcagtagttcgctcgcttttgcggcgttcgccaatccttcggcgacggaatcgcaattctcgcttttttccagccgatcttccactttgttcagcgttttcgcgatcgaagacattctggcgtcgtcttttttcgcatccttggttttatccgccatgtcaagcctccctgcttggtacggaccacatgcgtgcagtccatcgtagacacgaaaggggccgcttccccgtatttcgcgggaaaacgacccctacgcgtgttatgcgataccggtgctattcgtcggcttcggacttgttcttgtccttgccatcgcccttcgtcttgaacggattgtccttgatcggatgtccattcttgtcgaatttgacctggctttccggatgcgtctcatcgaagccttgggcgtacctggtctgacgccactggtggatggacgcgttggtgccgcgatggtgcacatggtagacacgctgcgcgccacccagcggcacgccttccttggccacggcgatctggttcacgttcgacggatccatgatggcgatcggcgcgaccggttccggttcggccggtgcagccgtatgctgctgcatgcgcgacggcagccattcggccagcctgctcaacagccagcagacgatgaaatagacgaccgcggccaccaccagcgtctgcagaatgttgaagtacatcgatccaagtcgacgtgattcctgcagcaggtcggtgtacatgatgatcgagccgagcgcggtgtccttcaacacgacgaccagctgggtcacggccgccggcagcatggcgtagatggcctgcggcacttcgatctgcaacagagactgcgtacgggtcaatcccaaggcgagcgaggcctcacgctggccgttcggcaggttgcccacgccggaacgcaccagctcggctaccacggatccgttgtagatcacgagcgcgagcaccaccgcccaatacgcggggctgggcagacctgcgaaggcgaaccagcgccagaagaagatcatgagcagcagaacggggacggctcgtgcgaattccacgatcgcgccggaaatggtacggatcagcaggctcggcagcagtcggcccacaccaaagaccaggccgaacaccacggctccgaccacggccagtacggacgcgcggatcgtggcccacagtcccggcagatagaagtcggtccatgcttcggcgtcaagcgccggcttccatagtttccagctcagctggttctcgccgtccggcggattgtgcagacgcatgaggatcagcacgaccaccaccgcgaagatgatgcctgcgatccaattgacgatacggatggttttgcggcccttcggaccaggctggtcgaacagcaccgcgctttcattgcttgccatgtcgcgtcacctcctcaccgcgagcttgttggatagatacgtggtcagcatgccgattggaatgatcagaaccacatagccgaaggcgaagatcaggaagatcggtacgatttggtcggcgtggtattcgatcatttcgctcatcatcgtcgaggtttcggtggccacggatgccgccgccgcgacggtggagttcttcagcaacgcgatcagcgtgttgcccaacggcgccacggaaccgcggaacgcctgcggcaggatgatctgagtggcggcctgcatgaagttcaggcccaacgcgcgggcggcctcggcttgaccaagcggcacggtgttgatgccggagcgcagcgattcacatacgaaagccgcggtgtacaggctcaggcccgtcacggccagccagaagaagttggtggcgaacgtgtcggagaagctgaacttcagctgcgcgtacgcacccagcaccatgaacaccatgatgatggtcagtggcaggttcttgaacagttcgacgtaggcaccggaaacggtacggagcgaggcgatcggagaaatgcgcatcatcacgaggacgacgcccagaatcgtggagaacaacgccgaccacagggtcagctcgatgttcaccagaaacgcgccgggaatgttgtattggctgaacaacgcgaggaatccgtccatcacttattcccctttccattcggcaccggcggattgtacttggcgttcggcgtgtaggccactcccctggtgttgtcggaaatagccctttgccaagaaccgtcctgaatcatatcggtgatggcgttgttgattttgttcttcagctcggtgttgcccttcttgacaccgatgccataatattcctgggtgaacggcttgcccaccacgcgcaggcgtccacgtgaggcggatgcgaggccagcgagaatgatgtcgtcggtggtggcggcgtccacaatgccggaaagcaacgcggtggcgcattccgccatgccgggctgttccatcaactgggtctgcttggcgaacttctccttgacgttgacggcggatgtggtgccggtcatggagcacagccgcttgccgttcagatccttaggtccgtcaatgccggtttcgtccttgcgtaccagcagatcctgtccggccacgaaatacgggccggcgaaatcgacgaccttcttgcgttcgtcggtgatggaataggatgcgacgatgtagtcgacatcgccgttctgcagcatagcctcacgctgcttggacggcgattccttccatacgatctcgtcttcggaatagccgagtttcttggccacgtacttggccacgtccacgtcgaagccgacgtaggtgccgttcttcttgaagcccaggccaggctggtcgaatttgatgccgatgcggatcttgccggtttcgtccgcgccgcatgcggataccgcgaacacgcacgcgcacgcgcagaatgccgcgacggctctgcgcaacatgcgtttcgtcgtgatcgaaagtggtttcatatcaggttccttcttctgtcgttatgttccgtcacttcagtgggtgaggatcttcgacaggaagtccttggcgcgatcggtcttcggatgttcgaagaagtcgtccggcgtgctctgttcgagaatctgtccgtcggccatgaacacgaccttgtcggccaccttgcgcgcgaaacccatctcgtgggtcacgcacagcatggtcatgccttcgtgggcgagttcgaccatgacgtcaagcacttcgttgaccatttccgggtcgagagcggacgtcggctcgtcgaacagcatgaccttcggctgcatggcgagggcgcgggcgatggcgacacgctgctgctggccgccggacagctgcgacggcattttggaggcctgcgaggccacgccgacgcggcccagcagatccatggccaggtcctcggcttccttcttgtccatgtggcgcaccttgatcggtgccaatgtcacgttttccaaaatggttttgttggcgaacaggttgaacgattggaacaccatgcccacttccgcgcgcagactggcgagttccttgccttcctgcggcaacggcttgccgtcgatgcggatatcgccggaatcgatggtttccagacggttgatggtgcggcacatcgtggatttgccggagccggacggtccgacgatgacgagcacctcgcctttgcgtacggtgaggttgatgtccttgagcacatgcagatcgccataatgcttctcgacatgggtcagttcgacgagcggcctgttatccgctcccgcgtccggcatgatgggacgcttcgcttcggtttctttcatttcagacataaagggcagtataagaaagcaatgcgaaattcatgtttcctatactgcccgttcacatcatttcgtccggaatatgagacatttcataccgtttgacgaacatattcatcaaacggatcgccgccggagcaatgtcacagcaccttggagaggaaggtcttcaatcgttcgctcttcggatggttgaagatctcgtcaggggttccctcttcctcgatcacgccggcatcggtgaagatgaccctcgtggccacttcgcgtgcgaagcccatctcatgggtcaccagcaccatggtcatgcctttggcggcaaggtcgcgaatcacttcgagcacatcgcccaccatttccgggtcgagcgcggatgtcgcctcgtcgaacagcatcaccttcggattcatcgccagcgagcgcgcgatcgccacacgctgcttctgcccgccggacagcgatttcggcatggcgtcggctttttcggccaatcctacggttttcagcagttccatggcgtgcgcgcgggcctgctcatccgtttcatgatgcaccagtttcggtgcgagggtgatgttgtcgatcacgctcatgttgttgaacaggttgaaatgctggaacaccatgcccacctgctcgcgcacctggtcgatgttcacatggctgtccgtcaaatcgtgtccgttgaccacgatcttgccgccggtggcctgttcgagtccgttcaggcaacgcaatatggtggatttgccggcgccggacggtccgatgatgcaaatcacctcgcctttgcgcacggtcatgtcgacgcctttgatgacctcggtctgcccgtagcttttgtgcagatccttgacgtcgatgatcacgtcgttctcgttcatcggttcaccttcctgtccacgatgttggccagccacgtcaggatggtgatggccacgaagtacatgacgccgacgatcagcagcgtttcggttacgcggaagttcgccgcgtacagctgctgcgcctggtacagcagctcaccgaagccgatggcgagcagcagcgaggagtccttgatcatgatgaccagctggttgatgatcgaaggcatggcgattttgctggcctgcggcagaatcactcggcgcatggcctgcctgtggttgagtcccagcgaacgtgcgccctccatctgtccggaatcgaccgattggactgcgccacgcacgatttccgccaggtacgcgccggagttgagcgacaaggtcaatgcgccggcgacccagatgttcacgctatgtccgatgagctggggcacgccgaagtagaagaagaacgcccacaccaggatcggggtgccgcggaacaccgcgatgtacacattggccaatcctgcggcgattttgctttccgaaaccttcatcaggccgaacgcgacgccgagcaccaatgcgatcgcgaaggaaagcagcgtgatcagcagcgtgttcctcaagcccgtcagcaatgccggcatcgactgtttgaccagtccgaggaaaccgaccttctgttgttcggcgctgtcgtcgccattgtcggtgatcatgccggaaatcgatttggcctgctctttcgcgccttgcttgccaagatattgtgcgacgattcgctcgtattctcccgaagcgatcatcttgttcaatccatcgttgatggcggccagcaaatctgcgttcatgcctttgttcacggccatgccgtattcgccgtgcggcaccttcggagtcacgattttcagaccgttgttctgcgatacgccatatgccagtaccggataatcgtcgaacaccgcgacggcattgccggatttgaccatctcgtacatggttgaggattggtcgacggaagtcaccttgtaaccgtacttgtcggcatgctgtttggcgtacgattcgccctccgagccggttttcgccacaaccgtccggcctttgaggtccttatagccggtgacgtcgtcgttgttggccgcgacggccatctggatgccggattggaaatacggattcgagaaatcataggaggctttacgctcgtcagtgatggacatgccggctatgacgacgtccacctggttggagcttagggcctgcaacgcggcgttgaatcccagcgactgtatctcgaccttaaagccctcttccttggcgatgcctcggattagctccatgtcgatgccggtcatcttgccgttctcacggtattcgaacggtgcgaacgtggtgtcggtgccgattttatatgtcttgcccttgaccgaggccggattgccagtttcggaggcgagcgcatgcggaacggtcgtcatgaatgccgcaaagaccacggcgagcacggcgaacagcgcgcatatgcgcatgccgaccgcgttcagtcgcttcttgtcctgtgttttcgatttcataccgcgcttcaaccctttctggttgccggataatcaaacacgctccactgtaatgacagcgacggaaaatagacaacgcgaataataaaaaatgtccgagcatcattgatgttcggacatttttcattcatctatgggcgaaaccgtatcagtcctcgtcctcatccggatcgtaatcgacaccggtctcggcgcgctgctcagcggagatcggagccggggcgccggtcagcggatcgcggccgccgccagccttcgggaaggcgatgacgtcgcggatggagtcggcgccagccagaattgcggcggtacgatcccagccgagagcgatgccggcgtgaggcggagcgccgtacttgaatgcctcaagcaggaagccgaacttgtctgcggcctcttccggcgtgatgccgagcacgtcaagcacacggtcctgaatgtcgtcgcggtggatacgcacggagccgccacccatttcgttgccgttgcacacgatgtcgtaggaatcggacatggcgtgttccggatccttgtcgaacttgtcgatccaatccttggacggcatggtgaacgggtggtgcatggaggtccacttggagtggccgactgccacatcgtcgtcgtccgggtcatcggtcggcttgaacagcgggaagtccacaacccaagtgaaggcgaaatcgtcgggcttgagcaggcccgcgcggcgggcaagctcgacacgcacggcgcccagcagttcctgggaggaggtgcggcgaccggctgcgaagaacacggcgtcgccgtcttcggcgccgacggcttccttcagaccgttgcgttcctcttcggacaggttcttggcgacggggcccttgagttcgccgttctcggcgaacaccacataggcgaggcccttggcgccacgctgcttggcccaatcctgccatgcgtcgaactgacggcgaggcgtggccgcgccacccttgaagagcaccgcgccgacgtatggggcctggaacacgcggaacggcgtgttcttgaagtaatcggtcagttcgatcagcggattgccgaaacgcagatccggcttgtcggaaccgtacttgtccatggcgtcctgccaggtgatgcgctggatcggcagcttgatgtcgtagccggcggacttccagatggcggcgatgaccttttcggccatggccatcacgtcctcctggtccacgaaggccatctccatgtcgagctgggtgaattccggctggcggtcggcgcggaagtcctcgtcacgatagcagcgggccagctggtagtaacgctcgacgccggagaccatgagcagctgcttgagcagctgcggggactgcggcagagcgtaccaggaacccggcaccagacgggccggcacgacgaagtcacgggcgccttccggcgtggacttgatcatggtcggggtttcgatctcctcgaagcccatttcctccagcgcatggcgggcggccttcgacatctgggctcgcagcttcagattgcgctgcatggacggacgacgcaggtcgaggtaacggtacttcaaacgcacgtcctcgcccggcagcttgttctcggactcgttctcaagagcggtggagacctggaacggcagagcatcggacttggccagcacttcgatgctttcggccacgacttcgatcttgccggtggccagatgctcgttctcgttgccgtccggacgcagacgaacctcgccgacgacctggatcacgaattcggagcgcagcggacgggccatctcctcgtcatagatgacgacctgcaccagaccggtgttgtcacgaagatcaatgaaggccacgccaccgtggtcgcggcgacgatcgacccaaccggcgagcgtcaccttctgaccgacgagctgttcggtcacttcggttgcatgatgtgttctgtaagccgtctggctcatgcttcccctattccttatcctcttgtatgttgcgaagtcttgcgatttcaggcttcaacggtaacggtttgctgggcatacacagtatccggctcccacgactgtgcgtcagccggccgctggtctcctgtgatgatgttcttgacttcgtcctgggcgccctcttcggaagcgtcagccgggaaccagacgtacgggatgccgagcttgtctgcatatttgatctgcttgccgagcttggccgcggtcggcgccacgtccgccgcgatgccacgggagcgcagctggttggcgatcaggttggacgcggagcggtcggcttcattccataccgccacgagcacggatgccggagacacacggttggcgtgcgcgcccgcggtgtgcagcatgtaggagaccaggcgggacaggccgatggacaggcccacgcccgggtacttcttgttgccctgcgatgcgaggttgtcgtaacggccgccggagcagatggagcccaaagcggcggcgccgtcgaggaacgtctcatacacggaaccggtgtagtaatcaagaccacgggcgattttcagatcggcgatcacggagcccggacggatgcgcgcggcctcgtcgacgatcatcgccagcgtgtcgagtccctggcgtgccaacacgtaggcgtcggaatcagacgcgatgtcatgcttggcgcacaatgcgtcgaacttgtcggacagttccttgccgtcggcagcggtcagctcggccagttcgaggcaggcacgggcctgggcttcgtcggcgccgcagccttcgacgagcagcttggccacctcatcggcgccgatcttgtcgagcttgtcgatctcacgcagcacgccttcgatatccgtaagacccaaaccacggtagaagccttcggagagtttgcggttgttcgcatgcacggtggccttcggcagaccgaactcgcgcagacgttccaatgcggacaccatgaccaacggcaattcgacctcgtaatggtcgggcagatcgccattgccgatcacgtcgatgtcggcctgcacgaactcgcggaaacgtccttcctgcgggcgttcgccacgccagaccttctgaatctgccaacgtttgaacgggaacgccagatcgccggaatgttcgacgacataacggctcagcggaacggtcagatcgaagtgcagaccaagacgatcctcaatcggagtgtcggactcgtgtccgacttcctgaagacggctcagcaggtaaatctccttgctggtctcgcctttcttgagcaggctggaaccctgctcaacagcacgggtttcaatgcctatgaagccattgagctcgaatacattacggagcgtgtcgatgacacgctgctccacaacacgttcagaggggagccactctggaaatcctgaaatagatgcacctttagccacggttctctataataaatgaggttacggaaaatgccgcgcgtttttcaaggtgtggaagcgcacgtcacggaccgtcacctctgcactacatgaagcttacgtaaggagctggccatggccgacgagaatgtcaccgcgtccgagaacaccactgaaaccaacgagcaggcagcgacgcccgcaacccaggccagcaaaccggccgtcccgagcccagcggccatgaagccgcatgcgccgagccccgcggccttcgccaagaaggctccgcagcgtcctgcaacctccaccggattctccgaagccgatatcaaggccaccgaagcgttcggccgtgtcgccgatgacggcaccgtgttcgtgaaggaaggcgagggagaacgcgaggtcggacagtttccggacgcttccaaggaagaggccctggcactgtatgcccgtcgctatctcgatctgaaggcaaagctcgacctgttcgccaacaggctcaagtccagcaatgtgaagaaccgtgagatcgacgagtccatcaagacgctttccgccgaaatcgagcagccggccgtcgtcggagatattgaggcgctcaagtcccagttcgaagcactgaaggaggccggagcggccaagaaggccgagctgagcgaggcccacaaggccgccgtcgccaaggcgctggccgaacgtaccgcgattgtggagaaggccgaggctctggccaattccctgggcgacaacaccaactggcgttccaccgcggacaagttccgttcgctgttccagcagtggcaggatcaccagcacaatagcgtccgtctcgacaaggccgacgccgacgccctgtggtcccgtttctcctccgcccgcactacgttcaacagcgcccgccgcaagtgggcccagggccgcgatgaggagcgcagcaacgccaaggccgcgaaggaggccatcatcgccgaagccgaggagatcaaggattccaccgcttgggtggaaacctcccgcaagttcaacgagctgatggatcgttggaagaaggccggtcgtgcgggccgtcgtgatgatgacgcgctgtgggcacgtttccgtgctgcggcagacacgttcttcaacgcccgtcaggccgatcgcgagcagattagctcgtccgaaaaggaaaatctcgccaagaaggaagaactgctgaccaaggctgaggctttggtgccggtcaaggatgagaaggccgccaagcaggctcgccaggcattggccgccattcaggaggaatgggaccagatcggctacgttccgcgcgatgacatgcaccgcatcgaaagccgtcttgatgctgtcgacaagcagatcaaggctgttgaggatgccgcctggaagcagtccgatccggaagccgacgcccgtaagtcctccttcgaggagcagctcaacgcacagctcgccgaacttgacgcccagatcgccgctgagtccgatccgaagaagaaggccaagcttgaggcggagaaggccaccaaggaacagtggctgaacgccatcaagtaatgacgctcccatagagcgatacggttgtggttccgcttggaagcgggcggaaccacaaccgtccagctgaacgaatagctggacgaataggcatatgtaaaaaagaccggtgggtttcatgacattccatcatgaaacccaccggtctttttgcatacgcgttgccggggttcttaccccggcaacgttggaaatcagttctgcgactgcgcggaatcagccggttccgtcgatgccgtcggttcagtggcggcatcggtttcagcggccgtttcggtcgcctccgccggattatccttctggttcggctcttcgaaggcctcgccggtgaacgtgaactcacccagaatgccttcgccttcggcgtccaccttcacgcgctggccatcttcgaggtcgcccatcaggatcttctccgaaatggcgtcctcgatgtcgcgctgaatcacgcgacgcagcggacgggcgcccagcagcgggtcgaagcccttctgtgcgagcagatccttggccgcgtcggtcagttcgagcgacatgtgacggtcgaacagacggtcgttgagctgcttgacatccaagtcgacgatctgacgcacctgcggttcggtgagctgcttgaacacgatgatgtcatccagacggttcaggaactccggacggaactgctgcttgagttcggcggagacctgttccttcatgcgctggtagctcgattcggtgttcgtgcccaggttgaaaccggtgttggcggccttggcgatgtcacgagtgccgaggttggtggtcaggatgatgatggtgttcttgaagtccaccttgcgtccctggccatcggtcagatggccatcgtccagcacctgcaacagcgtgttgaaaatgtccggatgggctttttcgatttcgtcgaacaacaccacggagaacggcttgcgacgcaccttttcggtaagttcgccgccttcttcgtagccgacgtatcccggaggcgcaccgaacaggcgcgacgcggcgtacttttcggagaattccgacatgtccacgcggatcagcgcatcctcatcgtcgaacaggaattcggcgagagccttggccagctcggtcttaccaacgccggtcgggccagcgaagatgaacgaaccagccggacgcttcggatccttcaatccgacgcgtgcgcgacggatggaacggctcaatgcggacacagcctcatcctgaccgatgatgcgcttgtgcagttcactctccatgcccatgagcttcttggactcggcctgggtgagcttgaacaccggaatgccggtggtctgggaaatcacctcagcgatgacgtcctcatccaccaccatcttcacatcggactcgccctcacgccaagcggattccttctccttgcgctcggactcgatcttctcctgcttgtcacgcagctcggcggccttctcaaagtcctggtccttgatggcctggtccttctcctcggccagcttggcagccttggcgtccaattccttgagctccggcggagcggtgagcctgcggatacgcagtcgggcgccggcctcatcgatcagatcgatggccttgtcgggcaggtggcggtcctgaatgtagcggctggaaagttccgccgcggcctgcagcgcgccatcggtgatcgtcacatgatggtggttctcgtaacgctcacgcaagcccttcagaatctcaatggtctcggcgatggtcggctcgtgcacctggatcggctggaaacgacgttccagcgcggcatccttctcgatgtacttgcggtactcgtcggtggtggtcgcgccgatggtctgcagttcgccacgggccagcatcggcttcaacatatcggaagcgcccaaggcgccatccgcggagcctgcgcccacgatggtgtgaatctcatcgatgaacagcacgatgtcgccgcgggtcttgatctccttcaaaaccttcttcaggcgttcctcgaaatcgccacggtagcgggaaccagcaaccatggaaccgaggtccaaggagtagacctgcttgcctttcagcgtttccggcacatcaccggcgttgatcttctgcgcgagtccttcgaccaccgcggtcttgcctacgccaggctcgccgatcagcaccgggttgttcttggtgcggcggctcaacaccaccatcacacgctcgatctcgttggatcgtccgattaccggatcgagcttcccagcggcagcctcagccgtaaggttgcggccgaactggtcgagaatcgcggaaccggtctgattgcgacggtcctgcacgccaccggcattggcgagttcgcccttgccatcgttcttgccgtcgctggaattgcctcggatcagatcgatggtggcgctacgcagttcgccaaggttgacatccatcttgatcagcacctgtgtgccgacgccttcgccctcatgaatcagaccgagcaggatatgctcggtgccgatatagctgtgccccagctgcaacgcctcacgtagcgacagctccaacacctgcctggcatgcggggtgaagggaatgtggccgttcggcgacgcatttcccttgccgatcatctcttcgacctgcttgcgggtgtcgtccaaggtcacgcccttcgaggccaatgccttggcggcaacgccttcaccctcacgaatcaggcccagcagcagatgctcggtgccgatgtagttgtgctggagggtccgagcttcttcctgcgccaacacaatcacgcgtcgcgcacggtcggtaaaccgttcgaacatgcttgtccttccactcttgttagtccttcaacactctaccgattcgcggtgacgtttattccgccggcgcgtaaattgcgctatggacgcaaaggaacggatatgcttgacttatggcaacgaccaaggaggtcaccaaatgagcgacaccatcctgcaatcgaatgatgtgatggattcccgccgaggcgacatcgtcgtcggcgtcgacgggtccgatgaatccttcgcagccctgcgttgggctcttggcgaagcatcgctgaccggacagcaggtgaatgcggtctacgcatggacccattcatgggatatgggatcccagccggaagatgaggagcaatgggcgcagatgcgtcatgatatcgcccgtcggctgcgcgaatgggtggcccaggcctcgcaaggcatgacgattgacgagaaccgcgtcaaactcacctccgtcaaagccaccggaacggcagcgcttctggaaatcggcaaggacgcccaacagatcgtcgtcggacgtcgttcgcttggacgcgtggcacgatggtttctgggatcgctttccgcttctcttgcagaggaggcgaaggtgcccgtcaccgtggtgcgtatcctcgatgatgaagaggcatccgtgcaggacgccatcgccaatgcacttacgccgaccgaggaaacggtctcctacacgatgccgggttctcccctgcctcggaaccagcgtccggtggttgtaggcgttgatggttcggagacctccaaacacgctttgcgtttcgccatcgatttcgcggccctgcatcacgctcccctgcaggtcatgttctgctggcagctgaaagatttgggcgtggtcaaagggtatgagaacgccgtcgctcccatctccgtcggccaggcgcaggcggaacgcatgcttgatgaattgctcgattcggttcaggtttcatcagcgaacattcccgacgatttccaaatcgaatcgcacgctttccatattcccgcctcgaaggggcttatcgcggcttcccgctacgcacgtcatctagtggtcggttcgcgcggcttgtccggtctggacgcgcatttccttggatcggtttccaagcaaatcatcaacttcgcagactgcaccgtcaccgtcgtgcactgaccgcataaaaaagaaaacaagatatgagagggccacgtacacattcaggtacgtggccctctcatatacgatgacgattattcgtcggattcggcttgagccgacgaatcagcttccgtcatttcgctttccgttgtttcagccgccgccggttcggtttccgccgattcggcttctgttgactcggtttccaccgattcgtcttccatcgatttgttttccgtttgcccggtggtttcagcagtcggctcaactaccgtctcatccatctgttcaaccggctcgaccgacccggcggaattgacggaatcggcggaatcaacctgttcagcctgttcgactggctcgtccgattcagtcggctcagccgtatcagccgattcggtatcgtccgacgtttccggcttattctcgtcgaccacggtgacggtggtctctacttcaggcgcatcgtcggaggccacatgctcaagcacatcctcttggctggcgtcgtcgtcgatggtgttggcttcgatgtccgcgtccgaaccttcctcatcctcattcggattatggtcgtcatcggacgaaagctgttcgatcagctccacggagccccgctcgtcacgcggcgcctgggcgatgatatcgatatgcatgtcgtcgaacgccggcttcgactgcacccacagatgcgacggctccggtggatcgatttcggaatgctctccgcagccatgatcgatggacacgaccctgccgtcatccgggctccacttgttggcgcacacgccgaacagcaggttcaactcacccttcagcggaatgaagaatccgcatgtggagcaaggattgccgtcggccgtcttggtggatagcgattttggcccatgtgggccttcgtaccaacgttttgcggtctgcgaccggccaagcggagtcaacacgtgcctgcgggacaggtcgaattcctcgaccgcctcttcgacatcctcttcggacgtcacaggctgttcggaatcctccgaaacgtccgtcttctcagactcatccgaagcgtttccatccatcgccggttcctgtacggtttcatccgcgactgacggtttgtcgtccgtatcgtccgatgtctcggcatcctgcgtcttgcggaagccctcttccatgcgggggtcatcgggatcggtgccgattgaatcagtcaccgccaaatcgcccggctcgagacggtccttccaaggaatccattttggcggacgcagggccttgtcggtcgggaccagggatgattcgttgaccgtccaatggtccagttcgacatcatggtataacgtgaccgaccattgccagccttcgtagccgcgtactcgggattcgaagcggaaatcggtgacgttgtctcccaggtcgatggcttccacgaagtcgccgacctgaccgtcctcgtcggacactgtgacagcgaccgcttgggcgattgccttgggatccattgtggtatcggacatgaaactctattcctgtacgtcgaaattgtcggcgaccgcgcgcagaagcgtggcgagcttcttgctttcagccggtgaaggatagcgatgtcgacgaagctgattgcccgcggagtcaagcagcttgatcagatcctccacgatggcggccatatcgtccggcttcggacgggtggctttaaccagcgacggggccgaggcaaccagcgtcactcccatcgcctgcggcccacgacgaccatcaatgacggaatactcgaccttggcgcccttacgcagcgtcttcacgccctcgggaagggcggcagcgggcaggaacacatcatccgtgctctcacccgtctgaatgaaaccatagcctttgttcgcatcaaaccaacgaacacgtccgctcggcattgtcacctcacattttgctgatcagataccttcacgcgaataggtaaaaccattcgcccattttcaaaccaaagatacagtttagcgcaagaggtgggccgcacccatccttccgcgccgatagcgtctgctttcccgacggaaaagagcgttatttctttgatttgcgattctttttttcgttttttcgattctcgctcaccgtaatcggctgcggcttgggttcgaccggggcgatcggcagcaccaccgtcagggtcagtcccgttccttcgctgccggatgcgcagatgaatccatgatgcgccttgaccacggattgcgcgattgccatgccgagtcccgtaccgcccttctgacgcgcacgcgacgggtcggcggtgtagaaacgttcgaagatcttcgaccgtgcctccggcggcacgccgggaccgtggtcgctgaatcgcacaatcgcgtagttcatacccacttgcatggactgccccacttcgatggcttcgaccagatggcgaagcgactgctcgttggacggcatacgggatagggattcgggactgatcgacgcggggagcacacccatggagatctccacaggcgagtccgccggcgtataccggtggatattgcccacgatgttggtaaccacttgacgcagtctcgaagcatcacccttcaactcaatctggggcatctggccattttggaaggcgaattgggcgggatggtccatatcggtacctggttggagcacgacctgtccgcaggaaatgccgcggtcggggtcaagcgcatgcaggtcatcggctgcgtcgcgcaccacggaggtcagcttcacctgctgcgtgatgtcgatgccacgtccttcgtccaaacgagccaaagacagcaggtcctccaccagaaccgtcatacgcgcgctggatgcctcgatatgttcgatggattcatcagccctctccaaagccccaggcatgtcgcgctgcattttgtacagctcggcgtacccgtgaatggcggcgagcggcgtacgcaattcgtgactggcgtccgagacgaaccgcttcattttttcggtggtctcttcctgcgcgtggaagctctcctcgatgcgtgtcagcatggtgttcagcgacatggacagagagccgacctccgtgctttccggcaggtctggcacacgttggctgagatctcccgcggcgattttcgcggcggttttttcaatccgcttcaaaggcgcgagcgtgctttgcaccagaatggtgccgagtatcgcgccgatcagcaccaccgcgatgcccaccatcgcgcagaatcgcgtcaatgtgttggccgtgtcgatctgatcgctcagcgacaggccgatgaacacgacgccactgtccttgacttgcccggtccgtgtcttctcgttccaaggcaacgcgacaacacgccatggcgactgcgcggcctgcatgatggaatgatccggggtgcggcttgtggtgatgtgcaccaccgcacgtgtcgtgaatggctgtccaagagtgacgccgtcgatgctgccgtcggccggcaggcttggttccgaaaccactccgtcacggagcatgggcaccgatccggcacccgtgcttttgtattcgctgtcgcgcacctccacgtaatacgtgttcatgaggctgcgcccgtcatcgccggtgtcgctgctgagcgagtccatgctgttgaaaatcagctgggcttggttgatcagctgcgtatcggtcttctgcagcagataattgcccaccaacgtacgtatggaaaaggagatgccgatggtgccgatggtcagtagcacgatgatgcaggtgaccagtttcgtgctcagcggaatcgcttgaatcctgcgggtgaaacggctccataccttgttctgcttcggcagcgaccggggaggctgcatgggggccggaatggccgaaggattggaggcgtggcccgtggacggcgaactgggattcttgctcatgactgaatctagttcttgggagcgcgaatcatatagccaatgccgcgcttggtttcgatcagcggcgttaccttgtgcttgtcgccgttctcatcctcgatgacgatgccatcgaccttcttgcgaagataggagatgtacgattcgacgatggccgcgtccccgccccaatcgtattgccacacgtgatcgagaatctgcgccttggacagcacgcggccttcattgtccatgaggtagcgaagaagcttgtattcggtggggctcaggtcgattggctgtccggctcgggacacgtcgtgcgagtcctcgttgatttcgagatcgcccacacggatgatcggatcgtcctccacctgctgctgggtgcgacgcaggatggcgcggattcgggccacgacctcttcgaggctgaacggcttggtcacatagtcgtcgcctcccacggtaagccccatgaccttgtcttgggtgtcatcgcgagcggtcaggtacagcaccggcgtggtgatgccttcctgcctgatgcgtcgggtcaccgtgaacccatcgatgtccggaagcatcacatcaagcacgatcagatccggctgcagcctttcgatgacctcgatggcttcggatcccgaagcggccgtgttcacttcgaaaccggcgaaatgcagggatgccaccagcagctctcggatggacggctcgtcatcgacaacgacaatggatgcttcaataggcttgctcatggcttaagcatcgctcccttcactggatgtttcctgaacagattctgaatcttgcgttgaagcggtatccggattgacataatcctcgttttccgattcggcgccccactctttgaccggttggatacgttcggcgaccgcaccatgacggccgctatggcggcccttacgccgatgcccgatcacgtccttcttgcgcaggatatggaacaccaccagaatcaccaccagaagcagcagcgcgccggcgaatcctcccacgccaatccatatggtccgcgacgaagtcgaggtctttttctgcaccgaaatctgattcatcatgtcggtcgcggacttcgcccagtccggatcgctttccatcaacggtttttgcgcggcatcggacagcgcgtcgacggtcgacttcttcttcagccattcctccgagttcgaagacacggccaccaccagattgccgtcattcgaggcaaccgccaacatcacggtattcggtttcgggttcaacgattccagcagcgcgctcacccatttatccggcttgcccttggcgttgaaactgtccagatacaccaaacggacggtgacgccggtctcctttttcgtctggttgatggcgtccgtgatctccgagacattcgaaccgagcagattctgcgtgtcggtgatgtcgtccgtggctgtaatgcccaatccggcaccgtcatccgcatggaccggcggagttatccacagcatcaaacacaaacccagcacgctcgccagcaacatgcaaatcgcgatattccaaccttttgccgttctgccgccgtttcgcgacacgccgacggaacccaaatgcatatgttctccgaccacagctccgtttttttcgttgcacacgctcactgatgacatagcatccactgtaccgtccggttgcgccaaccgcgatcgcatggagaaacacaccaatcatcattgaaaggaccggcacatgccacagtatcaagtcgacagcgagcagattcagtcctcgagcgccgccgtcaacgcctccatccaatccatccgacaggccgtgcagggcatgtacggcaatctcaacaatctgcagagcgtttggcgcggcggggctgcgacgcagttcacagcggtcgccgaacagtggcgtgccgcgcagcagcagatggagcagtcgcttgaatcaatccagcgcgcattgatgcaggcctccacgttgtattcggagaccgaaatgcaggcgtcgcgtttgttcgcgcagtagaaagcgcgcgtaaggcgccttccagataagcaaaggcccgctccccatcgggaagcgggcctcatatcagctatttgagcctatggaagcttccggtctttcgatcagtagcccatgtcggcgccagctgccggagcggctgccggcggttccggcttgttggccaccacggcttcggtggtcaggaacagtccagcgatggaagctgcgttctgcagagcggaacgagtcaccttgaccgggtcggtgacgcctgcggccagcaggtcctcgtactcgttggtggccgcgttcaggccctggccgtcaggcagggagcggaccttgtcgatcaccacgtcgccggacaggccagcgttttcggcgatctgcttgatcggggcttcgacggcacggaacacgatcgcggcaccggtggcctcgtcgccttcgagcttgacgtcgtccttggccttggcggcagcctggatcagggcgacaccgccgcccggcagcagaccttcctcgatagcggccttggcgttgcgcacggcatcctcgatgcggtgcttgcgttccttggcctcgacttcggtggcagcgccgaccttgatgacggcgacaccgccggccagcttggccaggcgctcctgcagcttctcgcgatcgtaatcggaatcggtgttggcgatctcgccacgaatctgagcgacgcgagcggccacgtcctccttggagccgccaccggacacgatggtggtctcatccttggagacgatgaccttcttggcggtgccaagcacggacatgtcgacggagtcgagcttcaggcccagctcatcggacaccacctgggcaccggtcaggatggccatatcctgcagcatggccttacggcggtcgccgaagcccggagccttgacggcgcaggacttgaaggtgccgcggatgttgttcagaatcagggtcggcagagcctcgccgtcaacgtcctcagcgatgatcagcagcggcttgccggtcttcatgaccaactcggcgatgtggacgacatcctgctgggagctcagcttgccggaggtcaggaggatgtacggatcctcgagaacggcggtctggtcctcggcgttggtcacgaagtacggagcgatgtagcccttgtcgaagcgcatgccctcggtgaagtcaaggtccaggccgaagcggttgttgtcctcgacggtcacgacgccatcctggccgaccttgtccagagcttcggcgatcttctcgccgacttccggatcagcggcggagatcgttgcggtggcagcgatctggtccttggtctcaacgtccttggccgctgcgacgagttccttgacgatggcgtcggcggccttctcgatgccacgacgcagcgcgatcgggttggaaccggcggtgacgttcttcagaccctcgtgcaccagggactgggccagcacggttgcggtggtggtgccgtcgcctgcgacgtcatcggtcttcttggcgacttccttgaccagttcggcgccgatacgctcatacggatcgtccagatcgatttcctttgcgatggaaacgccatcgttggtgatggtcggagcgccgtaggtcttgtcaagcaccacattgcggcccttcggaccaagggttaccttgacggtgtcagcgagcttgtcgagacccgcgagcattccctgacgagcttcgtcgtcatatgcaatcatctttgccattgttcctccacatatggctacacggtattatttccaccttcggagcgacaatcagaaccagccgtcagccgccagttatcactctcactcgtcgagtgctaattcgcagattagcactctcacgtcgagagtgccaaacccgatgacgttctttgcgctgtgagcaagatgtcagtcgcatcgaatcaacttgaaaaacgccggatttccaagaaaataaaagaacctcgcctatgttcgggcgaggttccaaaccggttcggacggcgttttttcagttcaacagcaccacaacgatcggcgtgaccaatccgctgctctgctggacattggagattcccagcgtctgcgcgacattctccgccgtcgccttgtcggcctcattctgataccagacaaccgtctggctgggaacgttgccggtcggattgctgggcgtcacgctggtgtatccggcctgggtcagggcatcggccttgctcttggcgtaaccggtgatgctggtggcgttcaccacgcggatctcggtggccagattcacgctctgctcagaagccgcatcctggccattgttctgatcgttattctgttccgcgttctggttggcgtccgaagcgtccttcgactggccatccgaagtactggtcttcttgccgtcctcggacttcttgttctccgtcttggcgtctttggacgtgtcgtccgtcttcttatccgccttatccgccgtggaaacggacgatgaagagtcctccttggccgaccaaggcattctcaggttgctgatctcaccagaatagactccccagaacagcaggccggcgagcagagccacaatcacgacaatcacatacggcagagccctggacgccatggaacgtgcgccacggtgcacgcccatcggtcccgccggaggattgtcgaacatatccttggcgtaggattcgtaggtctccttgtcctgcttagccattttctgcaacctcatttctcacacttaccgccccagtgtaccggcccgtgcagtcagcccacaatcagcatcgtcgattttgcgcgtattcgacacgtttccgcatggaatcggcatggacatccacagggcacgtcgtacagtgggaaagtatgactcatatcaaaccattgaaggatcttgtggagcccggatgggcccaggccctcgccgatgtcgaaccccagatacatctcatgggagactttctgaggtcggaaatcgcggcgggacgtaagtaccttccggccagcaggaacattctgcgcgcgtttaccattccattcgacgacatcaaagtgcttatcgtcggccaggatccctaccccacgccgggccatccggtgggactgagcttctgcgtggcaccggacgtcaagcccattccgcgcagtctggcgaacatctacaccgagctgaccgacgatctgggcgtgcccatgccggccaacggcgacctgacaccctggaccaagcagggcgtcatgctgctcaacagatgtctgaccgtcgaaccgggaaagccgggaagtcatcaggggcgaggctgggaagtggtcaccgacgcggccatcagcgcattgaacaatcgccgtcggcctgacggcagcgtcaagcctctggtcgcgattctgtggggacgaaaggcgcagacgttggagcccctgctcaccaacgctttcatcatcaaatccccccatccaagtccgatgtccgcccgctacggatttttcggctcgaaaccgttctcccgcgccaatcaggcgctaatcgaagcaggagaacagccggtggattggaccctcccgtcagcttgacccgttagagtagcaaccatggctttattccctccaaagaatccggcgccagcaccggcacccatccccatgcccgcagccgcaagaccaaccacgctgtcggccgaagacatcgcacgcgccaggaacatcggttcgcagattcgcggacgtttcgcgcagaccctggtcggacaggacaatcttcgtgaatcgctgatcaccactttggtggccggcggtcatatcctcatcgaatccgtcccgggtctggcaaaaaccactgccgcgcagaccttggccacttcggtgtccggctcgttcaaacgtgtgcaatgcactcccgatctgatgccttcggacctggtcggcactcaggtcttcgatttcgccacgcagaaattctccacgcagatcggcccgatccacgccaatttcgtgctgctcgacgaaatcaatcgttccaacgcgaagacccagtccgccatgcttgaagccatggcggagggcgcgaccaccatcggaggccaacgcatcgcgctgccgaaaccattcatggtcatcgcaacgcagaatccaatcgaggaagagggcaccttcaatcttcccgaggcgcagatggaccgtttcatgatgaaggccatactgacctatccgacagcgcaggaagagcaacgcatgctcgccatgctgacccgccgcggctccgataccgtagaccagcacgcgctcaccggtgacaccgtttccatcagcgacgtcgaattcctgcgttccgcggcacgtcgtgtgcacgtgtccgatgcgatcatgcagtatgcggtcgatatcgcggccacctcccgtggcgctggaaccaagcccgtccaaggactttcctcgctcgtcaggctgggcgcctcgccgcgcgcgtccatcgcgctggtgcgcataggacaggccaacgcgctcctgcagggacgagattacgtcattcctgaggatgtgaaggcgttcgcccacgaagtgttgcgtcatcgtattctgatgacgttcgaagcacttgccgatggcgtcaccagcgaccaggtggtggattcgatcgtgcaggcggtccccgttccatgatcgaccagatccgttccgacgatccgatccgcagaaaaatcgagacgcttggaaccacgctgagtctgccgacggtacgcaaggctctcggcatactcgaaggcgcgcacgaatcgaacaaacgcttcggctccgacgatgtcgtggatatccacgcctatgagccgggagacgaggcgaaacgcatcgattggaagaccagtgcccgagcgggacgtccaatggtggtgcagcgtgagcgtccctccacttcgaaggcatggttgctgcttgacgtcggacaggagatgaccgccacatgcccttcctcggaacaggcgtatcaggtggcggcaaatgccttatgcatgttcgccgcgctcagcctgcgccgaggcgacgaagtgtccatggtgttcggcgacagcgcttccatcacccgggtgccgttcaacggtggcctggcgcagttcgaacgaaccttggatacggcattgcagcgcgagtggaccaggccccgcaatatcgacgcgttgctggaatacgcgcgccgcattcgggacaaagaggcgctggtcgtcatcgccaccgaggagcatgcattggaggaacggcatttgagcgccatccgcacgattgcaaggacacatccgatggtgctcatcgatgtggccaccatcaatccgtttgatgtcagccatgcgcgcgtggtgcttgacggggctggaaaacgacgcgtgcctgcgttcctgcgtaggggaaacacagctgggcaagtgcgaacgcatcgcgaatacctggctgcgtccattcgccatgagctgaatcgctgtggctcgacggtaatccgatccgattccagcgaacgcatgttccatgagttcgtgcgcatggtttccacggctttggcccagtccacacgtaaccaattgagagccccgtccgtattgtcgttgggagacaaggcatgatgctcttccttgccgaggatgacctcgtcatcaaggaccagattcatcttgagaacggtttggccgtcgtcatcgcggtctgtctgttgcttgccgtcgttttggtggctcttgtggtctggcttgcccggccgagccggaagcccgcaaaaatagtcaatcgcggccgacatgacgcgcttgccggcaaaaccgtctggcatcagcgtatcgatgatgttgtgtcccgccatgcccggggggagctggagcgcgaggaggctttcgcacagctggccgcaatcgccagggattttgcttccactgccaccggaacggacgtgcgcaaccagacgctcaccgacatcgaagagacgcctcggaccacggggaaccagcagggtctcaccttgctcaggcaaaccatcgaggcattgtatccgccggaattcgcggatgccgagcgcaatcacatcgccaggcaggccacggtcgagcaggctggcgaatgggtggccaatcttgtggaaaggtggcgatagatgcaactgtcatggcattggccttgggtctttctggcaggcgtcatcgtggtgctggccgttgccggcgtcacgttgctggtggccgcgcgccacaaaaccgatgacatcgagagtgcccgcaccttcagcctggatgatgacctcaacacggaatccgcatcgagattattccgccagtggagggttctttcacgtttggcggtgattcttctagtggtcgcgttggcactcgccacggctctggtggcacgtcccagcaccgtggatgaaggcgaggagaaggccagcagccgagacatcgtgctgtgcttggatgtttccggctcggcgctcccctacgaccgcgaggtcatcgacacctaccgtcaactcgtcgacagcttcaagggcgagagaatcggcctgagcatcttcaattcgacgtcacgtaccgtttttccgttgaccgacgactacgaactggtgtccaaacagcttgacaaagccagcagcatcctcgcaggcgtcgagtcccaagccgatatcgacaagatgaaggacagcgattatcaggcgatttccgactggctggaaggcacgcagaaccgtaaggagtccacttcgctgattggcgatggcgtggtgagctgcgcggccatgcttcccggattcgcctatgggaacgcaagcgccgacaatgccgagcgtcagcgcgccgcatccatcgtgcttgccacggacaacgtcgtttccggaaaaccaacctatacgcttgacgaggcgctgaacctgaccaagcaggcccaaatcaccgtggatggattgttttccggaccgaagcagagcgaggccgacgagaccacccaggaattcaaatccgccatcgaagctcatcatggggtgtttctcacccaatcgaatggagcatccgtctcttcgctggtcaaggaaatcgaatctcggcggaaccatgaaaacgagtcgagcaacaaggccgccatggtggatgctcccggatggtggacactggccttggccatcgttttgatggtctggctggcattggcttggaggttgaggagatgaaccatctgacactttcccctgctttgggttggcctgtcggcggagccgtcgccgtggttctgctggcctgcgccattgcgcagatcgtattgcatgttcgtcgccgcgctgacagcgacgaaaccgtttgggcatgcgttcggcgcgtattgctttgtctgacggtgtcggtcatggcattgacgcccagtatcgtggcgccgaccaatagccgtgcggtgaacgccaccgacgtggtggtggccgctgacgtgaccggttccatggccgtcaaagacgcgcaatatggttcagccgaacagtcaagccgtctcgacgtggcaaaacaagccgtgaaggacgtcaccgcgctatatcccaattccagtttcgccgctttgcgattcggagcttccggcacgttggacgtgccgttgaccccggattcgaacgcgatcgacaattgggcggatacactcgcgcccgaggcgacttccgtttcggccggttcgacgttggatgcccctatcgaccagctgctgctgacctgcaagtccattcatgatcagcatcccgatgatgcgatcgtgctgtacctgttttccgatggagaacagacctcatcaaaggcacggcgcacgttctcatcattgcgacgatacctatccgatgccttcaccgtagccatcggcagcgagcagggaggcaacattcccgtaatcgccgacggcgtcgatggaaatgcggaccagtgggtcaccgaccctgataccggcaaacccggagtgtcacgcatgaacaaggatgagatggcgtccatcgccgacgagttgagcggtaccgcgctggtgttgaacgcctccaacaccatgcgtgacggcgtgtccaaggaaacgtccgataagtggcgagtcacccaaaccaccaagaagcgcaccaggacgatgcccgtcgtatggccactggccatcgtcacgctgctgctgctcgcatgcgaattgggggcttggataattcagtcgaggagtttgctatgaccagaacaaccatgaaaccgcgtgcctcgctgacggttcgcatcgttttggccgtcatggcggcgttgctggtcatggccgccctatgggccatagtgaatctcgcagccgtcaatagctacaaccaggccacgcaaagcctgcaggagaacatctcgaccagcagaaaagacgatgccgattgggacaagctgcacaccaggcaacagcagacggacgcccaattcaacgaggcatcagccatgaagccgctgctgctgccccaagtgcgcgaatcaatcgagcataacagtcatgtttccagccagcttacggatcacgcgtccaagaagatcaaagccgagcagagcgatcagtccgcttccacggattcaaacaccgccgacgctcaggaatcgggtaaatcaagtcacaagaacgacgaaaacctatccgacgaacaacgtcggaaaatagaggagctattggctcagaacgcccaatccacgcaatcggatcccaatgacgattcaggttcggctgcgaaaaagaacccaagcacttcatcctcgcagaccaaaccctggtagggggctttttcgaatatagttatccacatgccgtcgacgtggttttcgttgtttttccaataacgacacgccgacggtttttcatagactcgttctttgaccacaagctctgttttccgattggcgtcaacaccgaatgtggtcaaatggctgccatgaacgtttcaaatgcttttcttggtgccgccccaggcgtcgcagccttcaattcgttggcatctctgtcgggaatgtcctgtcgttgccgaattggcgtgcggaccacccaaacattgatcaatgcgaaacttgttgccgcgtcacggcttctcgatgaacttgatgcggcaatagcctccaacagactggccgactggaccggcaccgcggccgaggaataccgcacccgtctcaatcgcatcgcacggcaatccgctctgctacgtgacgatatgatcgccacgtcacgtcttctctggtcggcaggtgcggcatgaaccaacgagtgacggcccgcatcgttggcggaaagagattcaccaccgccgaataccgggaatacttcaatgcttcaagaatcctcagagatcaagcgaatcgtcttggcacttcccgtagatccttcattgccgcaggctatgaactcaaaatccaccctcgcgccacaccgctcctgtccgctttgaccggggcaagtccacggtgtacggcgcaggaccatatcgaattgccgtaccggcagctgctcggacgttgcgaagcacatgccgaggccctgcaatccatggcatcccagcttaatgagctatcctcattgatcgcacaagcccaatccttatacgcccaagctgaggaagccagcaggaaagggctgaatatcatgttgcgagggcttttcatgtcatcacgggaatccgcgattctcgccttgaccgccagcgcactgatgggggtaagacgcagttacgccaaagaggggaaattcaacaaattctatcttgtggaatccaccgcatggatgcaggaaagcttcgtgagcgtcctcggagagcatgcgagccgattgaacatacaggaacgcccttcaaaagacacgtccatcctggaatacatcacgaaaaccttattcatggtcaccaaaccgggagcggttatagcagaggggctttccggcaaaggctcggtcaatcgcggtcttaagaaaatcgacagactgctcataccgtacttcgacaaagaccatggagacaatctctccgtaacccgtgtgtatccgaaaaccaaagtggtcagaggcggtacaagcacgaaggacgccatcgccgaccaacggcggctgtccgaaggacctctcaacggcgaacgtgaaagcggtctggaatacggaaccatcgcatgctgcaagtaccgcaaagccgatggcacatatgcttggaggatcatcattcccgggaccgacggcaatcacgattcgcctatggactggtacaccaatttcgagctgatgagtgccgatgagcggcagcgcggaaccgcggaaagcctacgtttcctggatgagaccatgaaacaggccggcatccagccggatgatcccgtggaaatcgtcggccattcgcagggcggcatcatcgcggcagcggcggcgacggatttccaagacaaatacgacatacaacatatcgccacgcttggctccccgatagcgaatttcgagattcccgagaaaacacgggtcaccgccatcgagatggataatgaaggcatcgcggcacttgacggggaggctaacccccatacggagaactggctcaccatacgatgctccgtccatgaggaagatgcgccgaagagggcttttccaggagccgaagtcagtgattcgtccggggagaagaactccacgcactacccgaaataccatgaggcgggataccggtacgcctacgacaccggaagcaaatccgtgctggaccatgaccgtcatttccaagaggtcgtggaaggcgagctggaggaggtccagtattatgaaggacgcatcagcaaatgacgggaccaatggttcacggctgaacgtatgctgttgtctatgaagcttactgacatctcccccgcaatcgcactgacccctcttgacggccgctaccacaagcagaccgctccccttgtcgaatacatgagcgaaccggcgttgaaccgcgagcgcatgcgcgtcgaagtcgagtggatgattctgcttgccaacggtttcgagggcaacggcaatcagaccatcgttccgggtgtcaagccgctcaccgatgatgagcaggcgtatctgcgttccattccggagaatttcggagccgaaggcattgcccagcatgccgcttatgaggctaagacccaccatgatgtgaaggccgtggagtattacatcgacgaccagctggagaaggccgccgatgtgttgggtcatgacacccagctgaccggattgaagactctcgtgcattttgcctgcacgtccgaggatatcaacaacctgtccatcgcccgttgcgtgaagaacggtgtggagcaggtgtggctgcccgcagcccaggccattgtcgaccatctggcacagaaggccgacgcctaccgcgacaaggccatgctgtcgctgacccatggacagcctgccacgccgaccacgctgggcaaggaactggctgtttatgtgtatcgtctgaaccgtcagctcaacaaggtcaaggcccaggaatatctcggtaagatcaatggcgcgaccggcacgttcggtgcgcatctggccgcctgccctgatgttgactgggtggccgtctcccgcgagttcgtcaccaaccgtatgggtctgacgtggaatccgttgaccacgcagatcgaatcgcatgattggcaggctgaactgtacggtaccatcagccacaccaaccgtatcctgcacaacctgtgtgtggacgtgtggatgtacatctcccgtggcgtgttcgcgcaggtaccggtcaagggcgcgaccggttcctccaccatgccgcacaaggtcaatccgattcgtttcgagaacgccgaagccaatctggagatctcctgctcgctattggacactttgtcggcgacgctggtcgaatcgcgttggcagcgcgatctgaccgactccaccacgcagcgcaacatcggctccgcgctgggctattcgctgctggcgttgaacaatctgatgggtggtctgaactccatccatccgaacgatgttgccgtccaggccgagctcgattccaattgggaggtgctcggcgagccgatccagaccgccatgcgcgcctgcgagcttgcaggactgccgggtatggataagccgtacgagaaggtcaaggagctcatgcgcggtcacgagatctccaaggatgacgtcgaacggttcatcgaccagcaggccttcgacgaagccactgcggcgcgtctcaaggcgttgactccggcgacatacaccggagttgccagcaagctggttgacttcgaccgctgataacgcatcgccacactcatcttgcggatgatacgccttggggcggctgtgttttcacacagccgccccaaggcgtatcatcggagacgataataggtgcatgtcacccggacgtattcacccacgtacctataaagcaggtcaatagtgtctcacgacttcccaaccagcaaacacgaaacgcgcattgaggatgttccgccgaaacggaaccgcgatttcgcggatctgctccatgcgctgttcgccgtgcttgtcggcgcggccgtcatcctgttctccatctacttgcatggcaccacctccggagtggagtccgacgtgcgttccgcgggccacgtggtcagttggctcatggatgtgccgacatcgctgttgcagcagatcgccatagttttcattaccgtcagcgtgcttatccagctgctcatcgccaaggaatggctgcaaagtgtggtttccgccatcgcccttattctcggtttcgctgcgatatggggcatatccgctcttatcagcggctcgggcaatgacaccctcatcatgtccatgatgtccaacggcacttccgtgggaaccggactgcttcccgatttttatgcggcgatggcctcattccttaccgtcgccggaccgcgtcgcacccgttccggcaccaaatggggctggaacatcctctacacggtcgccgtgctgttcgtggtgctgtcatggaattcgctttccggcgtgctggtctcctttgccgcgggacgtgccttgggcatgctgatccgtttcatgctcggcacacagaccaacggagcttggggcaaccaggtggcgcaggcgctccgttccatcggcatcgacgtggcgtcgctctcccgcaggctcgcgacctacaccgattccggcatgctgaagaccacattggacgatgatctgaccgagaactcacgcatctacgacgccatcgacgtcgacggccaccaatacacggtatccgttctcgataaccaagtgcatatggcaggctatctcaaccagctatggcaatgggtcaggctgaccggggtctccatgcgccgtgaccgttcctccttcgacgccatccaccaccattacgcgatgattctcggcctgcagaacgccggattgacggtgccgggagtctacggagtcgcagacagcagcgaatcgtccattctggtgtttcaccgcgaccacatgcccttggaatgcaatccgaacaccatgtccgaccatgacatggaattgttcatgacctatctgtccgaagcgcaccggcacggcttcacccatcgtcgaatcactcccgaaacgttgtcgcgcatggaaaacggacagccggtgatcgcaggatggcagaatggcgactatggcagcgcgccgccaaactatgcgctggacaaagtacagctgctggttctgctcggcgcgctgaacggcatcgaccgtgcgatcgcatgcgcccgcaggacgtggggcgacgagcaactgatcgacctggcgccattcatccagaaggcggcggttccggcggcgatacgcgccctgcccgcctgcgacaagcacatgctcaacacgctgcgttcccgtatcgcggctttggctccgcaggaggtcgcggattccatggaaacggttacgctgtcgcggttcagtttccgttccttcatcgcgatcgcgctgctggtcgtcgccgtgtatgtggtgttcacccagattcaaccagccgaaatgatcaaggcggtcaaagaggccaacatcgccatggctctggtatgcgtgctgttcggactgctggcttggttcggatcggccatgacccttggctgtttcatggatgccgataaacgcaatccgatcggcttgtactgttcccaaatggcttcgggcttcaccgcggtctccatgcccgccggcgtcggcccggcctttgtcaacctgcagttcctgcgcaagagcggctaccgcaataccgcggccaccgccatcatgagcgccgtatgggcggtgcagggcggcaccaccatcattctgctgctgctgatcggcatcttcaccggacgcaacacactgtccggcatgattcccaccaacacgctgattttggtgatcaccatcgtcgcattggtgatttccgcggccatggccattcccccggtgcggcacatcgtcacggagaagtacctgcccatcgtcaagtcctacgcacgcagtctcgtcaacgtgttgtcccacccgaaggagctggccttcggcatcctcggcgcattggtgctcaacatctcgaccggattgggattctggattgcattgatggctttcggatgccacaccaatccggtggagaccacattcatcttcctgctggcgaatacgctcggttccgcagtgccgacaccaggcggccttggcgcggtcgaagccgcgttgtccgtggccttcaccgccgtgggcatcccctccaccatcgccgtctccgctactctcgtctaccgaatcgccttctattggctgagaattccaatgggagccgtggctatgaaatggctggacaggcataatttgatctagcccaaccccccgttagggttttttctccccctatgctgaatcaaaagggccaaaacccttggaaaatggcatttttggcacatgcgtgcgctattattgcaatgaacgtggatgttcataagcggaatatcccctgactcaagaaggatgctttatggcatacaacaagtctgatctcgtctcgaagatcgcccagaagtccaacctgaccaaggctcaggctgaggctgcggtgaacgctttccaggacgtgttcgtcgaggcaatgcagtccggcgaaggcctgaagctgaccggcctgttctccgccgagcgcgtcaagcgcgcagcccgcaccggccgcaacccgcgcaccggcgaaaccatcgagattccggcaacctacggcgttcgcatctctgccggctccctgctgaagaaggccgtcaccaagtaagtcgaccacgcagacctatatgagaggtttcaaccacggatggttggaacctctcttttttctttttataacaggcaaaggcaatgtcatcccacactatgcgctatgatactagacaatatgactagataaagggggatgtcatggtcgaccaacgcagacagatcatcgacgaaatccacaaactcaacatcctgctcatccacaccaagctcaaaacgacacgtgcccggaccgtggctcgcgccaccacacacgtgcggaacgtcgacgcggcaagacggggaacggttccacggcccaagccgtccaaacccatcgaagccgacgttcatatgctcgactgcctgaacgacgaggaactttccactctcggcgaactgctgcagcgtatcatcgacaacaccgataccaaacttctggatgaggagatttccgaacgccgcaaggcgatccacgaattcctcatgctgaaccatacggatgaggaggtgcgggaatgagcgtcgggcaggaacatgattccggtgcggacgatccggatctcatccgtctcaacaagcgttcgctattcacccccagcgcgtcagtggctgtggagcagcattcagccgtgccgcacgtgtcgcgaagcacctacggtacggcgaaggtcgaaggcagactcacctcccccaacgccagggttccggaaatcatcacgcagcgttgcggcggcatcaccgtcaaaggtcatacgctcaaatcgttcgcctataccaccgatgcggtcattatccgcaacacgaacgcgaacgccatcctcgcggtgtaccctttcaccggcgaaccggtgatcacgcaggcgctgctcaccgtggcgcagatgccgctgttcgtcggcgtgggtggaggcaccaccaccggtccgcgtgtggcagagctggccatggtggcggagatgcagggcgcggccggcgtggtcatcaacgcgccggcaccggcggaaaccatcgaaacgaccatgtcgatggtggacatccccgtcatcgccacggtcacggaggatgatgaaatcaccgaatgcaagattcttgccggtgcggccatcatcaatgtggcagccggtgcaagaaccgcgcaagtcgtggcaagcatccgcgcgcatcatccggaaatcccgattctggcttcgggcggaggtcgtgaagaccgtattctcgccaccattgatgcgggcgccgacgcgatcacgtggacgccgccaagcgcgcaacaactccagtcgcagatgatggccaaataccgtggagaagtctgagcggcagttacaatccgaccaaccaatatcaaaagcctgcggtggagacgagtcttccatcgcaggcttttggctactgcaaagcctctagtatcgtgaggaaccggtcggacggttgtgcgtcgaacggatcaagcaacgtcacgtccatcctgttcggcgaggtcagcgatagtcgcgtccaatcacaggaatattgcgcgttgtgcgatcgtgccgactggatgaaccgtccacgcagtgcggcgcgggtatcgtggggaggaacatcgatggcctcatgtgcttgtgactcgttgaccaacgtgcgcatggctccgcgacggcacagcgaggcgtacagcgcgccgttggccacgtcatggtagtccatgtccaactgttccaacttgctgacggagagtcggctccccgcacggttgcggagcatgtcgaacagccgtcgtttggcaagccaatcgaccttgtcggcgaacgtttcgctagcccccgagcggaacgcctctatgacacgcctccattggcgaatcacctcatgcacgtccgtgcgcggcaacgaggagcacacttcgggatgttgtccaacgaatcgttcgacgatttcaagataacgttcctgaatcgctacggcaccgccttccatgacagtgccgtctgccatgtcgaaggacgcttcgacgcccgtcaggtcacggcttaccttatggttggccgcactggcgtcagcgaaggagaatcgggcgaacccggaatccttgccttcgcgcccggcctgttcgatgacgcacaacaccagatgcgtggtggcgagcttcatcatcgtggcccactgggaccggttcgaatcgccgatgatcacatgcagccgtctgaacgcgtcaggatcggcatgcggttcgtcgcgcgtgttgaccatcggacgcgagcgcgtggtggccgatgagaccgcctcatcgaggaaatcggcacgctgcgtgatctggaagccctgctcccccatacgtcctgcgccggtgaacagctgccgggtgatcaggaacggcagcagctcctgttcgatcgtcttcaacggcacgaaccgtcgcaccaggtaattctcatggcagccgaaggaatgcccggcggaatccacattgtttttgaacacatggaccgtggagccggctccctggatggagcgcagacgacgttgggcgtccagggcaagatccctcatcaccaattcgccggccgcatccaatgccagcgcgtccatcggatcccgggcttccgccgtggcgtactcggggtgcgagccgacatcaaggtagagtcttgaaccgttttcaatatatgtgttggtggatctcgcttcggccacaatcggctggaacatcatcatcgccgtctgtccggcgtcgcatgggcggtccgaaccggtcacgctcacaccgtattcggtttcgatgccgaaaatacgggcgaaggattggatttcgtccttggtatgggcgtcaagcggcgctgtggaatggttgccgctgtcacgcagctgcggcatcactcgccgcctttttggacgaagctgcccacatattcctcggcgttggattcgaggaccgattcgatgtcgtccagcaccgcgtcaagcgcatcgaccgtgtcatcgatctgggtgccagcctgcgcaatggtctcatcctcgtcatgtttttgttcggcggattgcatctgctcaaatttctggggcatggtccttcctttctccgaaagcgtctttgcgggttctcctgcgaatagcatactgccccacaccttaacccaagtgtggggcagtcaatcagtcttatgccaaatactggcgcagatcatcggtaatcagaccgttggtggcgagtacgtcgttttcctgacgccagtggacaagatcgccgttccaccggctcagatgcccctgcgcttcccagaccacgacggctccggcggaaaccgcgggaacgtcccacttgtgcagatgcgcttcgaaatacgcgtcatatgtaccgtccgccaccttgcacaaatccaaggaggaggggccgacgcgcttgatgtcggccggacggccggagatacgcgacaccacttcaagcgcgcgcttggattcctccggcacatgggacatgccgaagctcaccaccgcatagtcaagggacggggtggtggacggcatgatcttctcgcgtttgtctccaagcggcgtcttgcggatgcggatggctccggatccgcgcaccgccaggtaggtcaggccaagcgccggagcatgcaccaccgaaaggatcggctgcgcggagcattggtcgttgaactcgaacagtgagacggtgatggtccattccggcatgctgcgcacgaaattgatcgcgccgtcgatgccgccaacgcaccaataccgttcccccggatggcattcttccggacggaactgccagaaaccatcgaacacatccacatacgtgatgcggttgctgatgaattgcgccaaccgcttatcgatgtcggaggtgaagctcagatgattgtccgttatttcaaaacttttcagatcacgcggattcatttgatcgttcaacgcgtgcttgcctgcatcctgcaggatacgggccacttcgagggccacttgcctcaattccatgtagtatgccttttcgtttcctcataaccggcttggacgcaccctctccctcaagcgtcctgccgtgtggttcatcgactatgggtatggcctctgccatcacctacggcaatggtacccgcacaacatgagattcaacgcagggattccacgattccgctcgcagtgtggacatgctcgaacgcttcggaacacaaggattccgtgaatttcaacggattggacatgtccaacgagaccatcgaattctccacgttttcatcaccggacgactcgccgcgcaccgtaaggtgggaccacgacgccgcaacgacctgttcggggaaacgtcgtatgatctccgcgcgcagccatgcgcgtgtgtcggccggcgcttggccgaccgcctcggcaagctgcttatccgtcaccagtcgttcggtctgtccggcaagccgggtgaaaatcgaatcggccggatcgagcgcggcccatttcagatcgaccgcggccaggcgccgatcggtccaatccgaaccggtcttgcggcgtagtttctccagcaactgccatttgagcagccattcgagacgtgacgcctgttcccgcatcgtcagtcgtccgtcatcgtcggcatggcgtacggtggcgacgtcggcgagagcctgcccccacatcgccatgatgttgcgggtggagcggtcgggccatgccggctctccggatgtgtcggtgccgtataccgttgccgcggccgcatataccagtccacgcaaagtgacctgcatctgccatgcggtggtggttccacctgtttccaatggtagtggggcggccagggtcaggtcgtgcgataccgtgtgcatggcttccaccgggtcggcgagcgtaagcggttccagcgcctcgttcaagtcgatttcggccatgtctgcgtgttcgagcagccacagcagcatgctggtggtgccgagtttcaaggcctgtggcacgtccatgcggttggcgtcgccgacgatcacgtgcagtctgcggtattcgtcggtgctgtgcgattcgtctctggtgttgatgatcggccggtcgaatgtggtctgcaaaccgactttcatatggaagtagtcggcacgttggcttagctggtagccggcgttttcgctatgttcgccgatgccgacgcggccggagccgatgaagatctgtcgggagacgaagtgcgtggtcatgaggcgtgtcaccaggtcgaacggtaccgaccgcagcatcatgtagttttcgtgcgtgccccagctggctcctttgccgtcgacgttgttgcggtgcagcacgattttccgtcccgtcgtctcgcttgccttggctgcggcggcgcgcatgatgagatcgccggcacggtcgtatcgcaccgcttcgaaggggtcggttgtttccggcgcggagtattcgggatgcgcgtggtcgacgtagatacgacccccgttaggggcgatcacgttggtgatgttgagctgtggggcgtcggtgagcaggtccgggtgggccgccgcacgttccagtctggtgccgcgcgcgtcgttgacggggtcttcctgccggtagtcccagcggatatggctgcgtgacgcatccgaggcggcgccaaccacgtcgaatgagagctgcaccggattgtagcggccttgtcctggcgcggagaccgcgtattccgtttccgtgcccatgaccctgcgaacgctcatcgcgccgttcctttccgtatttagatcgcgttccataccataccgtccagcattcatacgccggccggcattcatgccaccggtctgatgccggtcacccgtccgggttcaagcccgttgatgcggctccactgttccggatccgcatccagcagcgcgtcccgggtctcaccgtattcttcgtccacggctttggccagcagattgatgccgatcgccgcagcctgtccggtggtgatggacagtttcaccgcataggttttggcacggtccacgatgttcttgagcaccgcgccggacaccacgtcggcgaggtacaccggacgccactggccatggtcgtcgcagatgtcgcaaaggtgccgatgctcgtcctgcgcgtagatgtcgttgaccagcacgccgatcaacgccttcgcatccacgttcggagacaacggcagcttgtctgtcagatagtggcggacgatctgggtcgcctgctggatgcccggacggtccacgcggatcttcacgtcgaggcgtccggggcgcaacaccgccggatcgatcatgtcgatgcggttggaggctccgatcaccatgacgttgtccagcgattccacaccgtccagctcggtcaggaactgcggcacgatggtggtctccacgtcggacgaaacgcccgtgccgcgggtgcgcagcagcgaatccatctcgtcgatgaacacgatgaccggtttgccgtcggccgctcgttcgcgggcgcgtttgaagatcatgcggatcagacgttccgattcgcccacgaatttgttaagcagctccggtcctttgaccgacaggaacacgccacttcccgcgtcggtgccttcggcgagcgcgttcgccacggctttggcgatcagtgtcttgccgttgcctggaggaccgtacagcagcacgcctttcggcggtttcaggtcgtagcgttcgaacagttcgcgatgctggaacggcatctgcacggcgtcgcggatacgttctatctgctcgtccagtccgccgatgtcggcgaaggtgacgtccggcacttcttccagaaccaaatcgtcgtcgttttcggggggaaccaacgaaagcgcgaaccgcagagatgcgtcgacgttcacgcgatcgcccgcgctgatggcctgtttggcaagcgttcccgagcatcggaccaacgtcacgttgccgccgccatccgcgaccagcaggcggccgtcatcgcacacctgccgtaccgagcgcaccgcgcccagcgtgtcggtgtcgagctgtgagaccaccaccatgttctcgttgagcagcacggtacgtcccggttcgagcctggaagcttgcagattcgccgcgatcggcacgatcatgcgtctcgcgccggcagccacttcggcgctggcatgctgcacgccctgctcgtccgttttggctgaatgcacgcggaccatggtggcgaaagtcatgggaggccccgccagctggttcaattgggccttggttttcgtcatttcctgcgtggcgcggctcaacgccttgaccagcgcatggttcttggccatgagctggtcgttggcctgctgcagcgacgcgagcgtctcttcgtcatgatcgttcatgtcgacctcgctttccaacacgttcaaccctcaagaatacccattgtcctaatgatttccgacaatcggaaccatgcttgaacaagaaacgccgaacatcgcatccatggcatccctgcccacgctgtccgctcccggactgctggtgatggatgtggattccacgttgatcgacgaagaggtcatcgacgagctcggcgtggccgcgggagtcggcgagcagatagcgtccgtcaccgctcgagccatgaacggcgagcttgatttccgcgaggcgctgcgcgcacgcgtggcgttattgaagggtctgccgaccacgattttcgatgaggtctaccatcgcgtgcatttcacgcatggcgcgcttgaactgattgacacgcttcacgcgcatgattggaaggtcggcgtggtctccggtggttttcacgaggttgtggaccgtctcgcggccgatgcgcatctcgattattggattgcgaaccgtttggaggctgccgatggcaggctgacgggacacgtgctgggcgatatcgtcacgaaggatacgaagctggaatcgttgcgcgcgtgggccgcgcggatgggcatcgatatggcgcagaccgttgcggttggcgacggcgcgaacgatctgccgatgattcatgcggccggtcttggcgtggcgttctgcgccaaaccgaaagtgcaggaggatgctccgcaccggctcaatgaacgtgatctggcgaaaatcctcgattatctcaaataacttttccgcacctacgagcgaccggtgggcggcatgcgttgtaagaccgtaaagacttggcctgagcggcccggagcgtgtcgtcaatgcatgccgcccgccggtcgcggacgccgcagctactcacatacttacagtagaaacaaaaatcttactcgcagaaggcgttatcgaggtgggcgccacgggcccagtcggcggcgcgcatggctttcttgccttgcgctttaacttccagcagctcgagcggctcggtggaggtgccgacccacacgttcttcttgccggccacgatatggccgggttcaagcgatgccggtgcgttcggattggacatgtcggccggctgcgcgcgcaatacgtgcagggtcgccggttcggcgtccgcatgggcatgcagttcgcaccaggctcccggattcggcgtgcatgcgcgaatctggcggtcggcggcgaataccggcacgtcgaagcggatatgcgcgtcttcaacggtgatcttctgagccacctcatatgcgccggcaggctgttccaccggtgcgatctgatcgttggccatggcctgcaacgatgccgcaagcaggcgtgatccatcttcagcaagacggctcagaagctcgccggcggtttcgtgcgcgccgatttccacggtggattgcgccagaatcggaccggcatccatggcgcgcacaatgcggaaaaccgtggcaccagtcaccttttcgccggcccagatggaacgttgcaccggagcggcgccacgccattggggcagcagggagaaatgcaggttgtaccagcccatcggcagcgcgtcgagcacgtcctgtttcaggatcttgccgtacgccaccacagcggcggcctgtgcgccggtggccgcaagctcggacacgaacgtttcctcgctcggatcggattcgatgaccggcagaccgagttcgagcgcggcctgcttgactggattcgccaccagtttgcgacctcgtccggttggcgcgtccggcctggtgagcacggccaccacttcgaaatgctcggtatcctgggccaatagtttcaacgacggcaccgccacatccggcgtacctgcgaacagcactttcaacatgagacgaatctcctcaccttcatatccatcaatgcatgcgaccgtatgcgtcgatcccgcatagcgaccgcaagcacaaccgtctgtctaatctgcgtatgtcgttatttttcatgtaccgcgggaatcgccacgcccgcgtcgatcagcagggtgcgcaacgcgcgggcatccttgaaccgtacgccgcgaatgccggcttcgttcgcgccgacgatgttcatcgccttgtcatccacgaacagcgcgccggaagcgtcgatgccgaactgttttagagcgtaatcgtaaatatcgcggtgcggtttgcgcagtcccacgtaaccggacaccacgcggtcctcaagactgcacagaatgtcgtaatggtcgagcgccaccgggaacaggtccttctgccagttgctcaagccccatacgtggacgccggctgctttcagatcgttgatgagcacgcgcgcgcctggcaccacgccggtcagcgaatcgacgaaattgtccagatagtaccgcatcatatcggcccactggtctccgtggcgttcacgcatcagagccacgccatcgtcattggacatgccggcgtccagttcgttgttgatgtcgtagaagccggaaacgtcattgtcgaggaactgttccaccagtccgtccgagtaccgtggggtcatcaccgccgccggatcccaatagataagcacgttgccgaaatcgaagatcacgtcggtgatctgccggccggcgttcgcagcggcgttgccgtcggccataagcacgtcatattccatttgcggctctcccggccagcctttcatgcgtttctccattcctaacgtcaacgtcatcagtcgttccagtgtttcacgttgaggggacgtgcgtcagatgcgttccttcggatccatctggaatcgcagttccccaggttcgcgtgaagccacgtggcgggcgcttgccgaacgcagccgcaacgccaattcggcacgtctgccctgtgggacgcgcacgactgctttgaccctgtccgcggtgccttccaattcacgtgaatcgatggtgcgtggctgcggaatcggcaccggccccaagacggacggcatcgtaccggcaatcgtgtcgatggtggccatgtcgccgccggccaacgcgccgattcgtttcaacatcgtcccaaccgcatctcgtcggccccacacgcaggccgcggcgaataccggcggcagcgcggtctgggcgcggtcctccacttcgacttgggcaagcatcggcgaattccacagcatcaacgatcgtgcgagcacgggatctgtttccccgatcagcagcgcctgtcctccacgggtccgcggcgcgcacagcgacaccgcgcgcatccatccggtcaacgtgtccacatcggcgtcgatgccggacgcatacaaactggtccacgcgtcgaggatggccacggcacggtattcgcattgtgccggactctccccgcgcacacgcggctccgcgccgggcgtggcgatgaccagttgcggagcgaatccgatatcggacacgacgcctcttggctggcttggcgtggacagcaccatcggcacgccacggaacagtctggccagttccatcgcggttccggcggcgccgaccctgaccacgcgcatgcgctcgttatggcatgtcgggcatgaccattgcacggtggcggcgccgcaccagcggcatcgaatcgttccgtccgccaaccgttccaatggtcccgtgcaacgcgcgcatcgcacttggcggtggcatttcgagcagcttaacgcttcggtgatgccgtcctgcggtatggacagcagcaccggaccggtttccaaagctttggacagtatccggaccgcggtgtgtggcacgcgtgcgccgatggtcggatcggcgagtcgtgccagctcgtcgcgattgagccagcgaatccatggagacgcttccttggtcacggccggcaacgcgtgtatgggcgtgctgaagccgctcacctgcgtgtctccgacgtgcgccgcgtcggtttcccattggctttgcgcgctgcgcgcattggccatcgcgacgaacacgccgttatgcgatttcgcgcggagccgaagcacaccgcgcgcgttggcgtacggcatcatgccgtcggcgtcctggtagcacacgtcatcaaggatgaggaacagcgcgttgccttccaccggcgcgtacatggcggcgcgcgtgcccagcacgcaacgcacttgtccgcagctgatcgcgagatatgcccggtaacggtcggctggcgccatctgcgcgttgagcaccgcgaaatcgccgtcatagacgccgttcgcggccccggtcggagcgaatggtttcaagccgaccgaccgtagggtctcagtcatgtcggcgatctcccgcatggtcggcagcaccagcaccgccggcttgttctgagcgagcgccgcggccaccatccatgccgcgcagcgccgccaatggtcggcaccgggtagcaggtcgaagacgaacgattggaaacgtctgccttgcagcgcgtcatgcagcagattgatgttgccgtattgacgttgcaactggccgtatatctcctggtcgacggcggcgagccgttgtttgcccgccgcggttcctgcggcatcgcgattgccgacgcgcagctggctttcgacttttgccacgcgcggcggcactgccaggcggaggatattggcgcgcgtgccgccgaacgcgtccgcgatgcgcgtcatatcgtcgcgcatggattcgggaacgagcacacggtcggtgaccacacgttcgatgtaacgtatcgatgattcgggtgtggcgctggtatcggcgcgtttccatatgatgccgttgacccgctgcccgccgaagcggacgcgcaccatcacgccgggttgggcggccgcagagtatttttcctcgacgaaatagtcgaaggtctgtcccagatgcgtggcctggatgtccagcaccacttgggctatgggatgttcggcggctggcgttttgacggcgggcgcgcgtttgcgccgcttgcgcggggcaagcccgtcaagcgccagctgctcggcatcctcattggtcataatgcaagggtaacgcatgcgccgacgcctgtttcatcgtaggacgtcggccgcgttttcaagccttgatggcctccttgagttcgtcgaccatgttggtggcttcccaagtgaagtcggcatcctcgcgaccgaaatggccgtaggccgcggtcttggagtagatcggacgcttcaggtcaagctcgtcgatgatggcggcgggacgcaggtcgaacaccttgcgcaccgcctgctggatctgctcgcgggtcacaccgatctcggtgccgtaggtctccacgttgatggacaccggatcggccacgccgatggcgtaggcgacctgcacctcgaccttgtgggcaaggccggcggccacgatgttcttggccacccagcgtgccgcataggccgcggaacgatccaccttgctcggatccttgccggagaacgcgccgccgccatggtgggcagcgccgccgtaggtgtcgacgatgatcttgcggccggtcagaccggcgtcggctgccggaccgccgaggatgaacgagccggtcggattcaccagcacgcggtattcgtcgtgggccacacggtcggcgagcacgtcatccagcaccggacggatcacatgttcggtgagctgttccttaagccatgtctggtccacttccgggtcgtgctgggtggagaccagcacggtgtcgagacgcacgggatggtcatcgtcgtcgtattcgatggtcacctgcgtcttgccatccggacgaagatgcggcacctcgccgctcttgcgcacttcggcgagacgatacgccagacggtgcgccagatgaatcggcaacggcataagcacgtcggtctcgtcgcacgcatagccgaacatcacgccttggtcgcccgcgccttgcgcctcataccgctgttcacgggacgccttcgactcctcctcgccactcaaccgggcaacgccctggttgatttccggactttgctcggtaagcgacaccgtcacaccgcaggaatcggcgtcaagtcccacgcgggagctggtgtagccgatattgcgcaccacggagcgcacgatgttctggatgtcggaatagccttcgctggtcacctcaccgaacacgaagaactgtccgaccgtggcgcaggtctccacggcgacatgggaatgcggatcctgcgcgagcatatcgtcgagaatcgcatcagaaatctggtcgcagaccttatccggatggccctccgtcaccgactcggcggaaatcaacttcaattcagccatacggctgctcctttcgcgaacacccaaccgttcgcatcctgtgatcgcccacgaaaaacgccccgtccttcacagacgcaatcaatagttaattgttgactattcaaagcgcaccgctcaggtatcggggcgaatggaaaatgatgccagtccctctatgggaaccgtgtagatcagttgccttcggtcagatcgtcctcaccaagggtttcctcaagcagaccactgttgatctcgcggaacgcgatggacagcggcttctcctgattctggtattccaccagcgggccgacgttctgcagcagaccctcattgagctgggtgaaataggaattgatctggcgggcacgcttggccgcgaaaatggccagagcgtacttggagtccgcatgctccatcaaatcgtcgatcggcggatccgcaagaccggtcggggttggctcagtgccgaatgccatagtgattatctccaaatcatcagataagccaaaagcttcttttccaaaatcattagtataggcaatccactggacctcaaccttgcctctcccacaggccttctccaccagcgtagttatccaacctgtaagggaatcacacggttttccgaaaatttccacatagtgactcttgacaaaacacgtgtcccgtttagccagcacaataggaggcatggaaatgcgatctgcaaaactaatgaatggacgagtattcgcgggcgctcgcgccctctaccgcgccgccggtgtggatggcaaggatttcggcaagccgatcatcgccatcgccaattccttcgacgagttcctgccgggacatgtgcacctgaacaaagtgggccgtctgatttccgatgccatcaaggaagccggcggcattccgcgcgagttcaacacgatggccgttgatgacggcatcgccatgggccacaccggcatgctgtactccctgccgagccgcgacatcatcgccgataccgtggaatatcaggtgaacgcgcactgcgccgacgcgctgatctgcatcccgaactgcgacaaggtcgtgccgggcatgctgatggccgcgctgcgactcaacattccgaccgtgttcgtttccggcggtccgatggaggccggcaccaccgtgctgcccgacggcaccgtgaagaagaacaccgatctgatcgacgtgatgtacgcctccgccgatgacaatctgaacgaagaggatctgctcgcctacgagaagaccgtctgcccgacctgcggttcctgcgccggcatgttcaccgccaactccatgaactgcctgaccgaggccatcggtctggctctgccgggcaacggcaccattctggcctcccattcctaccgcaaggacctgttcaagcgcgccgccgagcaggtggtgaagatcgccaagcagtattacgacgatgacgacgattccgtgctgccgcgttccatcgccaccaagaaggctttcgagaacgccatgaccatggatgtggccatgggcggttccaccaacaccgtgctgcatatcctcgccatggcgcagtccgccgacgtggacttcacactggatgacatcgagcgtatctcccacaccgtgccgtgcatctgcaaggcgtcgccgtccggcgaatgggagatttccgatgtgcaccgcgccggcggcatcaccggcatcctcggcgagcttgaccgtgccggcaagctgcaccgcgacgtgcattccattgattacaagtcgttggaagacaagcttaacgactgggacatcatgcgcgacacctgcaccgaggaagccaagcagatgtatctggccgctccgggccacatcgtctcccccgaaccgtggacgcacaccacgctgttcgattcgctcgatcgtgaccgtgtcaacggcgccatccacgatatcgaccatccggcggtcaccgaaggcggtctggccgtgctgcgcggcaacctcgcgcctgacggctgcgtggtgaagaccgcaggcgtgccgaaggagatctggacgttccgcggaccggcgctggtcgtcgaatcccaggagcaggccatcgaggtcatcctcaacgacacgttgaagccgggcatggctctggtcatccgttacgaaggcccgaagggcggtccgggcatgcaggagatgctgtacccgacctccttcgtgaagggcaagggcatcggcaagcaggtggccatgctcaccgacggccgctattccggaggttcttccggtctggcgatcggacacatcgcgcctgaggccgcgaacaagggcccgatcgctctgatcaagaacggcgacatcatcaacatcgacattccgaaccgtacggtgaacgtcgagctttccgacgaggagctgactcagcgccgcgccgagctggaggccggcgatggctatgtcgcccatcgtgatcgcaaggtttctcaggcgctgaaggcttatgccgccttcgcccgctccgctgacaagggagcgacccgtgatccggagctgatcgacaagctgtccggtctcgcctgattcaaacatacggaaagggcctgcgcgaaatcgtgcaggcccttttcgtatgccggtttttattggctggatagtcggattgacggattacaggccgaactcttcggcgatgatatgccaaagctcgtctgcggcctcgtcgaccacgttattgacgatgcgtttgtcgaattccggcgcagcggccaactcgaccttggcggtctcaagccttttggcctgctgctgaggggtttcggtgccacggccgatcagacgacgtttcagttcttcgaaggacggcggctcaatgaacacggtaagcacttcgaggccgagttccttcgcgcgccgtttgaccgtccgggctccctgtaggtcgatttccaagaccacggggatattgcgttccagatgttccacgactggtttcacgggtgtgccgtagtgggcgaggccgaacacgtcggcggtttcgagaaactcccccgccttttctttggccaggaattcaggttcggtcatgaagaaatagttcacgccgtccacttcgcccggacgaggctggcgtgtcgtggcggacaccgacagccagatttcggggtgctgttcgcgtacgcgccccagaacagtgcctttgcccactccggcgggtccgcagagcacaatcaaacgtccatgttgagaatcagccattccatccccactcttggttatgtcttgttttccaaaaaggaagctattcagaaaaagaatttattcggcgtctccgtcagccgcatcatcggcgctttcgttttgagcctcggtcaatgcctgccgaatatccccggcgaccgacgcggtggcttcggtcaattttgcgatgtcgggaccgtgcgtggcgatggaacgagataccgtaaccagcacattgcccttggtgcctttgaacacggtcttcagatcgcgtgtctccgctccctgccatccgtagcctggggaaagaatcggtccggtgaacttggccgggtcgacgcccgaatcgttgatccactgcccgatggtggcgccgatgataaggccgacggaacccattccatcattgcccttattgaatttctgagcagtgctggcgatgccgtacgccactgttttgcccttgtattcgcctgcctgacgaatcgccgtctgcaggctggcgccttcctggttggacgtcaacgatgcgatgaacacgcccctgccgttgttgagcgcgtcattgatgacgcctcccaatgaccgtgcgccgtaatacggcagcagggtgatggcgtctgccagcaatggcgcgcccggcttgaaataggcgtccgcgaacgcggaaatcgtggtcggcaggccgccatgcaggcagtcgacgatggtgatgacacccatctgccgtgccgcatagagcacgcgttcaagcgcggcgatgcctttggaaccgtaccgttcgaacatggagaactggaatttgacagctgcggcacggccattggccgcctgcagcatacgcatggaatacagttccgcacccaacgcgtcgacgttatagccccagtcagtgaggagctgccgatgcgggtcgatgccgacgcacaacgggccgtatttggccattgaattgctcagtcgcagaccgaaatccgaacgctgggcattcacttcctcactgctggggctactcatcattagtcacggctttccaattcgaacagctgcgtggaatgatcctgaatactcatgatctgataatcattattgcgcaccgcctcgatagccatcaacacggcggagaattccgtcatggtggtgaactgcggcaggtcggctgcgatagccgccgaacggatggcgtagccgtcggaacgggaaccgcgggagttcggcgtgttgagaatcaggtcgatcgcgccttcctcgatcagctggacgacgttcttgccgacgctgccctccgcatggtaggtggtgatcgggtcgtctggatcggagtccatacgcacgctgatcttgtcgacgatcttggaatcgatgccgtagcggcgcagcacggatgccgtgccttcggtggcccagatgttgaagccgagctcgaccagtcgcgcggcgaacagcggcagctggcgcttgtcggtgtcgttcacggagatgaacacgttgccgctggtcggcaggccgccttcgtatgcggcgagctggctcttggcgaacgcgtgcgggaagtcgcggtcgaagcccatgacctcgccggtggaacgcatttccggtccgagcagcacgtcgacggtcttgccgagcggagtgcggaatcgcttgaacggaagcacggattccttgacggccacctgctggccacgatggatgtcgccaccgtcgccgtggggcaggagcaggccgttgtcacgctgctgctggatggtttcgccgaccatgatgcgggcggcggccttggccagtgccacaccggtggccttggaagcgaacggcacggtacgggaggcacgcggattggcctcgatgacgtacagagtgttggccatgaaggcatactgcacgttgatcaggccctgcacgccacagcccttggcaatggcgtaggtgccttcacgcagacgacggatctggtcatcggacagcgtgctcggaggcagggtgcaggcggcgtcaccggaatggacgccagcttcctcgacgtgctccatgatgccgccgatatacagctcctcgccgtcgaacagcgcgtcgacgtcgatttccacggcatcctgcaggaacttgtcgatgagcagcggcgaaggcagacggccggacacgacggtgtcggcctgggcttccttcaatgcgcgatcgacgtacttgcgcaattgggcgtcgtcgtagacaatttccatgccacggccgccgagcacgtagctcggacggaccagcaccgggtatccgatggcgtgcgcggcctcgcgggcctcgtccaggctcagcgcggtgccgtagcgcggcgcgttcatgtcggccttcttcagcacctcgccgaagagctcacggttttcggccagatcaatggattcaggcgtggtgccgagaatcggaacgcctgcggccttcagtcgggcggccagggacagcggggtctggccgccgagctggacgatgacgcccttgatcggacccatcttcttttcggcctcgtagatctcgagcacgtcttcgaaggtgagcggctcgaaatacaggcggtcggacatgtcgtaatcggtcgacacggtctccgggttgcagttaaccatgatcgtgtcatagttcttgcccagttcctgcacggcgtgcacacaggtgtagtcgaactcaatgccttggccgatgcggttcggaccggagccgaggatgatcacggcctcgcggtcgcgaggacgcagctcggtctcatccgcgtagcaggagtagtagtacggggttgccgcgtcgaattcggcggcgcaagtgtcgacggtcttgaacaccgggcggaggtcgtacgaccaacgcagctcacggatggtgttctcgccctcgtctcccagacggcgcaggtgcgcgatctgcaggtcggacaggccggcgagcttcgccttcttcagcagcttcctggtgagcttctccgcgttcttgacttccagcgcagtctcgttgatgagcgcgaactggcggatgaaccacgggtcgatcttggtggccgcgaagatctgctcttcggtggcgcctccccacagggcacgctgaatctgcagataacggtgctcggtcggcaccttgatggcgtcgagcagctgggaaacctcgtcctcggacggcttgtcaccatcccagttgaagcccatgtgacgcttgtcgatggagcgcatagccttaccaagcgactcctggaagttgcccgcgagagccatggcctcgccgacggacttcatggaggtggtcagcgtcggatcggcgcccgggaacttctcgaacgcgaaacgcggcaccttggtgaccacgtagtcgatggtcggctcgaagctggccggcgtggactgggtgatgtcgttctggatctcgtccagcgtgtagccgagggccagcttggtggcgatcttggcgatcgggaagcctgtggccttggaagccaacgcggaggaacgggacacgcgcgggttcatctcgatgacgatgatacggccggtgtccgggttgacggcgaactggatgttgcagccgccggtgtcgacgcccacgccacggatgatggcgatgccgatgtcacgcagcttctggtattcgcggtcggtcagggtgaagaccggtgccacggtgatggagtcgccggtgtgcacgccgaccgggtcgacgttttcgatcgggcagacgaccacgacattgtccttcttgtcgcgcatcagctcgagttcgtattccttccagccttcgatgccttcctcgatcagcacctcgtcggtcggggaatagtggatgccggcgccggcgatgcggtgcagctcgtcttcgtcgtgcgcgatgccggagccgagaccacccatggtgaagctcggacggaccaccagcgggtagccgaacttctcggcgatcttgtcgacttcctcaagggaatgcgcgatgtcggagcgggcggattcggcgccggcctcctccacgaccttcttgaagagttcgcggtcctcgccacgatcgatggcgtcaagggacgcgccgatcagctcgacgttgtacttcttgagcacgcccgcctcgcccagcgccatggccgcgttcagcgcggtctgtccgcccagcgtcggcagcaacgcgtcaggacgttccttggcgatgatctgctcgaggatcggggtggagatcggctcgatgtaggtggcgtcggccatttccggatcggtcatgatggtggccgggttggaattgaccagaatgaccctaatgccctcttcgcgcagcacgcggcaggcctgggtgcccgaataatcgaattccgcggcctggccgatcacgatcggaccggagccgatgaccatcacggacttgatgtctgtgcgcttaggcattgcgggttccctccttgacggaacgcatgagatcaacgaaacgatcgaacaggtatgcggcatcgtgcgggccggcggcggcttccgggtgatattgcacggagaacgccgggatatcgacgcactgcaggccttcgaccacgttatcgttcaaatcgatatggctgacgaacaccttgccgtatttgccgttctcgaatggcgcgtcgacggtttcgccgattggcgcatccacggcgaagccatggttgtgcgcggtgatttcgattttgccggtggtcatatccttgaccggctggttgatgccgcggtggccgaatttgagcttgtacgtgccgaagccgagcgcgcggcccagcagctggttgccgaagcagatgccgaagaacggatatccggcgtcgagcacctgacgcagcagattcacttcaggatcggcctgttccgggtcgcccggaccgttggagaaaaagacgccgtcgggattaagggactggagctcgtcgaaggtgatggtggacggcaccacatgcacgcggcagccgcgttcggccatgcgatgcggggtcatggacttgatgcccagatcgacggccgccacggtgaacagcggttccttgccttcgaattcgccgcagggttcgatggtataggcttccttggtgctgacctcgtcgtagaggctcatgcccttcatctgcggagtggccttgacctcgtcgagcatggagtcgatggtgcgcagtttgccgtgaccgtcgagcagcgcgtcgcctgagaagatggccgcacgcatcacaccggcggaacgcaggtggcgtaccagcttgcgcgtgtcgatatggctgatgccgacgatgtggttggattcgagatcgtcgtcaaggctgccggtggcgcgccagttgctcacattcgggctgggatcgcgcaccacatagcctgcgacccagattctggaggattccggatcctccccgttgattcccgtgtccccgatgtgcgggaacgtctgtaccacgatctgacggtcgtagctgggatcggtaagcgtttcctggtagccggtcatgccggtcgcgaaaacgatctccccgctggtcgtgccgatcgcgccgtatggctcgcccacatacacctgtccgtcttcgagaacaagaacggcatcctgagggtcaaacatcacggcttcggaatcatactggttcaccaaaacccccttatagtcaaggtattcgtaccaaggatagcggccggttaggactcgcgacccggccgaatcgcttaactttcggctttattcagccgaaggttcggtcggttgttcggccacttcagtggcttccgcatcggcgctcaccgcgctgagcagaccatggatgaacgccggcgaatcgtcgtcgcacagcgttttggcaaggctcaacgcctcatcgatggccaccatgttgggaacatcatcgttgaacatgatctcccatgcggcgatgcgcaggatattgcggtcgacgacgcccatgcgcttgaccttccaaccggtggaatgttcgtcaagcatggcgtcgatggcggcgatatgctccgccacgccacggacgatttcgatggcgtagtcgggcagcggggtctgagcgccgggctgctcgatgcgctcagcaagaagggacaggatgtcctgtcccttctcatccgcttcatacaacgtgttcagagccctcttgcgagcggtggaacgtgccatgaaacttcgctgtccttactctcagttctcgcggccgaggtaggagccgtcggtggtgttcaccttgaccttctcgccttcgccgatgaacagcggcacctggatctcggcgccggtttcgacggtggccggcttggtgccggcgttggaacggttgccctgcaggcccggctcggtgtgggtgacggtcaggacgacggaagccggcagctcgacggacagcggggtgccgtcgtggaaggacacgacgcagtcggtgccttcgagcaggaacttggcctggtcgccgaccagggtcttcggaatgaagatctggtcgtaggtggtcatgtccatgaagacgaagttgtcgccgtcttcataggagtactggaggttgcggttgtcgacggtttcgaattccatcttcatgcccgcgttgaaggtcttgtcgacgatcttgccggaaagcacgttcttgatggtggtgcgcacgaaggcggggcccttgcccggcttgacgtgctggaacttgatgacggtccacagctggccatcgaggttcagaacagaaccgttcttgatgtcattggtagtctgtgccaaattaactcacctatttcttcatctgacggaaaagcttacaaaaagccttgctcattatgccacggcgtgcatactttggagcgttgcccttccatatataaagaaacctccctcggattctcatccttgggaggtttctttaaaacgctagttcaagcgtgtcttgatgtcgggtagaaactactcgatgatcttggtgacacggcccgagccgacggtgtggccgccttcacgcactgcgaaggtcaggccctcttccatagcgatcggctggatcagctcaacgccgaaggtagcgtgatcgcccggctgcaccatctcaacgccttccggcagggtgatgacgccggtgacgtcggtggtacggaagtagaactgcggacggtagttggagaagaacggcgagtgacggccgccttcgtccttggtcagcacgtagacttcgccctcgaacttggtgtgcggggtcacggagcccggagcagccagaacctggccacgctcgacctggtcacggttgatgccgcggagcagcagaccggtgttgtcgccagcctcgcactcgtccatctgcttgtggaaggtctcgatggaggtgacggtggtggtctgggtcggacggatgccgacgatctcgacgttggagttgaccgggagcttaccacgctcgacacggccggtcaccacggtgccacggccggagatggtgaagacatcttcgatcggcatcaggaacggcttgtccagatcgtggaccggggtcgggatgtagtcatcgacggcgtccatgagcttcttgatctgctcaacccacttctcgtggtccggagcgtcatcgtgcagtgcgccgtaagcggacacgtggatgaccgggcaatcgcgatcgaagccgttttcgtcgaggaggtcacggacctcttcctcaacgagctcgatgagctcgtcgtcgtcgaccatatcgcacttgttcagagcgacgaggatcttcgggacgcccacctgacgagcgagcagcacgtgctcgcgggtctgagccatcgggccgtcggtggcggccacaacgaggatggcgccatccatctgagcggcgccggtgatcatgttcttcacgaagtcagcgtggcccgggcagtcgacgtgagcgtagtgacgcttctcggtctggtactcgatgtgggcgatgttgatggtgataccgcgggcggcctcttccggagcggaatcgatctggttgaagtcgtactccgggttgacatccgggtactcctcgtgcagcaccttggagatggctgcagtcagggtggtcttgccgtgatcgacgtggccgatggtaccaatgttaacgtgcggcttagtacgctcgtacttttcctttgccatgtgtttgtcctcctggacgtctcgtagtaagccttgaactcacttcaaggcactcgctacattttactgggtttgacgggtttgtgccactttggagcccgaacccagtcagcgctacaaaatactagcgctgactggagacagtttccacttcagtggcagcgcgtgtcactcgccgcgctgggccttgatgatctcctcggagacgttcttcggaacctcagcgtaggagtccatctgcatggtgaacattgcgcggccctgggtcttggagcgaagatcgccgatgtagccgaacatctcggacagcgggaccttggcgtcgatgaccttgacaccggtggagtcggtcatggactggatggaaccacgacgtgcgttgatgtcgcccatcacatcgcccatgtactcttccggagtacgcacttccacggccatgatcggctcgaggatgaccggcttggccttcggggcagcttccttgaagcacatggaacctgcgatcttgaaggccatttcggaggaatcgacgtcgtggacctggccgtcggtgacggtagccttgacgccaaccaccgggaagccggcgaggatgccggattccatggcttcctgcacgccagcatcgatggaaggaatgaattccttggtgatgtggccgccggtgacttcgttgacgaactcgtaggtctcgccgttctcggtgtcgagcggctcgaagttcatcaggacctttgcgaactggccggaaccaccggtctgcttcttgtgcgtgtattcctggttcatgacggccttgcggatcgtctcgcggtatgcaacctgcgggttaccgacgttgcactccaccttgaattcacgacgcatacggtcgacgatgatgtcgagctgcagctcgcccatgccggagatcagggtctggccggactcttcgtcggtcttcacctggaaggtcggatcctcgtcggacagcttcgccagagcgatgctcatcttctcctggtcggccttggtcttcggctccacggccacctcgatcacaggatccgggaaggtcatggattcgagggagatcggggacttctcgtcgcacagggtatcaccggtggtgacgttcttcagacccacgaaggtgtagatgttgccggcttcggcggcatccaccgggttctccttgtcggcgtgcatctggaagatcttgccgacgcgttccttcttctccttggtggagtcgaggacggtgtcgcccggcttgacggaaccggagtacacgcgcacgaacacgagcttgccgtagaacgggtgggtggagatcttgaagaccagtgcggagaacggatcatcggtggtcggcttgcggtcgatctcgatggactcgtcctgcgggtcgaagccgacgatggacggaacgtcctccgggctcggcaggtagtcgacgacggcgtccagcatcggctgcacacccttgtccttgaaggcggagccgcagagcaccgggtaggcctcacggttgatggtgagcttgcggatgccggcgcggatctcgtcctcggtcagttcgccggactcgaggtacttctcaagcagctcctcgtcggactcggcgacctggtcgagcagctcggaacgatactgctcagccttgtcctgcaggtcggccgggatgtcggtggtgtcgtagtgggcacccagatcgccggaaacgtcgttccagacgtaggccttcatgcggataaggtcgacgacgccggcgaagtcgttctcagcgccgatcggcagctggacgaccagcggggtcgcgcccagcttggtcttgatggtgtcgacggagtagtagaagtcagcgccgagcttatccatcttgttgatgaagcagatacgcggaacgccgtacttgtcagcctgacgccacacggtctcggactgcggctccacgccttccttgccatcgaacacggcgacagcaccatcgagcacacgcagggagcgctccacctcggccgtgaagtccacgtggccaggggtatcgatgatgttgatctggaacttctgcttctcgtcatgggtctgacggttccagaagcaggtggtagcagcggactgaatggtgatgccgcgctcctgctcctgagccatgaagtccatcgtcgaggcgccatcgtgggtctcgccgatcttgtagttcttaccggtgtagaacagaatacgctcggtggtagtggtcttaccggcatcgatgtgagccatgatgccgatgttacggatctggttgagatcattgagcacgtctagtgccatgattgttccttaactctcgttctcgactaattaccagcggtaatgagcgaaggccttgttggcctctgccatcttatgagtatcctcgcggcgcttgacagaagcaccgaggccgttggaggcatcgaggatttcgttggccagacgctcagccatggtcttctcgcgacgggcgcgggagaagtcggtgagccagcgcagagacagcgtgttggcgcggcccggcttcacttcgaccgggacctggtaggtagcgccaccgacacggcgggagcgaacctcgagggacggacggatgttgtccagagcgcgcttgagaacggcgaccggctcctggtcggtcttctccttgaccatgtcgagagcgctgtagacgatgtcctcggcgattgacttcttgccgtcaagcagaatcttgttgatgagctgtgccacaacggtggaaccgtagatcggatccggcagcagctgatgcttcttggaaggtcctttacgtgacatatctcttacttcgccttctttgctccgtacagggaacgaccctgcttgcgatccttcacaccctgggtatcgagggcgccacgaacgatgtggtaacgaacacccggcagatccttgacacggccgccgcgaacgagcacgatggagtgctcctgcaggttgtggccttcgcccgggatgtatgcggtgacttccacaccggagctcaggcgcacacgggcgaccttacgcagtgccgagttcggcttcttcggggtggtggtgtaaacacgggtgcacacgccacgacgcagcgggcttcccttcagtgccaaagtcttggacttcttcggctttgcctgacgtcccttacggacgagctgttcaatagtaggcaacttgaattctccgattcagtggtttctcttgttttcgtgtgaccgccgcactgcacccacactccacgacactgaatcgtaaagatagccacagtccaccggcccgatggcccgtccctctctcaccgccgcattgctgcgcgtgatgcaatcgagttccgggatatcccaacccgcacgcctgttacataaggcatgccgttggcacacacgaattaccagtatacaggtctgccggacaatgctggataatcgtgtcgcgacagcaacggccgttatacgaagagtggctccgacgccatcctggcatcggagccactctcccacgcgccaccttgcgcgcatcgcttcaaacctctgagtcttttcataaccccatgcggcccggcgccctcgccgtactgcctatgccgccatctcgaatcgctatattcggttgttcttcagttatatcttgaaggcgttgcgcatgggcctcacggccatcggcgcctcattgcgacctgacgaattctcgaccgatctgcaactccggccttcacctttagtataccgcaaacgaacatatgacacggggcaaaacacccctaaatcccaatattttcaatacttaaccgaacttcagcgcaaagcaacacaatctaacatcgccatggaaaaacaggtcaaaacagaacagcctctgaaccgttctgtacggttcagaggctgcctgaccgatgccacgaatcacattcaggcgttgaccgtttcctcggactcatccttgacggcgtccccggcttccgaagccttggccgcggaacccttctcgccattgtcggaatccgggtggatctgatgcttgtcatcgtgctcgcgccaccagctggacagcaccgaaccggagatgttgtgccatacgctgaagaaggtggacggcacggcggcaagcgggttggacgcgaaggagctcagggccagcgtggcgcccaaagcggaatcctgcatgccgacctcgaaggtgatggccttctgctgcgcgtagcggaagcccttcggatacaccttgtacatgagcttggagaagccgaagcccagcgcgtagccgcacaggttgtgcaggatgaccaccgggatggcaagcagcgaggatgccacgaacagcttcgaaccattggctgcgaccacgacgccgatgatgagcaggatggcgacctgggacacgatcggcagcgccaccgtgaccttctcgatcttctccttgaagatggcgtggcagatcacaccgagcgcgatcgggaacagcaccaccttgaccgcgttgaggaacagggactcgaccggcacggtcacatactgggaggcgagccactgcatcagcagaggaatcatgaacggcgcgcacagcgtggacaggatgccgatggacacgtcaagcgccacgtcgccacggctcagatagctcatcacgttggatgaggtgccggacgggcagcagccgaccagaatcacgcccatggcaagcgggccgtcgagacggaagatccagcacagcagcacggccaccaacggcatgatcacgaagtgggccaccgtgccgacgacgaccatcagcggctgggtgaggatacgtttgaaatcgtcgagcgtcagcgtcaggcccatgccgaacagcacgatgcccaggaagtatccggtgtaggacttgccccacaggctggtttgcggcacgaagtagttgaacacggcccatacgatcacgatcacggtgaaccatttggtgagccaatcaccaaacgccttgatcttctgcattatcgtttcctcttttctcaatcacgtttccatggaagtcatttccggggaaaacaaaacgggaccggctttccgccgaccccgtcgtgacatcttccgttggaattgcctacaaattaggcacccacccatcaagtgcgtaacattccgttcacataatgaacatcacttgacggccggaagcgcaacacgccgacgcgcgcacatccaaaaaatcgtgtatagtatccattcgttgcgcttccgcatggaagtgagaacatggtggctatagctcagttggtagagcatctgattgtggttcagaaggtcgcgcgttcgagccgcgttagccaccccggtgaaacctcggaagaaattccgaggttttttgctatccgcggcggccgaacgcgcggaaccagactttcccgatcgcaagcaacccacaacaaaaggaacgaccatgctgtctttcgaaaacgactactcctgcgccgcgacgccggaaatcatcgcccgtctcgccgaaaccgcgaccaaccagtatcccggctacggcaccgacgacgtctgcgaaagcgccaaagccaaaatccgcgaggcctgcgcatgcccggacgccgaaatcttcttcctcgtcggcggcactcagaccaaccaggtcgtcatcgacgccatcaccccaccgtatgcgggcgtggtggcggccaccaccggacatgtgaacgtgcatgaggcgggcgctatcgaattcaccggccacaaagtgctcacgctcccccaccatgacggcaaaatcgacgcggatgaactcgacgaatactgcgccacgttctacgcggacggcaactacacgcatatggtgttccccggctgcgtgtacatttcgcaggccaccgaatacggcacgctgtacacgctggccgagctcgaggcgatccgcaaggtctgcacgaagtacgacatgccgttgttcatcgacggcgcgcgtctcggctacgcgctgaccgcctccggcaacgacgtgacgatcgaggacatcgcgcgtctcgccgacgtgttctatatcggcggcaccaaggtgggcgcgatgttcggagaggccgtggtgttcacgcacggcaacatgccgaagcatttcgtgacgatcgtcaagcagcatggcgcgctgctggccaagggatggctgctgggactgcagttcgacacgttgttcaccgacggcctgtacctgcgcatcgcccgccacgccaacgatgccgcggaccgtatccgcaaggtgctggtggaacgtggctacacgctgactttcgatgcgccgaccaaccagatcttcgtcacgctcgacaacgagacctccgaacgtctgcaacgcgacgtccgtctcggcttcacggaaaaggcggacgacacgcataccgtgatgcgcatctgcaccagctgggccacgaccgacaagcaggtggacgagctggtcgcactgctgtaaaagacagtccgcaaaacaaggaaagccgggaaatcgctcccggcttttcgcttatgtataacgattgtattgcgattgcggcaggcgccattcagcgacggttatcggcgatcgcctcacgttccatcgcgacgaacttacgtacggacgattccaccgaataattggttttcgtatgtttggcgtaggtgccgccccacttggcgagctgcgccggatggtcgatccaccagtcgatacgacgggccagcgcgtccacatcgtccacggggaacaacgattcgtccagcagcgcgaactggccggccgcgctcagcgacgacgaggcaatcaccggcaccagaccggcggccatgccttcgatgacactcaccgattcgagatcggcgatcgacggatgcaccagcagatcgccggaacgcagcaacgccggcatgtcggcattccggtggaatccgatcgaagccggacgagacaacagccgtccggccatacgctgcaacctcttcttaagcggcccggtgccggcgatcaccaattcgatgtcctgcgcgtgacggcagcgggcgatcgcccggatcaacgcgacatggttcttctcattggtcagtcgtcccgacgcgacgatacggaacggcaccggcgacggctcgtccgccttgcgctgccgcttcggcgtgaaccgcgattcgtagccgttggagatgacatgcagcttcgacttgtatccatgcgagcgcagcaggctcgcacccaattcggtcggcacatgcacatggtcgatcttgcggtacagccatatgtcgaacagccagtagatgaacgagtcgatgccgggcacatatttcaaaggccccgcggaatacgtgacgttctccggctgcacgtggtagccggccgtaacggcgatgcccatctgtttggcgaccttgcaggcatgctggccgaaacggaacggcgtgtagatatgcaccacgtccacaccatcgaacgccttgcgaaacagcgtgtcgctcggctcggcgaactgcatctgctgcttcttcgccacccagctgaccaacggcacatgattgacgcgcgcgggatattcgggcgcgccgatgcccaccaaacggacatgatgcccctggcgctccagctcctgcgcccactgcaacgccgaattcgaggtgccattgccccgattccccgacgtgtcgaccaccatggcaatggtcagggggggttgcgtttcattcttctcattctcggacatgcgttccatcctacgccgatggcacaatagaagtcatgactgaagagaatcgtgccctcggcactccgcttggcaagcatccgacccgtgttctgttccttggctccggcgagctgggcaaggaagtcaccatcgaactgatgagactcggcgcatgggtgtgcgcggccgattcctacgccggcgcgccggcacaacaggtggcgcacgaataccgcgtgctcgacatggccaacgcggaccagctgcgcgcgctgttcgacgaaatccagccggacatcatcgtgccggaagtcgaagcgatagccacttccgagcttgcggccgccgcagcacgtggcgcgcaggtggtgccgagcgccgaaatcgcggcgatctgcatggatcgcgaacgcctgcgcgtgctcgcacacgaggaactgggactgccgaccaccccgtaccgtttcgccggctctctggaagaactacgtgagggcgcgcaaatcgtcggctatccatgcgtggtcaagccgatcatgagctcctccggccacggacagtccgtggtacgttccacggaagcgatcgacgcggcttggaccgaagcgcaggaaggccgccgcgcacacgacgaaggcgacgtgtcacgcgtgatcgtggaggcgctcgctccactcgactacgagctgaccgtactgaccgtcagctccagcgccggcatcgtgacctgcgctccaatcggacaacgtcaggaaagcggcgactaccgcgaatcctggcagccggccaccttcacgccggacgtgctcgaacaggcccagcacatcgcacgaaccgccgtggaaggtctggtggcgaaggccaaggcatccggcgaaaaaggctggggcgtgttcggcgtcgaactgttcgtgctgaccgacggaaacgtgctgttcaacgaggtctcccctcgtccgcacgataccggcatggtcaccatggcttcccagcgattgagcgaattcgcattgcacgcgcgcgcgatcctcggcctgccgatcacacaggaacatgtcgccctgtcgattccgcaaggcaccgtcgcggcaagccatgcgatcgtcgtccagggcgatggcgaagcggaattccgcaacgtcgccgccgcgctcgccgaaccgggtaccgacctgcgtatcttcgcgaagccggaagtgcatgggcaccgacgcatggcagtcgcgctggccatcggcggcaacgaggcggatgcgcgcgccaaagccgggaacgtggccgaatcgctcgacatcgcaatcgtttgacggctatcgccggatgctgagacgaggctaccggaacgcgcccaaaagtcgcgcgattgtagcctcccgttggtatcttgttaaccgtcaagttcaccaaactatctacctcccacacaccaggaaaggcgagtaatggagaagttggaaaagctctacgagggcaaagccaagcaactgtacgcaactgacgatccggaggtcctctgggtcgaatacaagaactccgctaccgcaggtgacggcgaaaagaaggaagacttcgccggcaagggcaggctgaacaacctcatcaccacgttgatcttcgatctgctcaagaagcgcggcatcgacagccacctggtggcacgcgtgggcgagacctcccagctggtcaagaaggtcacgatgttcccgctcgagatcgtgctgcgtaacaccgcggccggccacttctgctcccgcctgggcgtcgaagagggcatcgagctcaaggaaccggtgctggagtacttcctgaagaacgatgacctgcacgatccgttcgtgaacgacgacgatctggtggcgctcgatgtgtgcacccgcgaggatctggccgaaatcgcgccgctcgcccgtcgcatcaacgaagccctgatcgaaatcttcgccaagatcgacgtcaagctggtcgatttcaagatcgagatgggccgcacctccgacggcacgctgctgctcgccgatgaaatcacgccggattcctgccgtctgtgggatcagcgcgaccattccggcaaggtggagcacctcgataaggacctgttccgccgcgacctgggcgacatcatcccggcatacgaggagatcgaaagccgcttggccgagctcgccaagtccgagggcatcgaagtcgcagagtaatgcgtttgcaagcccgcatctgaagcgaaagccggatgcgggcttccttgttatatcgcaatccttcattcttttgtcaatccaaatccaataacccctcttttttcaaggagttgaccatggtttttcgcgtgtacgtggaaaagaagccgggctttgacgtcgcggcccagcagctcgccaacgagttgcgcaccattctcggcatcgaagctttgaagaacgtccgtctcgtcaaccgttacgacgtggaagacatcagcgaggagctgttcgcccaggccacgccgaccgtgttcagcgagccgcaggtggacaacgtctacgccgacctgcctgatttcggttccgacaccgtgttcgcggtggagtatctgcccggccagttcgaccagcgtgcggattccgccagcgagtgcatccagctgatctcccaaggcgagcgtccgacggttcgttccgccaaggtgtatgcgttggaaggcgaactttccgaagccgatgtcgaggccatcaagcattacgtgatcaatccggtggaagcccgtgaagcctctctggatgtcaagaccacgctgaagacccaggtgccggtgccaggcaaggtggaagtcatcgacggcttccgttctatgagcgacgccgagcttgagcagttcatcgaggaccgtggtctcgccatggatctggccgacctgcagttctgccgtgagcacttcaccgaggagcagcgcgacccgacgatcaccgagatcaaggtgatcgacacgtattggtccgaccattgccgtcacaccacgttcggcacgcaacttgacgaggtttcgatcgacgatgccaccgtcaaggccgcgttcgacaagtatcttgagatgcgtcacgagctgggccgcgacgccaagccggtatgcctgatggatatgggcacgatcggcgcgaagtggcttaagaagaacggcattctgaagaatctcgacgaatccgaggaaatcaacgcctgcaccgtcaaggtgaaggtggatgtgaacggccatgacgaggattggctgttcctgttcaagaacgagacgcacaaccacccgaccgagatcgaaccgttcggtggcgcggccacctgcatcggcggctgcatccgcgaccccctgtcgggccgttcctacgtgtatcaggcgatgcgtgtgaccggtgccgccgatccgaccgtgccggtttccgaaacgcttgagggcaagctcccccagcgtaagctcgtcaccaccgccgcggccggctactcctcctacggcaaccagatcggtctggccaccggccaggtgaatgagatctatcaccccggttatgtggccaagcgcatggaggtcggcgcggtcgtggccgcgactccggccgatcatgtgcgccgcgagaccccggctccgggagacaaggtcatcctgctcggcggccgcaccggtcgtgacggcatcggcggcgccaccggcgcttccaaggcgcataacgtcgaatcgctggagcttgacggcgccgaagtgcagaagggcaacgcgccggttgagcgcaagctgcagcgtctgttccgccgtggtgacgcgtgccgtctgatcaagcgttgcaacgatttcggcgccggtggcgtgtccgtggcggtcggcgagctggccgacggcctgtacgtggacctcaacaaggtgtccaagaagtacgagggtcttgacggcaccgaactggcgatctccgaatcccaggagcgcatggccgtggacgtggccgccgaagatgtggacgagttcctcggctacgccaaggaagagaacctcgaggccgaggtcattgcgaccgtgaccgaggatccgcgcatgacgatggtgtggaacggcgacacgatcgtggacctttcccgcgaattcctcgcctccaacggcgctccgaagcatcaggtggtgcatgtcgaggcgcagcacggctacacgacgccgtggacttccggcacgctttccgagcgcatgcacaccatgctcaccgacctgaacgtggcttccaacaagggtctttccgagcgtttcgactccaccatcggcgcgggcaccgtgctcatgccgttcggcggtaggaagcagctgaccccgaacatggccatggtcgccaagcttccggtgttcggcgagaccaccaccgcttccgcgatggcctggggattcaacccgtacatcatggagcagaaccagttcacgggcgcgtacctgtccgtggtcgaatcgctttcgaagctggttgccgccggcttcgaacatgagaaggcgtacctaagcttccaggagtatttcgagaagctgcgtgacgagccggaacggtggggcaagccgatggccgccgtgctgggcgccctgatggcccaggtagatctgggcgcgggcgcgatcggcggcaaggactccatgtccggcacgttcgagcagcttgacgttccaccgaccctgatctccttcgccgtggcggtgggcaatatgaagcgcgccacctcccccgagttcaagggcgccggccaccgtgtggtccgcatcgccccgcgctataaggccgatggcctcacgccagacaaggacgcgttgctggaggtgttctccgcggtcgaggagcttaccgatttcggcgatgcgctggccgtgtccacgccgggctacggcgccaccgccgaggcgatcttcaagatgacggtcggcaaccagatcggcatgaagctggacgacggcattgccgtggatgacctgtttgctccggcctatggctccttcatcatcgagcttgccgacaacgcgaaggttccggccgtgtccaacctggtggaagtcagcgaggtcggcgaaaccaccgaggagtattcgttcgtggccgccggcgagacgcttgatctggccgagctgcaggacgcgtgggagggcagcatcgaatccgtgttcccgtaccgttccaagggcgaggagaagggcaagacggttgaaaccatgtccttcgacgctccgaagaagaccgtgtacaccggcaccggcgtggccaagccgcatgtgatcatccccgtgttcccgggcaacaactgcgaatacgattccgccgcagctttcgagcgtgcgggcgccgacgtgagcactctcatcgtgaacaacctcaccccggcggccgtggccgaatccaccaacgcgttggtagaggagatcaagaagagccagatcatcatgatccctggcggcttctccggcggcgacgaaccggacggctccgccaagttcatcaccgcgttcttccgcgctccggccgtgaccgaggccgtgcgcgacctgctgaacaaccgtgatggcctgatgctcggcatctgcaacggtttccaggcgcttatcaagcttggcctggtgccgtacggcgacatcgtgccgatgaccgccgaatgcccgacgctgacgttcaacaccatcggccgccaccagagccgtctggtgcgcacccgcgtggcgtcgaacctctccccgtggctggcgaagaccgccatgggcgacatgcacaccatcgccatctcccacggcgaaggtcgtttcgtggcttccgacgacgtgctcgctcagctcaaggccaacggccagatcgccacgcagtatgtggacgaggctggcgtgccgggcatggacctggatgtgaacccgaacggttcgctgctggccatcgaaggcatcaccagcccggacggccgcgtgttcggcaagatgggccactccgagcgctacagcaacggcacgttcgtgaacgtgcccggcgagaaggaccagccgctgttcgcggccggcgtggagtacttcgccgcctgagcatcgagactcttttcacgctcacataatcaagggtgggttcgaaatctcatgattccgaacccaccctttcatatacagcaatccgcgacattcgtcatagcagccgcttcaggcggaaaggtaaccctcggcgagatcgacgggcctgttggcgcgttccaccgcatcatcgctggattgcgcggtttgtctgatgatgtcgtcgtaaccggtcagggcggcgaaaggcatgaattgggcggcacggttatgcatgctcatatgggcatgcgtctgcgattggtgatgcggcagatcgatgatgtcgtcgtagcgatgggtttccgtaaggctcatgccgcatgacctcctatctgcttgttgcgctgctggcctgtggcgtcatcgaacatatccatggccttgatgatggaatttctgccgaatttgcgtttgatgtccagaagcgtttgctgcatatgcagttcggcgtccccttgcggcgaatccttggaaccaccatcggcggaacgcatagcctcgcattcggccgcatcagcggaagcggaatccaccggcacttccatcgtggcgaacaaatcaggctgcgtatattcggacgcggccgcctgccgccgttcctcaagttgctcgtcggtcagcacatcggcggcgaccacattcacccgacggaccagcaaacgcctgtcgacaatcgaaaggaaaagcttatcgaccgcgtcgcaaatacgcgacgtagccgacgtcggctccggcaatgcgatcgacccggtggccggcttgggtacgcggcggccatacctgtcgatcgaaacagggccgtcgtatgttgccgcggcatgttcggcaatcgccttcaaatcagcggaaacatccttgccaagccgtttcggatcgaggcttgccgtgtcgtagccgaccatcaatcccactctgccggctttcacgcccttcgctaccaaatccaatgacagcgtatccgccatttcacgcacaatcagccgggctgcgtcgaatcccgccggacctgtcagcacttgtccggaactcaagctgtgccccgccggcttgtacactttgatgtccgcgatggtgcacggttcccagccccacgcatggtcgatgagcagttcggcgttcacaccgaacatcttgtacagtagatcttcgttgtagtattcgtcggcacggccaatggaacagcgagcgatatcccccatggtcgccagtccgtgcgcttcgagcttccttgcatacccacgccccacacgccagaaatcggtaagcggccggtgattccacaacaatctccggtacgacatctcgtcaagccgggcgatgcgaatgccgtcctcccccgcctggatgtgtttggccacgatatccatagccactttggccagatacatgttcgtgccgatgcccgcggtggcggtgatgccggtctgggtgtggatatcgcggatgatgtcacgggtcatctcctccaccccttttccataggcgcgcaaatagccggtgacgtccatgaacacctcgtccaccgaatagacgtggatatcctcagccgaaacgtatttcagataaataccgtagattttcgcactcatcgccaagtaatgagacatgcgcggtttggcgatgaacacgtcagcagccagattcggattggccgcgagcgccttcgcatcatacgatttccccgtcagcacaccgcctggagccgcggcgcgacggaccgcgttgatttccttcagtttcgctttgacttcgaataggcgggcgcgtccgggcagaccgtatgccttcaacgacggcgagatcgcaagacagatggttttgtcggtcctctcctggtccgccaccaccaagtgtgtggatagcggagggaatccatgttccacgcattccgaggacgcatagaaggatttgaggtcgattgccacgtatatccgtccggccatgatgctccttccatgcaatggctcatacgggggacttcccgcaccccgacgaccgtgattcgcgttttcaacgtcttccatcataacagctttttcgaacggctgttcgattgcatgtccggttccatataccgtctgagaactggacaaaacccgactcttgtagccgcccattgatactgttggacgatagcgaaccccttgtctccatggttttggaaggagctttggcttgtcagctgaactcgaagacatccacgaggaatgcggtattttcggcgtttggggccactcggacgccgcccgactcacctacttcggtctacacgcgctgcagcatcgcggtcaggagggtgccggcattgtctccaacgataatggtcatctcatcggtcatcgcggaacgggtctgctgacccaagtgttcagcgacgaacgggaaatcgaacgcctgaaaggagacaaagcgatcggccatgtgcgttacgccacagccggttccggcggcaccgacaacatccagccgttcatcttccgcttccatgacggggatatggcgttgtgtcacaacggcaatctcaccaattgcccctccttacgccgcaagctggaggacgagggagcgatcttccattcgaactccgacaccgaagtgctcatgcacctcatccgtcgttccagcaagcccacgttcatggacaagctcaaggaagcgctcaacaccgtgcacggcggcttcgcctatctgatcatgaccgaacatgccatgatcggcgcgctcgatccgaacggattccgtccgctgtcccttggcaggatgacgaacggcgcctatgtgctcgcttccgagacctgcgcgctcgacactgtcggagccgaactggtgcgtgacatccgcccgggcgagatcgtggtcgtggatgacgatggctaccgcatcgaccgttacacggatcagacccagctggccatctgctcgatggaattcatctacttcgcacgccccgattccaacatctacggcgtgaacgtgcattcggcccgcaagcgcatgggcgcgcgcctggctcaggaatcccccgtcgacgccgatatggtcatcgccgtgccgaactcctccctgtcggcggcttccggctattcggaggaggccggcctgccgaacgaaatgggtctgatcaagaaccagtacgtggcacgcaccttcatccagcccacgcaggagctgcgcgagcagggcgtgcgtatgaagctgtccgcagtgcgcggcgtggtcaagggcaagcgcgtggtcgtcatcgatgattccatcgtgcgcggcaccacctcgaagcgcatcgtgcagatgctcaaggaggccggggcggccgaagtgcatatgcgcatcagctccccgccgctgaagtacccgtgcttctacggcatcgacatctccaccaccaaggagctgatcgcggccaagaagtccgtcgacgagatccgcgactacatcggagccgattcactggcgttcctgtcgctcgacggcttggtggaatccatcggccttggcgcagacgcaccgtatggcggcctgtgcgtagcctacttcaacggcgactatccgaccgccttggacgactacgaagccgacttcctgaagtcgctcactccggaggatcgtgtccgtctgcccgaattcgccctgtacaagagcaagtacgaaggcaacgaatacaccaccacttcatcccaagaagaacactgagacccgagaaaggttagatatgccaaaagcatatgaggaagccggcgtaagcgttgaggccggttacgaagtcgtcaagcgtatcaagtcccacgtggcgcgcaccaaccgtccgggcgtggtcggcggcatcggcggcttcggcggattgttcgatctcgcttccctcggttacaaggagccggtgctgatttccggcaccgacggcgtcggcaccaagctggtcgtggccaagatggccaacaagcacgacaccatcggcatcgactgcgtggccatgtgcgtcaacgatatcgccgcccaaggcgccgagccgctgttcttcctggattacatcgcctgcggcaagaacaatccggctctgctcgagcaggtcgtctccggcgtggccgacggctgcgtgcaggccggttccggtctgatcggcggcgagaccgccgagatgccgggcatgtatgacgaagacgagtacgatctggctggcttcgcggtcggcgtggccgaaaagtccgctatcgtcgacggctccaccatcgctgagggcgacgtgcttatcggcctgccgtccaccggcgtgcattccaacggtttctccctggtgcgcaaggccctgttcgagcaggccggctacaccgtggacaccgtactggacgaactgggcggtgagaagcttggcgacgtgctgctcactccgaccaagatttacgtgaaggccctttccccgctgttcaaggcgggcgtggtcaagggcgtcgcgcatatcaccggcggcggtttcatcgagaacattccgcgtatgattccggacggtcttgccgcccatatcaacctcggctcctggccggtgctcccgatcttcgacgtgctcgagaaggccggcagcatcgaccatatggaaatgttcaacatcttcaacatgggtatcggcatggtgctggcggtcagcgccgaagatgccgataagaccatggaactgctgaagtccaatggcgaggccggctatgtgctgggcaatatcgtcaagaagaccggcgaggacgtcgaactgcagtaaacgaacatacgggggtagccgaacaggcacccccgatattatttcttgagattggcactcttccccataagggatacaacaggaggaaatatgaaggttctggtcattggttccggtgcgcgtgaacacgccatcgcccacgcgctcatgcgtggcgacagcgtcagcgaggtcactgtggctccaggcaatccgggcatggaacttgacggcatccgcaccacgcagctcaacccgtccaatcatgcggcgctcatcgatttcgtgaagaacaatggttacgattgggtgttcgtcggaccggaagtgccgcttatcgaaggcatcgtcgacgatttcgcggccgccggcatcaaggcgttcggcccgaacaaggccgccgcgcagatcgagggttccaaggacttcgccaagcagcttatggaacgtcacgacattccgaccgcgaagtaccagacgttcgacgatttggagcgttccaccgcttatgtgcgcgagcatggcgcgccgatcgtcatcaaggccgatggcctggccgcaggcaagggcgtgaccgtggcgatggatgaggagaccgccatcgccgctttggaggacattttcgtggaccaccgcttcggcaacgccggcgcgaaggtggttatcgaggatttccttgagggtcaggaattctctctgatgagctttgtgaacggcaccgatttctggccgatgccgatttcgcaggatcataagcgtgcctacgatggcgacaaggggccgaacaccggcggcatgggcgcttacagcccggttccgcagatcggtcaggatgtgatcgacaccgccatcgaaaccatcgtcaagccgaccgttcaggccatggccgacgagggcacgccgttcaccggcattctgtacgccggcctcatcgccaccgccgacggaccgaaggtcattgaattcaacgcgcgtttcggcgatccagagaccgaagtggtgctgccgaagctcacgtccgatctcggtgccggcatcaacgccattctgaacgatgagaccccggaattcacttgggatgaggacaatgccactctcggcgtggtgctcgcttccgacggctatccgaccaatgtggtcaagggtgccgcgattcctgagatcaaggtcgacgacgattcccacgtctactatgccggcgtgacgcgtggcgagcatggcctggtggcgaattccggccgcgtgcttttcgtggagacctccgcggccgatatcaaaaccgcgcaggacaaggtctacggcatcatcgacaagcttgacacgacgggaatgttctaccgtcacgacatcggtttcaaggcgttgaacgcatgatgtgacgtcatgctgacgccgtgaaacgttttaaggggcttgttccataattggaacaagccccttagcgtattctcagacgcgcgcgaattccacgcggcacgacacgaaggcgtacaaaggtacgtcgagtgtagtgccgtgcggaaggcgcgctgtcctcgttacggcagggtcatgaacgaggtgtttttcagataattcttccccgtggtgatgtcgtattggatgagccggtaatcggccagcagctgtctggtttcggcgtcgaaatcgtcttcggccatgggctcgcccttggagttcagatagatgttctgtccttcggggatgcggtcccagccttggatgttgttcacgaccggcggttccatggcggagatcttggaatgcatttcggtgaggaacgccaggtatggggaaactttggcatccatgtgctcggccgcctgggccacgaagaagttcggcgacgagtattcggcgttgtcgatcttgttgccttgcgtgccggaggctttgttggaccagatgaagtagtccgtctgatgtaacgccagcgagttgccgtcatcagcggaagccgacgagtagatgcccggcagatggtcgccgtagaagaccacggtgaccggcttgtcgagcttgtcgagttcggcaaggaatccggcggtcgccccatccgtcagggacgcgcccttttggtaggtctcgatggattccttctcgtcgtccttcaacggctttcccgtggtggaggaggctttgaagtcgttgtgcttgtaccagtcatggtagggcatgtggttctgcatggtgatgacctgcaggaactggttcgacttggttttcctgacttcctccagcgtgctttggtaggtggcctcgtcggagacgtacggcgaatcgtcgatcttgtcctgatgcgagatgacgtccggcccggtcagcgtgtagaaatgcgagaagccgaacttcttgtagttggtggcgcgcgaatacatggacgactcgtacgggtgcagtccgatggagttcttggacgcgccccacatctggttgatggtcggcgtccaatgctcgctcggcaccagctgctggtatgggctggtcagggaggaatcgaaattcgccatgctcaggccggacagtcccatgtattccagattggcggtgccgccgccgtatccggaggacagcatcaggccggacgtggtattctgcttaatcttgcggatgttcggtatggaatccttgttgactttgagtcccggcacgcgggacgggtcggagaaggattcggacagcacgtagatgacggtgctgtcggtcatgttcgcggaacgtttcgcgttgatcttcttcgcggccttctcatagcgggccgcgacctgcttcatggtctcttcggaatagtcgtccggcttgaccatgactttcgggttgagctgacgggtgaacgccaccagcggcccgttgcgctgggcgtcgtatacggagtcccacatggagggcttgtcccccatgacggtggcgaagcctttggcccacgagccgacggtgctcacctgcatcgaatacagcgtgaagaacaggcctggaagcaggatcagcagcagtcttgcgatcgcgttcacggaacgggatcgcttatcggagccgcgaaacagtttgccgtgacgcgcgtcgaggcggttcaggaagacgaacagcgccacgaacgcggcaaacgccgccaccgcgatcagaatggtccattgcgcgccggacggcatgaaactcatcagattgccggcgtcggccttcagaaagttcaaatcacttggcagaatcgcctcgtatcgtattgaaaccttgaaatgctcaatcacggcgacgatgaacgtgactgccagaaaaaccggcgtggccacccagaaacgattggtgagcatcagcagaatgacatacaggacgccccataggatgaggttcagcaccgccacgaaattggcgctggtgaacatcttgccgacgaatccccaaccggtgagccacatgttgttcgatagttggactcgagtggcggattcgctgacgccgatctgcagggcggcaacgcccaccgcatcgaacagcacgaatagcacgccgtagagccagccggggaactccttgcccgctttcttggccatcgggtccacggtagcgatgtcgagctcctcaatcggctcgtttttcgatgttgctttggtcacgcataaccccacttagttcgtttgcaatgccctattgtcatatatgcgtctgaaaaagacaacgtccaacgttttttctttacgatttttacgattggattgcgccgatggcgatacgattccaacggaaatacggcagacagccgctacttgtccgccttccggcagtcctcgcacaggccgaacacctccagcgtgtgccgttcaatggtgaagccgtacttgtcggagatgcctttcagccagctttcggaaggcgattcaatttccacggttttgccgcagttcgtacagacgaggtgatgatggtgcccgtcatcgccgcacaggcggaacagctgctgcccgtcgagacggaccgtgtcggcgcggccggcttcagccagggcgttgagctgccggtagaccgtggcgagtccgatatgttcgccacggtcttccagcttgcggtgcagctcctgcgcggagatgaattcgtcgcagccgttcagcacgtcgcggatggcgtctttctggcgggtctgccgcacgatatgttcactcattacttatgatgtcaggctttcttcaagtcgtcccagcagccggtggcctcaaggtcggccacggttttggcggtgtcgtcggtcagcacggtgatgtgccccatcttacggtcgtggcgcacttccgccttgcagtagtcgtgcacgttccattcgggatggtcggcgatgagcgcacgggtcggcgccacatgctggccgagcacgttgaccatgacggcgggcttgagcagctgcggctgttcgagcggccagccggcaatgccgcgaatgtgcgcgtcgaactgatcgaacgagcaggcctcgatggtgtagtggccggaattgtgcggacgtggggccagttcgttgacgatgaccttgttgtctttggtgatgaacagttcgatggccagaatgccggcgagttcgaagcctttggccagtcgcaacgccagctcgtgcgcctccttggccacggtttcgtccacttcggccggcgcgatggtcatgtgcaagatgttgttgcgatgctcgttgcgcacgatcgggaaggtcacgtaatccttgccgttgccggcgacgaggatgctcgcttcgaacgcgaaatcgacgaagccttccagaatgcttggcgggaagctgccgtcatggtcggcgcgggcgcgcacctgctccaagtcggcttcggacttgagcacggtctggccgtggccgtcgtaaccgccggaacgggttttgagcacagccggatagtggatctcatcaagtgccgcttcaagttcctcgacgctgttgacggccttccacggcgcggtgggcgtgccatggtcgttgatgaaccgcttctcgttgacacggtcctgcgtgacgcgcagcagatcggtgccttgcggggccgccgcgagggaacgaacttggtcgatggcgtcggcgtccacgttctcaaactcgtaggtgagcacgtcggacttttcagccagttcgcggatggcggcgatgtcgtcgtattcggcggtcacttggaaatccgcgacctgagcggtcggacagtcgggtgtcgggtcgagcacgccgatgcggaagcccatgtagcgcgcggacagcgccatcatgcggccgagctggccgccaccgatgatgccgatggtcgcgccgggcatcagtcgttcgatacggccgttggtttcctcagacaagctgggcattggattcagccaccttttccttcagggagtcacgatagtcctgcagcgccttggccagtcgctcgtcggtggtgctcagaatgctcaccgcgagcaggccggcgttggttgcgccggagttgccgacggcggtggtggccaccggaatgccgcccggcatctgcacgatggacagcagcgaatcccagccggacagcgcgtgggagcgcaccggcacgccgatgaccggcagtgtggtctgcgccgcgaccatgcccggcaggtgggccgcgccgcccgcgccggcgatgatgaccttcagcccgttggcacgggcgttgtgcgcgaactcacccatcagttccggggtgcggtgcgcggaaatcacctgcttcatgtacggcacctcgaactggtcgagcatctcgcatgcgtgcttcatggtctcccaatcgcttgccgatcccatgatcaccgcgacttcaggcttgttgtctgccatcaaaacctccgaaggatttacgtagacttacgtgttccagaacaccgtctactttacttactcggctcgatgtgcagcacgacctttccgaaaacgtcgccgtcgaccactttgcggaacgccgcgggcgcgtcggcaagcgcgtaggtggagtcgatgacggggtgcaggtcggcgtgttccacgaatttgagcagtcgtgcgaaatcgtcacgcgaacccatggtgttgccttgcacgcgaatgtcctggaagaagatgcgggtcagttcggctccaggctggtctcctgtggtggctccgcagatggcgatggtgccgccggggcgtacggatttgacggaatggctccaggtggccgcgccgaccgattcgatgacggcgtcgaccttatgcggcagtcgcgcgccggtttcgaaggcggcgtcggctccgatggcgatcgcgcggtctcgtttctcttcgctgcgtgacgtgacgaacacttccagtcctgccgcatgggcgagttggatggccgctgtggacacgccgccgcccgcgccttggacgagcacggtgtctcccggtttcacgttggccgatgtgaacagcagtgagtaggcggtcagccagctggtgccgagcgcagcagcctcatcgagggtcaggttggcgggtttggcgaacacgttggcgctgggcacctgggtgatctcggccatggtgcccgcgtatttttcggataggatggtgcgccgctcccccggcatgacgccggcgccgtcggtgccgacgaaggtgtagagcaccacttcggctccggctttcagccctttgcgaacaggaatgtcctcgtcgagcacgcctgacgcgtcggtgccgagaatcatcggcgtctgttcggcggagagtcccacgccctgcaggctccagatgtcgtggtggttcacgctggctgcggccacgtggatggtactccagaacggcttggtttcgggcgcgtccagctcccccaccttgagttgcgacagcggattgtcataatcggttcctgctgcgtatacggctttcatggtcagcgctccttcgcggtttttcggtggttcgattcatttcatcgtttccattgtgccgcagttgagaagactttgcaggtatttcacaaccgacaccccggcagaggcatacagtgggataggattttccgcggtaaagaagacaggttcagggaaggacagttgcgcataatgaccgctggcatactgggttcgattcattctccggcggatgtgcatgccctttcttcgcaacagttgcgtgatctgtgtctggagattcgttccacgctgttgaattacggccggaagcatggtggccacatcggttcgaatcttggcgtggtggagcttaccgtggcgttgcaccgcgtgttcggttctccacgtgaccgtttcgttttcgatgtctcccaccagagctacgtgcacaagatgcttaccgggcgcgccgaggcgtatctggacgagtcgcggttcggcgaggtgacgggtttcaccaatccgttggaaagcgagcatgattccttcgtgctgggccataccggcacgtccatctcccttgcctgcggtcttgccaaaacacgtgatatgcaacataccgctgcgggagcaagcgaaatcggcaacgtcatcgccatcatcggcgacggttcgttgagctcggcgatcgctttcgaaggactgaacaacgctgccgaacagggcggtaatctcatcatcgtcgtcaacgacaatgagatgtcgatcgccgaggatttcggtggcatgtacggcaatcttgcccgtctgcgcgcgtcgaacggaaccgcggagctgaatctgttcaaggcgttcggacttgactaccgttatgtggagcagggcaacgatgtggacacgctggtcgcggcgcttgaagacttgaaggatatcgaccatcccgtcgtgctgcatatccacaccaccaagggcttgggtttcagcgatgagaccgaggcgcaggatggttccgacggatgcaaccagaccaatccgcagccgcatgccggccaatgcgaggcgaatcattggcaggatccggacagcgcgctcggcaagccgcttgacgcgcgcaaatactacggtcagatggccatggcttcgttggagtcccgtttcgaaaacgagccgggactggtggtcatctcccccgccacccctggttcgaatggcatcacccgtgatttccgtgaacgtgccggatcgcattatgtggacaccggcattaccgaggagcatgcggccgcgttcgccgcaggcatcgcgaaggctggaggccggccggttctggcgacttccgccacgttcttccagcgtatttacgaccagttgcagcaggagctggcgttaaatcatgttccggcgacgctgctgattttcggagcgggcatttccggcgcggacaatacacattccggcacgttcgatatgacgatgttcgccaacacgcctgatgtgacctgtctggcgccgaccagcggagagcagatgctggacatgcttgcatgggccacggggccgtctgatcatggtgtgacggctatccgcatgcccggcgagcagattcttgccatggagcgttccgccgatatggcgttcgacccggccgaacgtgccgccgcgcacgaaacgacgatcgatattaccggcgattgccctttcacgcggtaccagatcgtgcgtccgggacgtgaagtggcgattctcggcttgggcaatacactgccgttggcggccgaggtggcggcaacgctcgaaaacgacgacgatatcaatgcgacgcttatcgacgcgcagcagtattccgcgatggatggcgagctgctggacgtgcttgccgacggccatcgtgtggtcgtcaccttggaggatggccagctggaaggcggctggggtgagaaggtgaccgcgttctacgcgaattccaccaatccaaaggcggccactgtgcatgcgctcaatttcggcgcatcgaaagaattcaccgatcgtgtgccccttgccgagcttgatgaacgttacgggctgactgtggaagcggtggctgatcgcattcgccgcgtcttggcccgttaatcacgcaactagccggcaccgtcaaaaatcgacagggaacgtcgaacaatcgcgaaatgccggcccacgctgaacagcacatggccgaccataggcattattgtcaatcgcaatcgctattgctcgttcttgatggcgtccaacgcaggaatcttcacagccttattagctggccccaaaccggcgagtatgcccaccagaattgaaaacagcacggccacgacaaacagccaccatggaatcacggagattcggctcacgtcgtcaccgcccataatcgctttgcctacgttttccatactgaatccaccaaacgacagcagattgatgctcagcgaccccaaggcggaaatcagacaggcgataagtccaccgaccagaccgatggcacctgcttcacataggaacatcgtgcgaatatccttcacatagcagccgagcgccttcataatgccgatttcccgagtgcgttccgacacggacataatcatggtgttggcgatgccgatggccgccaccaggaatgacaccgcgccaatgcctcccaatgcgagctggatgccacgactctgcttttcaatctctttgcgggtctgttcgaaggacgtggtttggtagccagacattttgatctgcgcttcgatacccggcacatccttgatattttgagcgtgcaccaccacttggtcgtagtttgttttggtccggctggtggtattggttttgccgtcgattttggcctgcaatgtgtccatatcctccagcgacatgactacaccggagctgaatgcatcgtaattattggttgcagcgtccaacacaccgaccacggtgagaggcatggaaaccacaggattctgcgaactggcaataccatcgccgtcgcctgaatcggtggaactcatcgaagtgctgcctattttgcggtaatcgtcagggctttgataatcggctccggtaatcaaattgagtttcgtggtcagtacgtcgaagaacggcttctccccctcgctctccttgcaaccgttctcatcgcactcataatcaccgggagcgatacgcctggagtcatcatcggaacgatacttatccataaactggtatgccgcgtatttgccgagcaatacttctccggcacgcctcggcatacgcccttgaacgagcttgtatcccgatgcttcaagctgggtcatatccgtacccatcacagaagcatattgagccacgtatcgggatccggctcccgcagtgagatccacggtgctctgcgccgaccgctgtggcatcacggctgcgacgcctgaaatgccacggaacgtctgtaccgcagcatcgtcaagcttggcctgatgatccgatgatgtcatgtccgacgaagacaaactcgacataccgacgccagagctgtcgtacgcgcccgagccgccggcagctgtgacggtaatgtcgttgagattgcccatgctcttgagcatctgctcattctgctcgctgatgccttgtccaatcgaaatcatcaggacgatggagcagcagccgacgatcacgccgagcaccgtcaaaatcgtacgcgatttgcgccgcagcaaattctgcgcgcaagtatgtgcgatatccgaaaatcgcatgcctactccttgacggatggagtggaagatgacgttgcggatacggaggcggccgatgtgccacctgccgtggcgattacctgcgtcggcgcatcggcagccatggcagtagatttaccctgcttatcggctccaagatcggcaggctcccaatcccaatcgtcatcatcggccgcctgctttgccttcttacggcggtgacggaccaccaatacgaccgtcagtacaatcacgacgagtgcaacggccgccgccactatccacacccagaccggcatgctctgatcctggacgtcaacatccgtatcggaatcatccggaacaggagcttcaacggcattgattttcaccggaaattccttggtctgcggctgtccatcggaattctcatacgtcaccgtcagtttcgcttcggtttcgccgggcttgtccgcagtgaatgcgaatccaatggagccggacgcgccggacgccacattgccgacgtactgcttggcctgcgtggcggtgataccgtcgccttcaacgctcgcctcgacattggaaacgtcgcccttgcccttgttcacgtaatccatggtgatagtagtttcctcacccgcgttgacgatattgggcaccactggatcgttcaattcaaaacgatcaggctgcgaaacgggtacggaaattttgatgtcggaagtgttggagctgcgtgcggcaccgtccacatactcgtatttgaagctgatgtcgatgccctgcgcgccgtttttcgcactggccagtgtctgcatcggcacggtctgcgtcaacgcagctcccgcattcagtgcatcgtagtagaacgtgttcgtaccgccggagatggcaaaattctcaccgccgtccacggtgaccaccatgttgctcaccgccactttgcccatgttttggaaggtgaaaccgaggttgaaggtgctgccgaccgccaccgacccgtcgccataggtgaaattggtgataatgatgttcggcaccggcccagcaatctgctcaacactgttgtccgctcccgcacccggagcatcggaagtattggcaccatcttcggcgaacgccgtcggcacaatgcacaccaacgtgatggcgaccaccgccaatagtgagattgccccgttgagcagtgttgcgattcttgtgttgttgcccatggaaggcccttctgttgtcgtcatagttgtcgatatgcgttgtcatgaatgttacgtaagccggtcgccgatgatgcggccgtcaagaagtgtgacgatgcgatcggcgtattgcgccatattgtcgtcatgtgtgacgagcacgatggtctggttgaaatcgcgtgcgaacgagcaaatcatatctatcacttcggttttggttttggaatcgagattgccggtcggctcgtcggcgaataccacttgcggacgtgtcacgaaagcgcgggcgatgccaacgcgctgctgctgaccgccagacatctgggtcggataatggttcatgcgtttgccaaggccgacccgcttgagcatggcacgcgcgatcgtctcgcgtttacgcttcggcacgcctcggaacatcagtggcatggccacattctcgatggcattgagattgggcagcagattgtacgactggaacacgaagccaaggtgcttctgcctgaattcggccagctgccgttcgtcaagcctgctgatgggcacacctgtgatacgtacaccacctttagttggtttttccatgccggcaagctgattgagcagggtggatttaccggatccggactcgccatagatacagcagatctgcccttgcggaatggcgagattgacacgttccagtgctacgacggtctcatcgagcactggatattccttgcgtaggtttttaacctcgataatgggaccgcgaccggttttcccagcgttggatgtgctacctaccggcacattcacctcctcgttttctgggaatatgttgataattgctcctaagtctaaagtgtttcaccgcgcttcgccacccttaagggaacaccctgaagccacggtccgcgcgtgcctgaaactcgaaaaccgttcaagaaaccccgcctgaacgatatggaacatgttgtttcatgccagaaacccttgttttgtgccaaatggcagtgaaccgtgaaacgacgaaaatacaatgaaggcatcgcaacgaatcgaaaacgaagctgaacggttccataccatgagggggacatcatgaaacgtcgtttcacacaagcggaggtctactacctcaacaccctgcccgcggtggagcgggcatcgatggaccgcatcacctattcgagggatttccaggtgcgttgcatggcgcaatatctgcggggcaacggaccgaccagcatcttcgccagcgcgggactcaatccgaagatcgtgggcagcaagcgcatcgaacgcgccatcgcacggtggaaggccgatccgcagatcatgctggaggcgcagtcgttcgccaatgaagccgcggccgatcaacgcgacctgctcgtcatctcccaatccatgaccatcgcatggttggaaaagaaagtcatggatctgcagaaacagatccaatccgtgaagcagcatgaggcggaacgcccgtccatgccggcccacggggcgctcatcggactggaatagcgtccagaagcgttcccatgacaagatgtgcgtcgtggtacggcgacgcacccatacgcgatccctccttccatcgtttccgcattctccgtcacattcacgcggctccccgatggaaggagggattcgtttcgtctttggccgcataccccgcgattggcgcatgcggccaaagacgccattcgatcaatattcgtcagatacgcggcaccgatggggcggccgtatgggacggcttcggcgtgtacgcgctccgttccgcggtttcgttggctgtcaccatcgcctgcgtgatctggctgtacatatcctgatatccgccaggggtggatgcgggcagcacgacggtcttggagttgttggattcgctcaaggagcgcagcacgtcgaggtactggttaaacagcaccacattgttcacatcgccgatgttcatgccgacagcctgcaagctcttgatctggtcgacgataccgttggcgatctcgcgacggtagttggcctggccttcaccctgaagacgggtcttctccgcctcggcggcggcctgggtctcaatctggatgcgctgggcctcggcgcgctgccgggtggcctccttctcacgctgggctgcgttgatggaatccatggcgttcttgacctgcgggctcgggtcaatggcggtgatcagggtcttgaccacggtgaagccgaagcgggacatctcgttgccgacggtcttctgcacgtcgaaggccacgtcgtccttacgggcgaaagcatcatcgaggctcaacgcaggaatggcggaacgcagggcgtcttccatgtaggagcgcagctgcccggccgggtcgcgcagctcgtagtaggcggtggccacgttttccgggttcacacggaactgggtggaggcgacgaccgtgacgaacacattgtcgagggttttggtctccagctgcacattgagctggttgacgcgcatgttggttttcatggcgatacggtccacgaacgggatacggatgtggatgcccgcgaactggaccttgttgaacttgccgaaacgttcgatgatgtatgcctgctgctgcggcacgatgaacaacgtggacaggaacaggaacgcgatgatcagcgcaatgacaaggagcgctacaaggaacggcatggcattactcccttctttggtttctctttaaaggtcttgtcgcatgacctttcgtaggttctgcaaccattgccgaacccgagtaaaaatttaccaaagaatgcaatcgtatgcagacaatgtccgcgagctgggcaagggccgtccacgaaccaaccatcgcctgtccaggagctgacccacatacgcccacgagccggacagaggggcgctttcccctgtccggttcgtgagatagcgtgccagttaatattcaaatccctaccgatagcaaaactttcaggcatatacgtgttgcgcgaaggtgaacagactctcgccggcgtgacgcttgagatagttctcgtacgcgatgtcgaaggcttggccgagatcctcaatgagatcctgcttgtcttcgatgccgactgcgagacgcaccagttcgtcggtgatgccgaccttcagacgctcctcgcgcggcagttcgaaatgcgtcatgcggcacggcagttcggcaagcgattccaccgcgcccagagacaccgccaaacggaagatatacaggttgtcgagcacgtccgcagggtcgacgcccggcaccacttcgaagctcagtacggcaccaccgcccttgagaccgttggaggccagctcgtattcgtgaccgggcagtcccggataatgcacggacttgaccaacgggtgcagcagcagatagctggaaatcgcacgcgcgttctcctgctgacggtccatgcgcaaggcaagcgtctggatgccgcgacgcaccgaatcgcattcgttcggcgcgagcacgccacccaaacggttctgcgcgaagtagacgcgcttgcccagctcatcgtccttgaccaccacgaggccggcgttgacttcggaatggccggccagatacttggtggcggaatggatgacgatgtcggcgccttggtcgagcggctgctgcagatacggggtgacgaatgtgttgtcgacgatggcgatcgcgccatgacggtgggcgatttcggcaatggccgtcacgttgttgacttgcagaagcgggttggtgagcacttcgaagtacacggccttggccggacatccatgcgcattgcccttggcggattcgccggacaccgccgcatcgagcgcctcgtaatcggtggtgtccacttcctctacgatgacgccccaacgttcgaaatactcgtggaacagcgagtaggtgccgccgtagatgttcttgccgacgataatacggtcgcctggtcggaagatcgacagcaccgcgtggatggcggccaggccggaaccgaacgcgaaaccgcgcgtgccatgctccagctgcgcgatctgcttctccaggaactcgcgcgtcggattgccgctgcgcgcgtaatcccagcggggcatggtcccgaccgattcgaaagcataggtggacgagttgtagatcggcgggttcacggctccggtgttgttgtcgttgaccggcagtccgtggacgagctgagtgttgaatctggtcatggtgcgcaccccctcggtgtggtttccttgccgcgtgccgttcacgcgatcgctggttcctacttaaccgtgtcttggaaagcgccacgcgccggagattatcgacgttgcttatacaacgtgcgaatcgccatagcgtttatttatgaggggttatcggatggtacgaaacctccggaaacatacacccgcgtggactgtaaacggtttcgaaggatgtgacataaccggcccggaatcggcatgaaaaagccttccgcggcgtgtgccacggaaggcttggaaacaggattgacggacggcaggccgccgtcaggtcaggtaagaatcaaagctggccgccttcgaccacaatgtcatccgggttgacgtcggagccgtacaccggcttcaaagtctcctcgtaatccttgtggaagaagttctccttgccgagcttcacgatctcgtcgttgatccagttgagcagctccttgttgcccttctgcacggccggcgcgatgatgtcttcgtcaccgagcttggtgatgcccaccttgaagcccttgttggtcttggcccaggccagcacctcggtgttgtcggtggagaaggcgtcgccacggccgtcgagcagcgcgttgtaggcgtcggcgtactggtcgtacttctgcagcttgacgtcgggttcgttcttctcgaaatagctttcggcggtggtgcccttggcgatgatcagcgtcttgcccttgagctggctcacgtcggtgatttcggcgttctccggggagaccacgccgagcgcgaccttcatgtacggcttggcgaagtcgaccttctccttgcgctcgtcggtgacggtgaagttggccagcgtgatgtccaccttgttggacgtgagcacatccacacgggcggccggatcgacggacgtgtacttgaccttcacgcccagatccttggcgagacgctcggcgaagacgatgtcgtagccggcgttcttgccgtccttgtcgatgtagccgaacggggccttgtcggagaagacggccactttgagcacgccggacttcttgatctcgtccagggagcgggcggtcaccttggacgtggtgacgccgccgttggaggcgttgttctcctcgctcggggtggcggcgttgggaccgcaggcagccacggaggcggccatgatcaacgcggccgatgcggccacgatgctcttgattgtcttgttgatgattgatgcggtcatggttactcctctcttgtacggatgactgctatcaaaacttgcgattactcggcggaagttcccgtcggttccgccggcttgcgatgcctgtcgaattcgaacgtgtgcaagaaacgcttggcacgctcggttttcggattggtgaagaacgcttcggcgtcgtcggattgttccacgatgccgccgtcctccagcatgatcacctggtcggcgatggctcgtgcgaattgcatttcgtgcgtcacgatgagcatggtctggccggaatcggcgagttccagcatcacgtcaagcacctcgcgcaccatttccggatcaagcgcggcggtgacctcgtcgaacagcagcacttccggatgcaggatcagcgcacggcagatggccacgcgctggcgttggcctccggacagctcatgcggccaggcatccttgcggtcggcgagtccgacgcgttccagcagagcgatggcttccttctcgacctccgccttgtcgcgcttctgcacgagcgtcggagcgagcgtgatgttgccgagcacggttttgttggggaacaggtcgtagctttggaacaccatgccgacacgcgtgcgcagctcgctgccgcgcttgctgcggccggccgattcggtgcccggcttgccggtttcgataatctcgccgttcagcgcgatggtgccgccctgaatcggctcaagacctgcgatggtgcgcagcaacgtcgacttgcccgatccggacgggccgacgatgacgaacaccttgccgtggggcacgtcgaaggagatgtcgtccagcactggcttgtcggcattggcgtaccgcttgaccagatgcctgatttcaaggcttgtctgcgatttcccgctgttttgcgcggtctgcgtaacctgttcagcctgctcagtcatgcttccacctcttttccaacctgcgggccacgatggacagcggccagcacacgatgaagtacatgaagaaaatcgttccgtaaatccacaaagtgcccgtcggatactggaaacggttcgcgtcgatgatctgctggcccaccttgatgacttccaccacgccgagcagcacggccaatgacgtggtcttcacgatacgcgtggcgaggttcacggaagccggcagcagccggcgcaacgcctgcggcagaatcactttcgtgaacgtctgccagccgctcaatcccaaaacgtacgacgactcgtactgcgccttcggaatcgattcgagcgcaccacgcaccagatcgcccagttcagcgccgccccacaaaacgaagacgaacacgcatgcgccggtcgcatccaaattccaattccacgcctgcgcgaaaccgtagaaggcgatgaacagcagcgccagctgtggcatgatgcggatgaaatccagataaatcctggtcatcacccgcacaacgggatttttcatcgtcatcagccagccgacgatcaggccgactggcacggacaacgccacggacacgccggcgatccacaccgtgacccacaggccctgtagcaggcgcggaatcacgcccggctcgagcagaatctcagcgccgctcatagtcgaacctccgttccagccaagtaccgaacagcgagatcggcagcagaatcaccagatacgccacaatcagcaggaacagcgactcataggtgtcgtagtacatgccgatcaggtccttggccatgtacatcacgtcggcgagcgcgatggcggacaccacggacgattccttgatgaggaagatcacattggccacgacgcctggaatggaggtgctgatggcctgtggaatgaccacgcggcttaatgtctgccatttgctcaagcccagcacgtatgcggattcgcgctgcacttccggaatggtctccaggccgccgcgcatcgcttcggccatataggagccgccgaggaagccgagtccgacgatggcgcacagttccgcggaccagacgagtccgagtttcggcaggccaaaatacaggaagtacagctgcaccagcaacggcgtgttacggctcagctcgatgtagacgcgcacgacctgccgcaggacggggatgcgcgcgatctcgatgccggcgcagaccaagccgaccacgatcgccaggatgatgccgaagacggaaatgaacagcgtcatttcggcaccgctgacgaagaacggcgcgtagtgcgagatgaacgtccagtcgaacacgcgcgcctccttctcttctcaacggatttttcgtatttgttccggcgaacgcggctcatactatcgctttattcgccactacgagccagtttcgttatcggtttttcgtataaggacttatcaggtatcgcaaaacagtcgtcctgcgatccctccaaggttcttctacagtatggcatgttggcggattgcgccgtcggcgcatatcgaaatgtgaagattgggtatgccttgcgagagagtatgcacatgctcattcgacatgcaacgatggaggatctggacgcgatcgaggctgtggaggccgcctgcttcccacctgcggaggccgcaagcaacgaaagccttaccgcacgcgtggccgcttatccggaccatttctggctgttggtcaacaccgatgacgacgataccccgttcccctcgcgtgtagaggatggcacgttggttggtttcgtcgatggcatggccacaaacgagccgaatcttgccgatgccatgtatgacgacgccgatatgcatgacgagcatggcgattggcagatgattttcggcgtggatgtggcacccgtctaccagcatcgcggctgcgccagctatctgctgcgccaggtgattctcgacgcggcacaggccggacgcaagggcctcgtgctcacctgcaaggaacggctggtcgatttttacgcacggctgggattcgtggacgaaggactgtccgagtcgacgcatggcaacgtggtctggcatcagatgaggctcgcgctgacgcacgccgtcggcacgggaaaccctactgcgaacggctccgccaagaccgcggagcgtaccaatgatgcggatacgaccgccatgagcggcgtggaccacgacgcggaaaccttggagtttccgcaggtcgaacccaccgcgtgaagaacggccggcgaacttcacgtgaacatcgcgacacgccgacgatttgcattccgccgagaatccacgtaagttagcactcgcttcgggcggttggcgcagaggtagcgcacttccctgacacggaaggggtcacaagttcgaatcttgtatcgcccaccatcctgccgttacgtatgatgatccaattggaatcctggtacagggttacggaatcccacagctggctcatcggaggcaactgcttgacaagcatgacaggagttccggcggtgatgccactgatcggaatgcgggcgatcggaatccacacggtaccggaattgttcaggatactacccgacggaaccgtgggatcagccgccgtgccactggtggcggtgcccttcaacacagcgagcgcgatcgtttcgatgttgttcgagtctcgcgtgtatttcacgcagattaggtcgttgcggttccgtcctgtgactccgctttcgatggtgacggtttccgccgcggtgacgcgtgcgtatcgtccttcgatcacaaggttgaggaccgggatgagcgctttgtttgctgactgcatggtcacggcggggaatttgccgtcgctgccttgcagcaggtagttgccgtttccgaccagtccggcctgcatggctccttggtcgctggatgtgatgtgcggagcgccggccttgccggtgatgagattcatggtcatggtcattccttcctatctgttgtgttgttgaggtatgcggcgtaggcggcgtcctgcgtggctgccagcgctttgaacgtctgccagcatgcggtacagacgagcgcgccctgtgcgactccgtcgacggtggtgtgggtgatgtcgtgccagtcgctggaggtgcgtgggtcaccgtcggcgaggtatgcggaggcgtggcatcggtcgcaggtgtatctggtgatgttcgtggttcgtgccattgatgttcctttctctttcagactgtgcgctggtagatgtgtcctggaaggatggtgttgcattccttccaagtgccgccgtaggtggttcccggatttgttgtggcggtggtccagtagagggagccgaccgggtgggcggcgatgaacgcctggcttgcgctcatgcccgtctcgcccttgtcgcccttcgggccgacgaggcttgtgttggaaaccggtttgaacgtcacgtttttcccggtggctgtgatctgtgcgtacatcaggttcttgccgccattggtcatggcgaagaagtattcgcctacgaccggggcacggttgaaactgagtgcccgccagtcaaaatccgagcatgcggacgtccagtatccggatagtatgcgtgtgatgatcaaggcaggcaacccggtctcgccgcgttggccggcctctcctttcgctccggtggccccggtcgcgccagtggcgccggcagggccctgcggtccttgcactccctgcttgccttgcggtccggtgtcgcccttggggcctttgacgttgccgagcagaatcttcgtcatatgcgctccttactttccgtcattgatcatgtagtacaggtcgcccgtcgccggatcgtaggagacgggagcttctgacgcggtggtcgtatccgcgtacacggcgtacaggtctccgttcgggtcgacctgcagtgtgaagaatccggaggttggtgccgtcacgccgctggcaccctgcggtcctgtcggtccctgtgggccctgcagtccctgcacaccttgtattccctgcttgccttgcggcccggtggggcctgttgctccggtaggtccggcaggaccagtcggacctaccgggccagtgggaccggtggggcctccttctccggaggggccgacatcgcctttgtcacccttgtcgcccttcagcccttcaggaccttgcggaccggtaggtccggcagctccagtggctcctttaggcccgatctcgccggtatcgcccttcacaccttgcgggccgacgtcacccttcggaccctgcgggccgacagggccttgcgctccgatgatggactgcctggaaaccgtcttcccttggaactggccgccggattgcgaaacgcactgccagatgatgctgtattttccgccacctgacaatgcggtcgaatattcattgacgagtggtgttcggttcaaccattcgctcacgtttcccgtgaatatggcgcctgccggatattcgccaacgagtatctttttcatcacgagcgccggaaggccgacgtcgcctttaacgccctggacgccttgcttgccttgtgggccagtgtcaccagtatcgcccttaggtccttggggaccgacggctcccgtatcgcctttcattccttgcttgccttgcggcccggtgtcaccggtatcgcccttgtctcctttggggcctttgatattaccgattagaagcctggtcattaatcacctttctggtatatccacatacaggtcgccgctcttgggatcccaagtgaacgatggtgggctcgtattatccggataattcacatataggtcaccgtcgccttccatgctgagtgtgaagaagccgttcgagggagcggatatgccgctgtcgcccttttcacctctttcgccctgcggaccttggatgccttggactccttgtattccctgcttgccttgcggaccaaccggtccgaccggtccttgcgggccggtggaccccgttagaccggttggacctgcggggccttgcggccctgtaggaccggccgctccagcgtcgcccttctccccgcgcaggccctgcagaccttgtggcccctccgggcctgccaagccctgtggaccgcgttcaccggccgctccagtcgctcctctggacccggtatcacccttctcgcctttttcgccttgcggcccctgatcgcctttctcaccttttggcccctgcgcgccctgaccgcctgtcggaagccccaggttcagggtcttgtcgctgccatctccggtaagcgacgcgctggcctgcgcgcctggtgcgagcgtgtccaccgaaccgattctcaggccggtgatgtagtcgcctttcggctgcttgcccgccaacgccgtattaagcgcaccgatgtcctgtctggtcacgtcggcgctgaaggtccaattatcaagcttgaggccggctccagcgtagtaggcgtggccaccatccccgatggaggattctccgctgttgccgccggcgctggcgcctccggattcgtaggtgacggtgagcacgcctcccgaaaccttgacgatcttcttggagatctcggcagtgacgacgaggcccgtgttgttgtcacggcccgtgaccaggtcgccgacgtccgcgtcgatgccgtcgggaatgtccacgtcgatggtgctggtgttccgaagttcctggaatttctgcctgcccttgtcctcgagctcgtcggcttcggcgttggacaactcgtatgtggcggtgcgttcgtcaaggcctttgagggtctgcgtgtggctgaacgtgccgttcgcgtcggcgtaccagtggatgacggtacggtccttgagttcgcccttgcccaggcagatgagatggttgatcgggtgcgccgcctgtttggcggtgaagtcgatgaggtccgagtcgatgctgtcgccgatcgtgcggacgggcatggcgctcatggccaccttgtcgccgtcattacgcaaccggagtttgagtccgcttgccctgagcatcttgaccagaccgctgtacaggtccacgtaccggtcgaactggcaggtggtcttgtggtcggcgctttcgtcggtgacggtgaacaggccttgcaatcccgcacggctgacgagcgtgcgcatgatgacgggaatcgtgccggacagagtgaggtaatcgttgttcccgtccggttcgatgatcttcgaggcgagcactccatgccagtcgcggccatgccatgtgacggtggacaggcctccgtccacgtcgacatccgtgtcgtcgatgatgccgccgtactcggtgccgtcgatcatgatgcggctccccgccttgagcgcggcgtcttcgacctgcaggtcgaagtcgttctccccgctaccgaacgcgaggtcgagcgtgtatgaggcgtggctcgccacgggtttgcctgtggcgtcggtgacgatcaggtccatggcggttcgctcctttcctcgcagaccgtcaagtcgaattggaatcctcccggccagctgatcggctgtgttccgggcgcgagcggttggaacacgtaccggccggaatccttgcccgaccctcgcacggcctgcgcgaagcagtttgtggcgagacctgtgccgctgaccatggtgacggtcctgacatcgccggtgccgtcgatttccagacgcgagccggatggcacggtcacgtcgacctcgtaccggttgtttccgatgatgacgtacggttgcgcgcatggtccgaatatcgtgagtttgaccggctgcgggatggacgtgtcgttgacgatctcggcacccaatgccatgccggcgaaatcatgcggataatcatatggatagtcaaggtcggcggttccggaatcgtatcgcggcgtgaaatgcgtcatggtcggacggcgccacacgccatcggccagcacgatggtcaactgcgtctcgaccatcgtgggcgtgatggattgcggttcgcttttcgtgatccacgctttggcttcccattcgccgtcggccacgagcgtgcccgggttcccggatgccatgtcggcgtccgcgaggcggcgcagtaggtcgagcgtggctggagaatcgtggatcttcacggtgactgtcgcctcgcgtgccttgcgggtgatgcccgtcatgccacgtgaggcgaggctgtagtcccagacgcgggcgcgcagtcccgtgagcgtctcgccgtacagcggcccctcgaagccgatgcgctcacctgtggccgcgcacacgtattcaagcgattgcacttctcaccttccttgcgaagtcgcggtcccctatcgtcggcgtgtacctggcgatgatcgatccgaggtcgtcgtgcaacgattcgacggccgtgatgagttcccgcagatcgccgtcgccggcattggcgccggtgccggccgtgacgttcagcctgccggtcttcgaccagtccgcgtcggagaggctcatcgtggagacgagcgaatccatggaacggctgaccacatgcgcggaatcgtcgatgcccaatgccatgccacgtccgaccatcacgccgacctcgtcgcggaacacacgcgacggggaatggatgcccaaagcgttcttggccttgtccaccaagcccgacaacgcgttggtgatgctggaatacaacgagccgaccattcctgtgatgccgttgatcaatccctggatgatgttgcgtcccgcgctgacgagccagcttcccgcgccggacaccgcgctccggacggttccgccgatcccgctcacgacgctcccgacacggccaaccatgttgcttacggtgccgacgatgccgccccagacgctcgacacaatgcttccgacgccattccacaacgcggcccacacgctccggattgtcgagcatgcggcggataccactccgctgaccatgccgatgccggcggagacgacgccttggatgccgccccacactgccgacgcgatgccctggatggccgaccacgcggcgctccagttcccgttgacgaccgcgagcgccagttggatgatgccttggatgacggcgagtgcggtgctgatgactgtggcgatgatggtccatgcgccttgtacgacggtggatatggtgttccagagtccgttccagaccgtgctgatgattgtgacggcggtttggaagatggtttggatgttctgtattccggcttgcaggagtggtgtgatggtggtgatgaatgtttggatgccggtgatgatcgcggtgagcgcggtcatgatgatggggccgatcgtgttccagacgttttggaggacggtggtgatgagtgtccatccggtttgccagatttgttggatttggctcatggtctgggtgatgaatatggcgatggcttgcaggattggctggcatgcggtgctgatctggttccagattcccatgaaccatgtggcgaaactgttccagagtcgtttgcccgtttcggtttgggtgaagaaccatgtcagcgcggccacgaccgcgccgatggccacgacaagcatgccgatcggattcgcatccaaggcagcgctgaatgccagctgcacggcggtagcagccttggtcaccgcgctccacgccgattgagctgccttgacaatattgaacgagccggcgagttgcttcagtgctccagccgcgcttcccgcgtcggagatcttgccaatcaaatcgaacgtggccgtagcggtcttctccacaccggaggcagtcgcggaaatggccttcagtccaccggaaactgtcttcagcccggccgagacgatatcccagcctttgaccgcgagcaatgcaatggtgatggctttcaacgcgccggataccagtgcgccgttctgctgcgcccactgtccgaccgactgcagccagcctcccaccgtcatgagcacgccggtcaaagtgttcaacagtccggcgaagctctgcgccgcggaactggcggtgcgcgcgctgtcgttgaagccgaaggcctgcgagaccgcggccgccaatacggaaaccagcgagcccaatccggagatgacgccggtcaggctttcaaggaacggctgcaacgcgcccgtctcgatgaacgtgttgacgaacgtcttcgcccatcccgccgcgttcgacaacgcctgcgcgaccgaagcgaccactcccgcgagcgcgccggcggttgtggagaacattgtggcggcttcgccgccattgttgagtccgcctatgagtgatgtgattgcgttccagaggccagtgagttggcttttgaggctggccgtcgccgaggcgagcatctggaagccggggatgttggagatcgtgtcgccaaggtttttgagtttcgcctgtgtggcgggtatcgcgttctcgagaccttgttggagtgccgctccgactttttgcagggttggtgtgacggctgcggtgaatgtatcgatgagtgggatggcttggttgaacaggccgcgtaagccgtcgaggactggtgtggcggctgtttctccgagtcggctcaacgcggctttcacgttggccagggcgccggtgaatgtggtgcctgcggatagtgcggcgccgcctaggccttcctgcatggcgtcggcgaaggtttggaagtcgatcttgccgtccgagaccatgtcggacacttcggcgctggtcttgttcagatgcttgccgagcatctggaggaccgggatgccgctcgacatgagctggagcatgtcgtcgccctggagcttgcctcgggcggcgaccgagccgaagatcatgccgatgtcggtcaggctacggccgctgatctgcgcagtgtcggcgacggtcttgaggacctgtgtgagctcgccgccctccttgacgccggaggcggacaggctggccgcgacggtcgcggcgtcacccaatccgaacgcggtgcccttgacggatgcgagcgcgtcgttcatgatctcggtgacgctcgcgctgtcgtggccgaggcctttgagcttggcctgcgcgttctcgatgttgagggcgcgcgtgaagccgcccttggcggccaatgcggtgatgccgcctgcgatggtggcgatcgcgcctgtgccgaccttgccgattttgccgaacgcgccgccgatcttcgagatgagggtgttggagcctttcctggaggctttgctgacggcgtcgccgatgtcgccttcgatgcttttgccgaatcctttgccggatggttcgacgtggacgtatgcgacgccgatgtcctgtgctgccatcgtgtttccttattcgtaggttgggattccgatggcggtcggagtcagaggtcgtcgttgatgtggaagtaggctttgagccgttccctgtcctcgcgttgacggcgggtgaggttgtgcgtcggggttggcgggcggagcgggtcgtgctcgtggtcgaaccatgggcgtttgcgttgtccggacagcgtccagaccgcctgttcggctccgtcgggcgcgtagacggcgttctgcaacgccatccacgagtggctcgtatggtctttgaggatttcgcgggtcaacgcccaggcgagtccccaatcgactcgtggactttggccttcaacccattcccggaagcgtacgggcctgtagatctgcccgtacgctcggatccagtcgtaggctagtgccgcgcgattgttgttccagaggtgggcgaggtaaacgcttttgggtccagtccggattcctcggcccacgccttgatggtcgcggtgaggtaggccatcggacgtttggtcttgcgcagcacgttccagaagttcggctgcatcgtctggaagtaggcgaggaacgtgctcacgcaggccgtggtttcctcgtcggacaatgcgggcttgcttttgatcaggaggatggcctgcacgagttcgatgggcagttccgcgttgttgaggttcggcaggtcgagtttcgctccggcgacctcgaggtgcacgtcgggtttgagctcctccgcgtcggtaaggtccacgtccacgacatggtaggtgttgtcgctcatttcgtctccgtttcatggttatcggcggttatgggtaatggtcccgtgcggccgaccgccatcggccgcacgggaagaatcaatgggctacttggcgtcttcggtgacgaggccccatgcgtggaactgttcgccgttagtgcccttgagcatcttgaacgtcatgctgaagttcatgatctcgctggatttcaggctcacgtcgtcgcggtcggacaccttcgcgttggtgccgtacaggaggaaggggcggtcctgctggtcgagcgcgaccaggacgaggatccattccttcttcaggccggcgcccttgatgctgatgccgccgtcggattccacgtccacgtcgaagtaggcggataccacgtccttgcggccttccatcgcggcgagctggagcgtccagtagcccgggtccgtgtcggacaggacgatgtcgccgttgtgcgccttgtagtcggtgctgtcgcccggctccggatgcaggacggcgccgtcctcggtgctgtatccgatcggcttcttgttggacggcggcgtccagttcacgccggtcggcgcgacgaaagtgctgtcgcccttggggaacaggaacagcgcgtagttcttgatcagacgcacgttgccggcggtattgccgttggacacgtacccatagtcggtcgatccgagcccgtcctgcaggctggtttcggatgccgtctgttcgacggcgatgggttcttcgttgctgtcagacattcctgtctgcacctcgcttccgttctgcgtgtggcggcacgtctttgcttgtcttttcttgtgttttcagttcaggcgacggatacctcgagcaggagcacgccgtacgcgctcaccagtctcttgtcctcgtcggtcatgcgtaccggcccggattccagtgacgcgctgatgagcggcgcgacggttccgagcctgatgatctccctcgcgattgccgcccacaggcgggcggccttgtcccagtcgcccgtatggtcctctctcatgcagcgcacgctcagccgcagtcgcacggcctgggagatgggagtgctcatgccttgcatggagtcggccaatgtggcttcggtgaagggaggttcgaggtcgttgcgttcgatcgtgtcgaacgtcacgtccgggaacagctcccgcagcctgggcaggagcagcggctccgtgcgccgtggggtgatggggatgctcatacgcgcatccttccgagcgtgtcctccaatgtgccgttcgcctgctccacgggtgcggggcagaggatggccacgccgtttcggttcgcgccgttatggtcgcgaaccatgcaccggctgtcggtgacggcctcgttggcggcgtcgcgcatgcggccccgcagggtctcgttcttcagcacctgctggctgaatgcctttcggttgaacacgaatctgcatcgtttggccatgggttatccttcccgttcgcccacggtgatgacgtcgccgatgtggcgtccgtggatgttgttccacacttgcggttcgcctttgacgggcaggaggatgcctctgactttgatcaggtcggtggcttggatgcctgtcggctggctaccgcggatgtggatcgtgtattcgatggtctgcgggctggcgttctcctcggtctggtcggtggtagaggttggcgcgaccatcgcctggaacgtgccgacgcggacgggtttgccctggatggggttgccgtccgtgtcggtggtggactggccgcgccacacttcgatggtttccactaggacgtctcccccgttgccatgtcgacgctgaacgcgcgctgagcgttgatgccaaggatgcgtttctcgtcgtcgcgcagccagagatcgccggtgggcgctccgaaactgtattgttcgctgaagctgccggtggtctggttcatctgcgtgatgccgccgggaatgtcgtacgggtcggcctgcatgattctgcggacgatgtcgcatgtgatcttcgtcagcaggcgtggccgttctttttggagacgttgccagttcggggagcgttccttgatgtagtcggtcacgtccgcgagatgcgtgtcggccttctcacgttcctcgtcggtgagtttgtgccacctctgttcgaggtcgacggaggtggcgaacacgtctggttcgtccgtcatgtcggactccgtcaggcggtgagcaggacgaagcggttgatgtcgcggatacggaagccgacctcgatttcgattcgcacggcgaacatgttgtgctcccacaggttgacctgcttgccgtcgatggtgatggacgcctggtcggagatgctggtctgcattccttcgacggaaccccatgcggcggaggagaattcgccgcacacgccgaggatctctgccttggccggtcccggtgtctcggatacggcgggcacgtgaacgcccttgctgatgtaggtgcggttgccgagcacggtgctcacgtcggaggcggcggtgccgttgaggaacagggggcgtccgttgttgtcggtcgcctgccggagcacactgcgaccctgggtgctcaacgcccaaccgtccacggttccatccgcttcggacacgaggtcgtcggctttgttcaggttcttccacacgtccttgccgatgctgacggtctgcgcgctcttcagggtgtcgaagtccgctcccggagcgtcgacgagacccatgatggtcttgtcaaacgtgcgggcgatggcacctggccccttcgcgaccacttggtcgtagagagcgccgaagtctcggcggaactggttggagaacggcatgatgaccgcgatggtgtacggcagcatgtccttcttgccgaaggtgacgccgctcttcggcttctcggcgccctcgttgacccatgcggcctccgggtctccgatgatgatcggcacgcgagcgccgttgccgggcagcttcatttcgggcacgagctgcatgaacgcgctctggtattttgcggtctgccagatctccgcctgggtttcaggggtgaggtctagaccgttgctttttcgggtcatggacggatctgtcatgatttgtcctttcaaatgaatgttttcgctggttgaatcacaggagcgtattgctcatggcgttgacgaagtcctcacggctggagcgtttcgccttggcctgtccggtgcgggcgctctggtccgcaaccgtgccgcgggaacgcatgtcggcgaacaccttcatgagtttctcggcgtattcgccaatctgcttctcgttgtcgcccgcgaggacgctcgggtcggtgatgccgtgtttggccgcgacgttggcgcgtatcgtggagagctccttctcgtgttcggcctgtttggcttcgcttttgagcttctcgttctcctcgagcgccttggagagtttcgattcgaggtcggcagtctgtccggccttctccttgagctcctcgtagtcgcttttcctgccgcgttccctgccgagacgctcgttgattatgcggtcgacttcctcctgggtgaaggtcctcagcttcgcgttgttcacgtcctttggggccggagagtgctgttccggctcctgttggccgtccgcgccggtctggttttcttctgccatggttggtggctcctttgcttgttcttggtttccacgcctgacgccggcgagttgacggccattcttgttggtttcgcgcatggctgcgccccgccccatcgctggggtgtgaaaggtaaaagaaaagccatcacgtttcgacgtgatggctttctgggattcagagatttcccagcgcttttcttcgcgcgtattcggaccgcagctcgtcggtcgacacatagtcgccgacggaccagcgcttctttccttcgttcctgacccattcatattcgtcctgcggcatggagatatcgccatacttgcgtttgatttccgcaagatggcgctcatcggtgacttccttcaaatcaccgggcataaacgtgaaacggtcggaacgatccataggctcaatcatagcagtctcagataaacgatcggtctgccgtcggatgctccaagcccttcgaaacgaagagcccttcctctcggcagaagaatttcgtattctcccggatgctgagtgatcggctccacatacacgccggcgcttcccggcggtaccaggattcttgtggcgatgcggtcttccccatcaacgtcaatgcctccctccttgatgctggtggccatgtagccgatgtgttcgaaggtgcgaccggtattcaaatcgaaaagcgactccatgtcgttgacgtggaacgtcgacaaccgcatctgcctgtcgaccgtgaaacgttctcgggtgatatggtcggatatcgcttcgtcgatgcattcgacctgatggatgacgtctttcgacgggtttcgtccgccgaacaggtagccgttgatacttttgtagctgtctccggtccaatccatcaaagccgcgatcttctcgtcgttggagaatctatctccaggcatcctgacgctataatccgacaatctcgatagttcggaagcactgattggaatcgatttgccgctccatcgaatcgtcggttgggcagtcacaccatcattgacctcatcgtgatagatgcgtctcaattgggctagcgtgtcacgccagtcgccgtcatcgccggccgcagccttggctgcctggtacatttcacgatacttgtccggatcgtatcctttgagtttgctgctgccccagcttggcacgatgtcgcagtcgcagtccgtatggtattgcatctgccgtccggcggtgtcctcgctcaggtaggcgaagccacgcgaggcgagcataaggcagaacgcgcatgtcttagcccctcgcggcacacgcgcccagcgaggcttggtgggatcgttggccacagccctctgcatggtcagccgcccgacggtctgaatcagattctgcacgtattccagcgcctgctcctcgtcagcgaacgtgggccacaggtcgtcgatggttcttccggcgttgttgtgaacggctccgttttcatctggaatgacatccttgtagtgcaatcccatgaagtcagtgttgttgaaaccgccttccatctgccagaccgcgcggtcggcggtgatggaaggcggctcgtattccggcatatcgattccgccgtactgcgcccacaggtcgcgtacgtggccgtagtagtcggatgcgagcctgctggcggcgtcggcataccggttgatctccgctttgatgagctcctggctttcaccgtcccagacgaggcccgagacactgttgccggcctccttctgcaggcggctcatggtgtccgtgtaatcctcgtacaaatcattgaggtcgagttcaagccttctgcgtcgttccggcggcaggttcagactgttcaggctcatctccgccgccttccggtagtttgaggctgaccggcgtcatgccggtgaattcaatgcctttcagtccaagcatcgatgccgcggattccggtgtcaccccggctctgatcgctactcccagtgcgtcgaagctgtccttcagccccccccccgcaacagttgattgcgtggaagcgtcggtctggcgttccccgtcgtcctgcgtctgctccgtctgttggcgcatgccgcgaatctggtcgaggacctgtccggcctgggccttgcgctggtcggccttcagccggacgatctcgcttcggctcaatccggcgcgtgtcatgccgacctcgctgttggcgaacgagtcgatgcttccagcgagcttgctgaatgcgtcggcgctcatggagctcgacggcgtgttcgggttcttccagtcgacctgcagtttcatcagctcctcgtcgggcacggatggatcctgcatccgtgccacaagacgggctgcctgcaggatcgattcaccgaaatcgcgatcgcaatggcgcgcctcgatgatcaggtcctcgcgctgcgcctcggtcgcgtcggcggatgtcggattcgcgtcggacacgatgccgagcgagctggcgggaatgttcatcgcgctggcgaacatggcggcccagcttttcagcatcgtcaagtgcgggtccatgctggacgcggccagttgtgtcacggtcggggactgcccgtcgatgtccttgctgatcatgttgtagcgacccatataaagctttaacgcgtcgtccgtgcccaatgaggcgagttcttcggaagtgcctgtcagcaggatttttgggaacgcgtagaattcggcattcgcttcggcgcgcacgatggtgcggttcgcgccgtcgatgatggccatagcgtcccggctgatgcgggagcgtccgaacggtttgacctcggtagccttgtaggcgaggcggaacacactgcactcgttgtcgatggtgggttgctcatcgtccacgcgccaccagtagccgagacggcgctgcacgctgatgttgcggtcgggcatgtagagcacgagtccggtggcctcattgttgtcgtcgacgtcggtgatggccatgcacgccctgacccgccggtcggggtaatcccagacggcggccgagctttccgcggtatgcgtgcggatgagcggtcttccttcgaagtcctggacgacgctgaggaacgaacagccgtgaatgagtgcagtctggatggcctgctgcagaacgctagtgaatccgatgcggctcatgaagtcctgcagttcgaacgggtcgtccacgcccggcgagacgaatccctcgaacacgcaaagctcggcgagcatatccacagccttgcgcgcccacccaagcggcgtgtaatgatccttgatggacttcggcacagtcagtccaaaatcaaccagtggctccttggcctcgtagtaagcggtgagtgttcggttgcggctcgcatggcgcgtccacacctcggcgagttcacgcagcaacgcgttctcctcaccggagagtccgtcgatgtgcgtcggtacgacgagtttcggcaccgttccggctcctcccgtaggtttccacccgtccggcgctgccgttgtctggatgtcgctcatttagattcctccgatgatctgtcgtcttcccggatgtcgcttcgtcgtgcacgccccgtacagggcgagtgtggtggacacgagcggggttatgtcgatgtcactgccgagtttgttccaggcgatcgcgccggactgtcccaatgggcgcgtggtcgcgcccttgacggctgcggccagctgcgactggtattcgtcccgcggatgcttgagcgttccggctttgagcatgtcgaggaaccggccacatgcgcggcccatctcctgcatgttcgtgaccatgaccttcacatgtgctttcttcagttccggcagcaggctcatagcgggcgactgggcgtcgatgaccacgctggcggtcttcggccagcgttcagcgagccagtccacggcccacatggttcccgcctgccgcgcgtccttgatgttcgccatctggacgatggccgaaccgtccgcgtatcgtagcgccgctccgatggtcagcacgctcctgtccggaggcatgtcgatgccgaagctcaccgtgccgccctcgggcacgtcgtcgacggccgcggcctgccacaggtcgggactgatggcgtatgcggtggcggtctcgtcccatatgccaagcgcctcacgacggaatgaatcgtccgacaggttgttgcgcatgcgcatgattgcctgttcgcttgtacgtttcggatagctgggattcgctttagcccactgttcgcggtcgtccggatccgcgtccttgtcggcggcgagctccacgtagaggaggtttccgtcatggttcagcgcatgcatgcgtttctccgtgaacgcatcgcactggtctcccggcttgggtggattgcccatatacacgaccagggggttaggactcgtgttcaaaaccggaatcatgttgtccatcgcgcgcactgtgaggatctgcgcttcgtcgaacacggccacgtccacgctgtgcaatcctcggccgaaaccgttttcgcgggcgccgaacatgatgcggctgccggacgtgaacgtgatctcctgttggccgtttgctctgcgaatgcgttccacgtaccggccgagcactggattatgctccatctcgcacatgtccgcgaatgtctcgtcgctggtgcgcgtatggtgggcggtccagatggctttcaggttcggtgtgagtatcgccttgaggaacaacgcggtgccgacggtgaaggtcttgccgatctgcctgcagctggacagcacggcgccgtccgcgccacacgcatacttgccttccgcgttcttggcgaacagaagccacaagaagccctgctgccacaagtcgaaacggatgccggccttgcgcgcagctttgttgattcgcgtgaactcgctgccgacgatgccttccggctggcggaggaccttggcgatttcagacaatcgacgctccgacatcgtccgtcacctcgtcttcctcatcgtccagcaggtcggtcaggccaccgacctggagcgattcgatgcggtcgcatacggcgatgagctggcggctgatcgcgggcagcgcgttcgccggcgtcgtgggatcggccatggccttgagcagcaggtcacggttgtctcgcagtatgtccagcatgctgccgtccatcatccgttcgaagctccgctggtcgagatcctgctccggcttctgtttcgtttccacggctttgacgggcggcttactgttccggtcctgtgcgggcctgttctttttccgacgataatcggctttctggcggcaggacttggaacagtacttctgaggccgcccgtggccggaaggctggaattccttgccgcagagttcgcacttcatcggcgtaatcctcgctttccgacctttcgttgtttcccctgtttccgacgtttgaatccgcggggagaaatcggcactgcacccgaggcgaccgggagggggcatacccggggtccccgccctggtatcggagtcagatgccgaacgttttgaacggcatcgagcttgctttcacttcctgtctgccagccagcagcgctcgtgcgtgttcgtctgtcttgtcgctcttgaacctgttgcatctgcggtgcgtgagcctgcagttagtgaagctgtatggatcaccgccacgtgagaccggtacgagctcgtcgacttcggcgctcatcggatgtggtgtcttcaatgtcttgtcgactggcttgccacagatggcacacacgtcgtatgcggccagcactcttgccctgagctgtctgcgccgccagccgttgctgacacgctcgttacgccgcttgctcatgtggcctcccacgtgtatgggacccggagtgccgtggatttgccgacgactatcttcgccgttggcttgccggaatgccggtataggggctcccgtatacggccgctcccgtgtcttgtaggggttccccatcatctgcgaatacccctcccggatttgccgatacccctaccccggatttgtttcatgggtgccttcggcgggattcgaacccgcgcatacacgcggccacaaggaagagaatccaataaagactcgcggccggtacgatctaccactgattcctacgaaggcatggacaggcgatttgagcttcaccgcatcacggaagcgcgggattggcttgcctgccacattggggtatgtccactctgacgggagtgggcggagcgtgtccgatatgccgttcggacaggacgggtacgtaacccaaggagtcaggagaatccaaggcggatatgagtgagggttcaaaccaagtcacctcggtttgaaccctctaatccactgacaattctgcgttgcactttcgattttgtcaaatcgaatcgcgccgcagcacctgccgatgcacatccgaaagcctgtacaatggccgtcccttctcgttctcaccggccggctggagcctgccgcgcttgcgccacgaacgaatcgtgttcgcattgcactggaacccgcactcgcgcagcagctccgcgcactcccccgccgtgaacgccctgcccgattcgatgcactcccgcaggaaacccaatcgcacatcgaccacgcgataagtgttgccgcacaccggacagtcaacgcttaccgctccaacctccgcactcagctccacgccgcacagaggattcaggcacctgccgatgccgtgcctggatggcggcacgtcgatgatgcccagcgtcttgcgcgccaaccgctcccagtcatgccaaatcaaaccaatgtccggcagtcggttcaaccgctggcaagaccagcatgccttgagcatgtcagcgactggcgggaccgcgatgcttgtggcccatggcatggccggcggcgcatacaatcgacaccacaacgccgtcaccgcatcctcgatctcctgcagatggtcaacgaccgagagtctgatcggcgtgggcgcggacggcaggttgacacgtccaggctggtggcctccgtaatgcgccgtcgaatccaggaactcgcgcagggcgtggatccagatgggatagtcgtggatccatcccctcaaagtgttctcgcacttgtcgcacatcgtggcttggatacggcactccccgccacacacactacatgttgtggttgcttcccgtttttcgcccatatgttgcgattctagcatttcggccatcctgaatcgaacattagttccatttcgggtattcccgcccacgggtccggattgtcgggatccggccgcatcgtcgggaacccctcaagggtcgaatagtggaattcacttccgctcatgtcggcgggtttgacgctgatgggcatgagcccgcattcatgcgcgccgagatacattccgtccgggctgatgccgagcggtcccgcgaccgtctccaatctgatcgtgtccgtctgcgcgatgcggcggatccggatgagctgccggccgaggatgatcgcggtgaccaggtcgtcgccggcgatgatgccggcgtcccatgactgccagaccacgtcacgttcgctgaagatccaccgtccgcatgagcagacggccggcacgaggtgcgccggattgcccggcggcgcgagccggcgcatccacaatggtggtttacgactcatcccgccaccagtcgacgaggtcggtgatcttccaagctgtttcgaaaagcatcagcatgacgaatcccaggatgagcccggacacctcatcgagaagaccaccaagttttcggatgattcccatcatgattcctacccttatccgaggcttcgtttgatcgatttccagatctggtcgagttcgccgtccggcagaccgctcacacggccacgctggaacagatcggcctggatctgccgttcgttctccggatggttcttcagccttccgtacgcccaggcgtgcaatgtgctgttgcgttggccttccggcaccgggctcatgaccggcacgccatgcgatcgggacgcggccggcctgtcggccatgacatcgtccaggctcaacgacggagcctcctgctttggctcgttcgtgtatccgaaatccttgagcatgcgcatgaccgcatcactcgcctccggcaccacgcccgccggcagatcaaccagctcataccggttcccatcgatgacactgcccggaccaatcacatagcccttgttgctgacgcgcaggtcaattggcagattctgctcatgcacagcgttcttcagcaagctcacatccatgcctgccggcatgcgataatacaagtgcacgccatgcggagtcctggtcaccaacgtggccggcaacgcctgggaaccgtaatcgccagccaacgcctgcagacactgccacccatcaggaccatcagcctcagaaggcttgtcacaatcgatgacgaaacagtcgccaagcggaatgacggcataacgagtcatcttgtcggtgatgaaagtcgaatccgtgtggctctcgtccgacggattcaaccgcttccacgacagcgacaccttcccatcgaccggaccaccagtctttcgcgccttgccctcgcatggcgcgaaaccgacattgccagccaacgcggattcgacgatgccggccagatcatgacagtcgcccacatcatccaacgttttaagactgtcgcggttcggcttcgacaatgccgtctgccaccaagtgtcggcaggctccgtctcgttatcgagagcggccttgcgatacacttcgaagcgattctggtcggcgacgcgcaccacacggcattgactgcccggcagcgccttggtcttcgaattctccaagcccagcacgtccatcaaagactgcggcaccgccgtgtgaaactccttgcgatagtcgttcctggaagcgactggcacgccatactgttcatcgttcgacgcgatctcactgatcagccaatacatctcgtcactgatggtgcgagcaggactaagattcacaatctccggctcatccgaacgctcccacaagcggcacgacagcacgaagaacgctgcgggatgtcgatggcagaacccctcgatcgcatgatattcgtcatacgagcggcctttcgactggtggaattcgaccttaatgaaacgacgcgtatcggaattctcgcctgaatcggcgaactgcatgttcgtcagaatcagcaatgtggccgatggcgtcatcacacgataacggccgcccgtgacgcgggcgttcacctgcgagcctgtcgagagtgcacgcagcaatggcagcatgtcctccgtgacagcgcaagcctcatcgtcaatggcgaaagccttgccgtccatctcatcattcatcgactcgcgccccagagtgtagccaccgccagtgcaatagccctgcacactgaaaccaggaaacactttcccgactccaagcacgccaaggatcgcctggcgggcgatcagcgttttcccgtcaccaccatgaccagacagtacgtatgacaattgtttgaatggctcaagccatggcgtcgcgaacattcggcaaagattcgcgcaggacttctcatcgacggtcaaccattcgagaatgcgcttcgcatccctcaatgcctgattgcccattcctgccggtgagaatgtctgcgtgaccgcaatatccggctcatcctgcagacagacgattcttccttcacggcgcacccacacgcatgggtcgcagcgcacgccgcgttcgacttggtcgaaccattggcttcgcttcgcctcgcgaagaatcgtcgcactgtagagcggattacgctcactgctgcgcgcgttcgtgccgatatggtattcatcctcgatggttttcacgggatgccatgaattgaggatgagcctttcgccctcatggtcggacgtgtctgggtctcgacgccagagcctttgctgtgacgggcagtagcgaagatgcccttcgcggagctcccagatggctttttgatagccggcggccacgactgggattttcttgcgatgttcggtggcagtatcgccaccatcgcagataagttcaaggttgcggccatcgatggtcgcaatgatcgtgcggtcgttcgccggcgcgaaggtgagtgcgagcaggtggaagattcccgcgaattgcgctggcaggtcttcagtgggaatgggcgagtatttgctgtagtttctcatttttcacctcctttttgcggggacggttactcccctatacacacaacacaaaaaacaacaaaaaagacatatatataaaacactttgtccttttgtcctttttctatatatggttgatttttcgtcctttttgggtggactttgcctatgtccccctgtgtccaccacgtccccgcagtgacgttttcgattagcgagacgtcactgcagggatgtggtggggacgttttcctattttttagaattcaggctcttgtccgctgcccgcgccgagcgcgttgacgacctggtcgaccgttttgccgagcagtccggctatctcctgcacgttttttccggcggcctgcagttgggcggcctgctgtcgttcctgcatggtcaggcctgcgggctggccgatggtgactggctggccgtactgcggctgcggcgcatactgttgcggggctgcggcctgcgggtcgttcatcgcggtgttcaagtcggccgtctttttcggtgtgacgacgtagtcgtagattttcgcgtcgttgtagccgcgggtcttcgcgggctgggtgcgggcgaaagtggctttcaagtggtctccgacgttcggatggtcgccgactccagcctgacggcatgcgagacgcaattggccgatgttgtagccttttacgtacacgcctcgaatgccggagtctccgacgcgatttgggtcttgcagtgtggtctgcaggtggatgacgacctgcggcttcggcttgccgttgggatagtagaggggttcgccggtggtgaagtcggtctgctgttccgcgcggatttcgacgatctcgccttccacgctggtgccgatcggatcgtccttgctgaacgcgctgggcgcgccgccctgcatcacgtcgtcaaggcttaacgattcggcggactgctgctgcgcctgttgtggccggtagctggctccgccttgctgagtgaatccgccaccatagttttgcgttccgaacattgtgttttttacctttctgttttcctgtaggtggattccagcaggccgatggcctgccgccatttgtccggcaatgccggatattggttttcgttgagttcggatagttgtccgagctggtcgtccggccagctgccgcattggaagcagtgggtcggactggttggcagagcgtgtatccacgcgtcgcgcatttcggttccatcctcttgttcgatgaggtcgaggaggttggcgatgagttgcgcgcggctgagcgcccaccgtccgggtttcgggtcgaagtcgaattcgatcggcagtgcgtcggccaggctgacgctgttcctgggcaggaagtagatggcgttccttttgcagggttctccgtcgttttccaatccgatgccgtacaggctcgcctggatgcgatattgttggcttggaccgttggctttgacgttgcgaattgtggtggggccggtgattttccagtcgatggtcgtgttgttttccgcgtcgtacaggtcgatgctgccgtggatgagctgatagccgtggagtccgtggatgctgcccacgtcgacgtgtctttcggcttcgaagcgtttcacggcccatggttctcctccatcgtcgtccgggacggtgaattcgtccttgcgcttgttgaacaggtgttcgaatcgttcgtggacgcatgtgccgatgaatggcagccatgcggccgactggcgtttctcccatccggcgagtctggcggcgaggcagtggaggcagtcggtgccgagttcgcttggcccgatctccttttgcaggctgcgtggctggttggcgatgtgcgcctcgatgatcaggcggatttccttccattcgtccgattcccgcgaagcggatggtgtggcatcgacgagtgcggtgcccatgttggctttcatgactgtttcaaggtcgagttgtgagctcatatcccacccttccgcattcctcgtcgagacgggcccagaggaaagccgccaagtcccccgcctcttgtgtgtcgatgatgtaggcttcgtccatgaatccgggcgccttgtcgtaatggtcgagcgtcttgctgagcgcgcggccgaccgcctcctggctgattggaacgcgcgtcattcgaccaccagacttgccgcaccggtcttcacgcacccgcgcaatgctggctcgccgacctggctgacgatttcggacaatgccttcggttggatccgatagcagtcggcgtactgttgcacaggaaagcgccgttcgaatgctctggcatcgaggttgcgcttgcctttccggattttcacggtcaacggtccggcagcgtattcgcctggcccgcggtcttccatgagttcggctttcaatccgtcggcttcttcctgcaggtcggcgatgcggcttttcagttccacgtaccgtttggccaatgtttcgaggttctgcgcgctcatttgcttgttcctttcacgatgatgctggttttggtggggatgacgctggtctggtggtgcgggtaggagcgtcggtgcgtttccacgacgtcgaacgcgggcgtggttcgcatggccggccccaatggtccgcacgtgcggcagtacggcatgtgtcccctctgcttgctcattccacgtcctccacggtcgattgcgtcatgccgtcgtcttcggtggcgggattcgtttcctcgcaccgtcggctgatgatcacggtgttgcaggtccttggattgcgtaggagccggctgatggccgcgccttccttgacgacgttctggcaaatgtcgatgcatttcgcttccggcaggcgtgcccatcagacccttcttttcgatggtctggtccgctttgtcgatgaatgccgcggctgcgtcgccgattttgctggccgccgggtagaggctcgcgaggtcggcgctcatgtcctcgtcgtcgatgagggtctgcacaacgtattcactggtgtttttcatggtgttttctcctatctgggtatgtattcctgtttgaaatagatgcttgcctgtgtgtgtggcgtgtatggctggccgtgccatgtgagcggatcgccgcttttccgtttgcgtggcctgccgtgcgcgccaagcacgtactggtcgggacgatgcacgtgcacgctggcttcgatgatctgccggtcgtccatgtaggcgacgccgttcaacgcgtcggtgaacagtttcgccagattgtcccagtcacgtccgcgccgtgtggccgtccagaatgtgagcgtcaggcagactggcccttcgtagggtggcaggcggggatactggttgcgccattccgagtacacgcggttctcggcctcccgggttttcgccggggtgatgccgtgtccctggtagacgcgtggacggcctttcgactgcgggtctcccggcacggtgagttcgcacaccattggccattccggcaggcttaatgtttcgagactcaatccaggtcactccaatcgggtgttctgccggtggcgaggaagcctccgcgtcgggtccgcgcgttgacgagcaatcccatgccggcgagcctgtgcacgtcgcccatcacggtgctccgggggatgttgagccgtgaggccaccttgtggctgctgggcgtcaccccttccatctgcagtgcgacggtcgtctcgtacacgcgttggatgcgtggcttcacgtcgatgtcacgccgggtgcggcgtctcatccgcgtgatgtactcgcgttcgtcgtggatgagccggtcaaggtcgatgccggtctcctggctccatgtcttcggcgaagtgtggtggccgtggcttcgggatgcgccgtagcggatgctgccacggttgaccggagcgtacttcgcgtgcagttggaggctggtcgcgccgctaggcatcactgtcctcctccatgccgtcgtccctggacgcgaaccgcaccaccagccacaacgcggtggcgagatacacgccctcgaccacaagcgcgcccacaaggctaccgccatgccaggtgagcatgagcgtcacgctggcgacgaggccgacgaccgcgagcaggaacttgaccctgcgcagcggatagttcggccgtctcgcctcgcgttccttccggtcctcgatacggaaatcgttgtcggtcatctggtgcctcccgtttcgttgtggagttggtagtcgaatgtctcaagctcgcccgcggtgatggatgcgagcgtgcaggcgccgtcgggcaggagttccacgagttgggccccgcctttcggactgatgcgaaccgcgtatccgctcatgccaagcatgacgatgctcgccttcggcggttcgggtggcgtcagcagcgtttccacgtcgattctcctgagtgccatcacagctccttgttgatcgtgtcgacgatgagatccacgattccggtgacgtcaaggtcgacgtagccgacgatgtggccgagaggcctcatggccttagcatccccatccgcgaacgcgtggaccagttcgccccgtgtctcgaactcgtcgaacaccgcctgcacgcaggccttgcgaatcgttttcatgccgactcctttccctcgtattcacatgtgctctggtagaggtgttccttgaagtaggcgatcatcggctccttcggatacatgacggtccgtccgaccttcacgaacttcgggccgattcccgcaccacgccagtacgccaaggtgccctccttgatgccgcaacggtccgcgatgtccttcgtcgtgttcatcggtttcaggacctcagcgagcgcagcgaacgtcgtatcgtcttccatcacgcgcctcctttgcgtatgtgatgccgggcggcgttaggagaaccgcccggccccctcctaaaatcggtgtcatcccgcatatgcgacgtgcgggccgaacagttaggagaagaatcaatgtcgaatgcagccgaatacctactgcagttttttgaggtcgagcagcagcccgacggattccggaaggacgtgctgtccgcatacacggccatgtgcagcaccgaaagaacacttgatacgctgatcgcccgtggcgtgaaacgtctcgacatggcgaaatcacagatgcccggtatttggaaagccttgtgggaatcattctcggaggacgcgaacggatatcgtatgaacttcagcacgttggccggtgcgaccgataggttggatgccgcggcggttctggctttgcagaccatcgccgacaggtgggtagagctggatgtgcggatggaggacaaggacagggagaacatctccggcttcctttctgaaatcgagcagtgcctgaaagaggatgtgagcatgccagcggcgttgaagtcgtatgtgcttaatctcacgaccgaggttcgccgatgcgtcaacgattgggagagctgcggctcgttcgagctcaatgacgccatgcagcgtctgcttggagccttgtacatcgccgaatcgcacaccaaggaccaatcccgctggcagaagatcaaggagaaatacatgggtgggatgttcgctgatttcatcgttcagattcccgctcttgctctcgcggcggttccgtacatagcccagatcggcgcatgagcaggtagttcctgttcagttcccgcagcatcacccatctagtgccaatctgcaatccgttgagcagaagggagcagccaagaagaatctggaattgattcagagatttgagtccacaggcaaacatccagattccggatatcgcgcagatgatggacgccaccacgctaagagcgcttggcttggttgcaacaatcatcactcatcccccaacatcgtcatgaattccctcgagtccacttcggcaatcgcggggaagattacgaacgccttcccgtcgcctaagagctcgactctgatcgggtcgtccgttatccatttgccggaatgcgcgaagagatagtcactgatacgcttcgcttttctctgcggaatgttgttgatttcaagacacgcgctcatcacgcacccgcttcctgtgttggtttcgcgaggaacagtttggcgaaatacgtctgccccttgccggtcatcttcggcgtcttgttgatcgtggtgtgcccgtccgagtggctgatggtcgtctccttgacctcgaacaggtgaaggtccatcgccttctgtgtgggcatgttccaactggagcccttggccttgatgagccatccatgctcgcggagccaggcgaacaggcgccgtgggccgatgtcgatgccgttgcttttcaggatcttcgcgaaatcgcccacaaggatggacgtcctcgcggtttcgaccgcgttggcgaacaggaccttgccttcctgggctttgagctgtttggcttgttcgtcgaccttggattgcagccatcgcatgctggccaacgccatctgttccggtgtcatccgttcctggccggccatatagccgccgtgcttgcggatggacggcagcacctcatgcgtcacccaacgctggaactccttggcctccggcttccgagacttcatcacaagacggtaaagaccaggctcggagatgatgagcggagctttaccgccattctgagcaatgtggatactatccacattggtgatttcatcagactcaagaatcttgtgtaagtcccttgtatctgtcccgaggatgtcgcatacgtccttggcgacgaaccagggctcccccgccttatcggtcagggtgcgcaatgaggcgcccttgaaatcgaacttctggatttcattgttcattggattctccctagaatcgagtttgtgaatagttttcttgaggatccggcaggctgggcttcgaccatcatcgccggagcgtctttggcgtggaacgttctgcagcagtttcaaatccactccattcgccgtagggacgatttgtcccaaaccgatttggagccttttcttgattccacgtcgaacagcatcgtgtatttccggcttgttggacctctgacgatgtatgacgtccgaatcccacctcaggcaacgttcggaacaagcccctatacgccgctgttggccaagcggttgagaccgaatcagatctgccataccggcttcaccggcgagaatgcggtgctgctacttcccgatgatttcgagattgagtggcggtcgtcccacatgtcgcgcagtcataagattcgtgtatctctgaccgagataaagaaggaggcgtggaaccgcagctcgaagagtgttcggcagattcgcgagagggcttcgaggccgtaaccaacggttctgcatcagtcgcgttctcgtggcgatgagtcaacgaatcgaatatgccacgcaaggtcgcacacaaaccggaatgacgcttcctgcgggcgagatgccatcccgcatcaacgccagcgagataaaaccacgcatcaccgaagctgcatgggccgtaacttgattcgtcggtgaccacatcgaaatagccggcctgcttcacgtcgtcaatccagtattcggatggaagcacatcaaggcatggccctccgtccgcttcgatggtgcggcatttccagatgagacgcttgaaatcgccagcgttccccggctctttcggaatgctcttatccatccccgtgcagccgttgccgaagtcgacccgttcgagcggttcacctggaatccattctcgaacgtcggatctcttcatcttcctcatttcggattctcctttcgattcactcttcggcgagcgccgcttgctttttcgaagcactctcatttgaggcccttcctgccgagtgggagaatgagcagacccacgcaaagaagggaggtgagaatatgagcaatggatccgatttcgcgaaggcgagcgccgtgttcgggaaggccgctgaaacgtccgatcccgacgagaggatgagagccctgtgccaagggctttccctcctcgccaagggattcgattcgatggatgcttccatggcatccgccgcctactgtctcgacgtgctctcggataagttctgaacggagttcctgtatctccgtgcttagtcggtccgcggcctgattgatgcgctcgagaatcgagcccatgacttcagtcgtcatgtcgcgggccgacaactgccgtccgacctcgatgccgattcctcgcaggtcaaggctggacaggtggctcctcctgtcgtcgcccactgttccgataaccgttcgagctggttcctcgcggacggcttttcttatcgcgcccagcatcgccgggtgcaggcgttcgaactcctcaacggaaatcgggttcgtggattcatccggtgtctcggccggaatgttgatgctcatttcggattctcctttcgattcatgatttggcgagcgccgattgcggttctttttcttctgaatttgctgcaatgaagatgtcaagaccgtcttgccatttcaatgccggagcaatcttgtcgagaacgcgaatcggccattcccgttgattgcgcatgtatcgattcatgacgacccgattgattccaactgcgtcggcgacgtcggattgagtgattccaagtcgagccatcctgacttttattgcctgtgtcacgtattcattgcttgtcacatcacctccattccccgaatattcgggactttgttcgacgtttaccggatattcggtgaacatgctttcaatgtactcccgaatattcggtatggcaaattcgacacaccgaacggtgtaaagatgtaacttcccgaaaattcgaatacagtcatcgctatggatagcagcacaacacgcaccgatctggtgatttgcaaatatatcagccaagcaatggaagccaatggcattacccaggccgacctctccaaggctcttgaaggacgatcaaaaggttatgtcagcgaccgagtactcggtaaaagaagttgggcaattagcgagttagacagactcgctccactctttgggcttccggacgctctttcactggtcgcggcagcctgtgggtcaatctccagcgaggccgcccgcgcctacgaggcccgcgagcgccaaaagatcaccgatgacctggtggatcgcatcgccgcgcatccggaggattacgtcactgccgccaatgacgatccgaacaagatgcttgaggcggagacgccaagagactagatttttttgatgcaaatcaactagggaaagaaggaaaccatgtacaggaagacaatcgcaacggccgtcgccggtctgctcattctcgggcttggcgcatgcggcaacgccagtgacgccaaaaccgccgacgccggcagcacgagccaatcgcagacgacgaagaagccggcagagaagaagccggtagaacagcctgcggatctgaccggcacatggaagcagaccaactccggcagcacggattcctggatggaagccgagataacggccgacacgatcaccgtccagtgggtcagcgacaacggcgatacgaagagcctgtactggaagggctcctacaatgcgccggacaaggccggtgactggaagtggacgagccagggagacaccgcggcgatgcaggcgtccctgctcggctcgcaggacgccaccaaggacttcacctacaccaaggcggacggcgtcagctgggagaccaccgcgatgggcaccaccacagtggtgaagaccgccaagcagtgagcgataggctcagcaagccgctcaaggcgggagctccaaggaactgggtctgcgcgcgtcatacgcggattgaactattagaaataaccgaatagttcaaaaccgttggaaacatcaacaacagaccattttgttgacgtcaacaagatggttgtggaatcggaaggagacaagcatggcggacgaaccacaggaaggccggataatcctctaccaagaggacgggcgcaacgtaccagtcgaagtcacgtactggcgggagacgttctggctcacacagcagaaaatggcagaattgttcaatgttaccgtgccgaccatcaacgagcatctgaaaaacatcttctcatccggcgaactgacagagacgtcaaccattcggaaatctcgaatagttcgacaagaaggttctcgccaggtatcaagagaaatctctttctacaatctcgacgcaatcatcgccgtcggataccgcgtcaacagcagacaggccacacaattccgccaatgggccaccggcatcctacgcgaatacatcgtcaagggattcgccctcaacgacgacatgctcaagaacggcagaccgttcggagacgactatttcgaggaactgctcgaccgcatccgcgacatccgcaccagcgagcgtcggttctggcagaaggtcaccgacctgttcagcgaggtcagctacgactatgccccgaactcgcagacggctagggacttcttcgccagctgccagaacaagatgcactacgccgtcacccatcagaccgccgccgaaatcgtcatggatcgtgtggacgacggcaagccgaacatgggattgactacttggaagggcgctccgaaaggacatccacggtccacggacgtgaccgtggcaaagaactatctgaacgaacgcgagatgaaggcgttgaacacgctcaccaccggtctgctggacctcgtggaggcacgagtactgaaccacaccctcaccagcatggaggaatgcgccacgctgatcgaccagtacatctccctgtcgggcatgccgttgctggaaggcaaaggcaaccgtggacacgagcagatgagacgcaaggccctcgacgagttccacaagtgggatgcggcacgagaaagcgatttcgacaggttcgccaagggattggacggaactggacggtgaacgacgccacattgacgtcctggtcgaagacactgggcgtgcgagtggaggaacgtcggctggccggagacaggtgcgggatctactacgatccgctccgcctcatcatcctcgacgaacgactggccggattccaacgccgctgcaccctctgccacgaactcatccacgccagacaccatgaccccggctgcggtacacgatacggggccaaatgcgagcgtcggtgtcgtagggagaccgcgctggcgttgatcagtccggtggattacggcatggccgaggagatttatgagggcgcggcgtggccgatggcggtcgaattgggtgtgacggtgcaggtgctgatggactaccggcagctgcttcatgattccggcgtgtgcatgcaatagttatacgcctttatacgtgcttatagagccttataccccttcggattccttataaaaaatgaccccggccacccgcataccgcgagcgccggggtgaaaaacatgtgggaagaagcgtcatgaaagtgaccattgatgatctgtggctcaagaatgacgatgatggcaatccgccgagtcgcgcggccaaacgctctttggcgaactcacgcgatccgatgaaggccaatgtgcctgagaagtggcgtaaaagccgttatggagtcgggatgcgctggcgttgtcattggaccatcgtcaaggacggtagacgtgtgcagagggtgaagcagttcgccaggctcgccgaagcgcaggagtatgccgcggccatggaggacgacatccggcggggacgctaccgcgatcctcgtcaggagcttcgtgtcctggatgacgtggccggcgaatggctcgcgtcgaaggttgatctgaaacccggcaccgcaggccggtatgcgagggagctgcgcctgtacatcctgcccaaatggggtggcatgacgttgcgggagctgcgccctgacatgctgcaggagtgggtcggccagctcatggacggtggttatccggccgcgttgccggacggacgtgattcgaagccgctgagcgcgagaagcatccgcaatatcatgaaagtcgtcctcaagggcatctttgactacgccgtctcgaacgggtggatcggtgagaatcctgtggacagggtcaccgtgccgaagatcgtctccgacgacgacatggtgttcctctcggtccgcgaggtcgagttgctcgcggacgaggcggagaagatcgggaagccggtggacggtctgctggtcagatggcaggcctatacgggatgccgcataggcgaatcgcttgccctcaaggtcggtgacgtggacgcggacaggcggcgcgccaggataggccgcacatggactgacgacgggcacggcggcagcatgctcggcacaccgaagaacggcaaggcccgcaacatcgcgataccacggttcctcatgccgcagatcaaggcgcagatggatggcatgggtgatgacgactggctgttccgtgccacccgtggcgggaacgtctggacgaacacgtggcggacaaggatatggaacaaggccgtcaaagcggccggcatggaggacgcgggcgtgaccatacacagtctgcgccacacatacgcgagcttcgcgatcgcccagggcgcggatgtgaagaccctgcagatgcagctcggccattcctctcccagcatcacattgaacacctacacggcgctctggccggaacgattggacgacgtggccgacgcgatcggagccctccgcgagcgcgaactcgtgtgaatcgggcatggaggtaccgcggcgtttgtatgcatttgtatgcggattgttttcgacggaaaaaataagcccttgaaaacctaatgtttccaagggctccggtcgggctgacaggatttgaacctgcgacattctgctcccaaagcagacgcgctaccaaactgcgctacagcccgttcatgcactcccgcacgtggcaggtgaacacgagtttccattgtagcgtatggtaggacaacgacaggctagaatggcaaatactggagggaacgcgcatgggacgtcatcagcaagccgaggcttcaggcatcatttccttcatggcatgcgccactcttgcatggatcgccatggacctatatctgcaattcgctcccgccatctggcgtgtcacccaacgcctgttcaccgtgtgtgccggaatcaccgcgggatgtggagtcatctcgttcaccttggggtatgcgcgcaactccaggtcgatgacgttgaaacatggctggaccattcctattcgctgtatcttcgagatactcgctttgtccgtggtctacgcgtcgaccattttcgtcacggcgttcatgctgctttccattgccagcaacatgatggggttgcgcacgttaaaaggctatctgactgcgctctgcgccgcgatctcgggggtcgtaggctatgtcacgttcgtacaggcggaactcatgaatgccaagaccatcgcatccttgttgccgttcttcgtggtttccggtgtcagcatcgcaggattgacgtccgatgatccatactggtacaacaacaatttctcccaattgggcgatcgaaccacttttgctgctcgtatgttcaattcgacattgatgttggccggcgtctgcatcgtcatcatcagctatttcgcgatttcggagctcatcaccacgcaccgtctgcagatgcagtatctgtctgcaagcgatgaaaaagaagctcccaaacacttcaaggcgcggattcttctgctatcgaccatgctgacgctcgcaggcatcgccttcatcggcatcggcatgttccgttacacgccgcatccgattctgcacaacgtattcgcccgcggtcttccctgcctgatgagcgtgctgatgatcgcgctgccttggctggccccgcagctttcaaaagtagtatatgtgatttcagacctagctatcgtgatcggggctcttgccgggttccagtggttggcggggcgtaacacgttgacgaacgtcgaggctcttgccggcatgatgtttctgggctggttcatcatcttttcacggcagattgcggccatcgaatccgatcgtgtgcagacgcagcttattctggcgcaaaccaagcggccagaatccgtcaaggatcttgcggaggtcagcgaaaccgttcctggaaccgtttcccgactctcgtcggaagtctaattctcgtaacggttcacgagcacagtccacaaacaatacggcgaggtgtcacccgtacggatggcacctcgcctgttctcatggctatcagaaatcgtagttctttgtggtgggctttctatcgctcatcagcaacaggaagcttctcgactgcgccgtgatcgcgaagccggcctcatagttgagttccggacccttcggattatgcgtgtcgacgaccagacgccatttcttgccataccgctcgtccggcaaggtgaacataatcggctcgtaatgcgcgttgaaaatcaggatgaagttattgtccaccatctggttgccataccagtcggcttccggaatatcggaaccgttcagatagatcatcaccgagaacgcgtgggtattggaccaatcttccatgtccatgatggaaccggtgtggtccatccattcgacctgcggaatcttatcgtccgggtctcctggctcgcggccggtgaagaaacgacgacggtggagcaccgggtgctcgagtcgcagatgaatcagcttcgaaacgaactcaagcagatccttctgactatcgtcaagatcccaattggtccatgaaatggcgttgtcctggcaataggcattgttgttgccctgttgcgtgcgtgccacctcatcgccgccgcagatcatcggaatgccctgactgcacagcagcgtcgcgaacatgttgcgcatctgctgttgccgcaggtcgttgacgtccttgatggtggtcgggccttcgacaccgcagttccaggaacggttgttgctttcgccatccctattgccttcgccgttggcgtcgttatgcttctcgttgtagctcaccaaatcgttcatggtgaagccatcatgtgcggtgatgaagttcacggaagccaccggacggcggccgttcatctgatacaggtcggagctgcccatcagacggctggcgaattccggtagcgtcgatggttgcgaacgccagaagtcacgcacgcaatcacggtagcggccgttccattcggaccagctggacgggaagccgcccacctgatagccgccggaacccaaatcccaaggttcggcgatgagcttgacacgggagatgaccggatcctgttcgacgatgtcgaagaaggcggacagcttgtcgacttcctggaactggcgggccagcgtggccgcaagatcgaatcggaaaccatcgacatgcatttcggtgacccagtagcgcaggctgtccgtgatgagctgcagcgcgtgcggcgagcgcatcagcagggagttgccggtgccggtcgtgtcgaagtagtggcgtcggtcgttgtcgaccagacggtagtaggcaccgttgtcgatgcctttgaagcttagggtcgggccgaggttgttgccttcggcggtgtggttgtacaccacgtcgaggatcacttccatgccggcgcgatggtaggccttgaccatggatttgaattcgttgacctgctcgccgcgttgtccggagcttgagtacgcgttatgaggcgcgaagaagccgatggtgttgtagccccagtagttgctcaggcctttttcctgcaggaagctgtcgttgacgaactggtggatcggcataagttcgatggcggtgacgccgagcttcctcagatattcgatgaccgatggatatgcgaggcccgcgtaggttccacggatgtccggcggcacgtccaggttgagattggtcatgccacgcacatgggcttcgtagattaccgaatcatggtaggagatgttcggatgttggtcgttgccccagtcgaaatacggattgaccacggccgatttcatggtatgcggcgcggaatccagcgtattcatgctggtgacgtcctcagggcttttgaaccaatacgaatagaggctttcgtcaccgtcgatgtttccctcgatggcttttgcgtacgggtcgagcagcaacttgttcgggttgcaccgcaggccctttgctggatcatacggaccgtacacacgatagccgtaccgttgcccgggttgtattcccggcagatagttatgccatacgtaggagttctgctccgtcatttccactcgggtctcacggtcttcctcatcgaaaagacaaagctcgactttctgggccacttgagagaagagggcgaaattcacgccggcgccgtcgtagctcgcaccgagtggatacatcgatccaggtctgatttgcataattcaagtatcgcacgttttgcgagttgaattcgttatttcgtttattccggcgattgtttttacaattcgaaacctgcaggccgctattgttgccgcattctgcgaatttgctcatgcaaaatggcgatctccgaattggaggccgtgatgtgcgtgtctcgtagctgcttccacgggatccaagcagattcgacatgctcgtcggcgtcgaaatgccgttcgacggcctgccagtggcgcaggtgcaccaccatgatgttggccagttcgtcggtcatgccttcggatgaatagaattgcccgacatggtcgatatcgcaactgttttcgtcgattggctcgacgccggtctcttcgcgcagctcacgcaatgcggccgcatcgacgtcttccccgtcatcgatgagtcctgccggcagaccgtaggcgaaggcgtcgcagccgacacggtattctcgttcgaccaagtacaaatcctgcgcgcagtcatgcaccagcatgaccacacagggcgcgtgccgcatcacctgtctgcggatcacggtttgtccgccgtctcgtgtctgcaacgcgatacgcatgtcctccacgccgaaaatcgcgccttgatacacgtgctctctgctgagtactgtggccggtctggtcatgtccacgccatcgctggattcgttcagcgacatatccatgctggtcatatcggacatcgtcgttcagcgttcctgcccgcaggacggcagtaccagattccagggatcggtgttcatggaaatccagcggacggtggggatgtctccggtcgcctcagatacggcacgaggcacatcgcccatggcgtattggaaccatatggattcgatggcgctgtgtggcgtgttgatgaacatcggacgaacagtggcgtcgcctcggccgagttcgatgtccgcggcacgcatggacgcctcatagcgcgcctgctcgatggcatcggtcaccggatgatggcgcagatcgctggtcacatacacatcgacgcctgcggcacgcacttcatcgaacagggaatcgcccgagcccggcaataccgccaccgtgccgatcgtcgcgtcaaggtcgccgcacacctgcacgccaagttcggtgtatggcagcgcgtcggccacacgacgggcgaaatcacgcaatgcgatcggctcctgcaaccggccgacacggcccaatccgaccggatgttcggctttcggatcttcgatgggtaccagcggacgctgttcgatcaggccgaacgcgtcggcggcggccatgccgactcctcggtaggaggcatcggcattggtgtgcccaacccacagcgcgcaaccggcgaggttgagcttccggacgatctcaccacggaatcctagtccggagaccgcatgcacggaacggaagaacagcggatggtggcagatcagcaggtcgatgcctccggcgatagcctggtcgatcaccgccatggatgggtccgccgcgaacgcgatgttgcgcacgtcgtggcgaaggtctcccacgatgagtcccggctcatcccattgttccgcgtatcgcagcggatacagcgtttcaagcacatccacgacctgcttcagcgttgccacaatcttccttctttcttttttaatcagccttcgattatccgacgggaacggatcagtgggccgccaattgccaatcggaaccgatgcccgtcgatacgtccaacggaacggccatggtgacggcatgctccatggcatccttcaccagcgcggtggcctgcttctcctcaccgggcgcgatctccaccacaagttcatcatgaatctgcagtatgaggcgacttccaaggttcgcttcctgcagtgcgtcatacgcacgaatcatggcgattttcatgatgtccgccgccgagccttggataggcgcgttcaacgcggcgcgttcggccgcgtccctcacggcacggttcggcgatttgagaccggggaaatacctgcgccttccgaaaatggtttcggtatatcctttttcgcgtgcggacgagacaagcgattcaaggtattcatggactttgccaaaagtggcgaaatactggtttttcagcgattcggcttctttgggcttgatcttgagctgctgggcaagtccatacgtgctcagaccgtaggcaagtccatagctcatcgccttgacgtggctacgctgatcggacgtgatgtcgtcaacgggaatgccgtagaccaagctggccacatacttatggaagtccttgccggagcggaaggcctctatcaacgcctcatcaccggaaaggtcggccatgatgcgcagttcgacctgcgagtagtcggagctcagcaacgattcgaagccctctcccggcacgaacgcggatcgaatctcacgacctgcgggatcccggttcggaatgttctgcaggtttggatcgacggagctcaatcgtccggtggccgccaccgtctgttcgaaagtggtgtggatgcgaccgtcatgacggtttgtggcgtcgatcaacgtctgcacgatctgcttgagcttgttcttttcacgatgcatcagcaacgcgtcaaggaactggcatgcgcggtcgttatcgtacgagcggtcacgcaaggtctgcaatgccgcggcattggtggtgtatgaaccggacttggtttttttcgtcggtttcaatcccatgtcttcgaacaggatcttctgcagctgtttggggctttgcaggttcacctgctcccccgcgaactgccacgccgtttcctgtgcctgggcagcgtcggcggcaagttggtcgcgcatctgcaccagacgtgtcatatccacttgggcgccgacctgttccatgccatgcaggacctgagagaccggaagctcaatggatttgaggagaccgaattgttcgcgcttatccagcacaccggccaaatattcggccaaaagccccacgattgcggtgcgggtgagtatcagctcatcgttcttggaatcgttttcctcaggctcgtcgaagtccaaggtcccctgtgtcgcggcttcggcttgtgcttcgatgtgcagatcaaggaaatgggccgcagcctgttccagcgtgtccgcgtggaaatccgggtgggcaagatatccggcgagcttggtgtcgaacaatggttccggaagttccacgccgatgctgcccagcagatgcgcatgttctttgtaaccgtgcacgaccatggaatggtgatagcggtcgaacagcctttgcaggcattgcaccatatccggactgaatacgtcgatgcgaatggcttcgccgtgcacggcgatcatcaatgccgaaagagaggcttctccgggtttgctcgtgccttcggcgtaaagcgtccaggactgtttcaccttgtccgtgcagcgggtcgaagaatcgatttcgaagccgaattccggaatgtcgttggaggagcgttcatggcgttcgtgcagatgttcctgcaccacggggaaatggttttggacccatgtctccaccacatgcggatcgttgacgtcttcgacatgtggcagcccgagcttgctggattcgtgcacgtccccggatggtttgtccgcattgaacgttttgagcacgcgattcttggtccgaacaccgaattcgagcttggtgaatagatcgtcgagttgaccagcgtcgacttgtccaaatgtcaggtcggataccgacacgccaagatcaaggtcacgaaccaaagcgttcacggaacggttcagtttgacctgttcgatgttttcgcgcagggcttcgccttttttgccgctgatctcgtcggcgtgttcgatgatctgctcaagtccgccgtactggttgatccatttggccgcgaatccgtcgccgactccgggaacgccggggatgttgtcagcggtttctccgcgcaaggcggccagatccgggtattgcgcgggagagacatgatatttctcctgcacggcatccggggtcatatgtttgaggtctttgaaatggtggccgggatacagcacggtgatgttgtcgttgatcagctggaaagcatcacggtcgccggacagcaccaatgtgcggtagcctgcctggtcgcccatgctggcgagcgtgccgatcacatcgtcaccttcgtaaccgggtttttcgatgtatgtgacgcccaaggccgtcagcatctgctggattaatggcagctggctgagcagttcctcgggggccgcgtcgcgagttcctttgtactgcggcagcatctggttgcggaacgtgccgcccttcacatcgaatgcgacggcaagatggtctggatgttcggcatcgatcacctgcgaaagcatggtggcgaatccccagaccgcgttggtggcctgacctgatgatgtactgaaattctctacgggtaaggcaaaaaaagcgcggaacgccaaagaatggccgtcaacgaccaatagcgttccgcgtgaagtgccttccacagttggtgtgttagcgctcatcctctgcttccgacttctgttcgccatacttggcgatgatggccatggccagacgcttcttcggaatgcgctggtccatggaggtcttctgaatccaacggaaagcgccctgttcggagaagtccgccttgtccatcagcaggcccttggcgcggtcgacgagcttgcgctcctccagcgtttcttcggccttcttcagctgctcttcggccttcttcagctgttcctcggtttcctgcagtttggactcgctacgttcgacattgtcaagcagatcgttgatttcggcgaaacggcccatggcgacttccaaagccggcagcagcttggattcctcatacggcttggtgacatacgccatggcgccagcgcccgtggcctttttgaccaaatcagactgggagaatgccgtcagcatgacgaccggagcgatgttctcatcacagatgatgccagcggcctcgatgccatccatgcgaggcatcttgacatccatgcacaccacgctcgggcggaacttactggtcagttcaacggcttcctcaccgttggcggcctctccgacgacctcatagccgttatcctcaagcatggcgaccaaatccatgcggtttacggattcgtcttcggcaacgacgacggtgcgcttgtgcgcctcgttattattggcagaatccggctcgggagccgcagcagcttggagctcctcatcagtgagtacttcgtccggttccgtggtcttctctgcagccatgtcggtctctttccactgtcacacccaaagccggcctaacatgccccaacccgggcctggattgatattgatttcttacgtgccctcggtgggactcgaacccacactgcgcagattttgaggctgcttcctctaccaattgggatacgagggcttgcacgcaactctggaagaataccacatgattgcgatttgcgccaaatctcggcgttgtcatcattcggggacatcgcgtaaaaacaataatcctcccatcgggaaccaatgggaggattatggaatcagcgtttaacgcgacgattcaaatctcagtcgcaggcaccaacggtgtggacgtagatggaatcggtgcgacccggctggtgttcgccctgggcggagctcagcacgacgatcttgtcgccatcggagaccttgccggcgtccttgaggaccttgtcggtgaaaaccatgaggtccttgcgggacttgtcatggtaatcctcgtcgaccaggaaggactcggtgccccaagacagggccagccagtggaaggtgtgctcattgttggtgatgccgtagatcggggtggccggacgttcacgggacacgcggtgcacggtggaaccggtctgggtgtaggcgacgatggccttggcgttgagcttgtcggccaggtcgacggcggcggaagagacggcacctgtggaggacatatccaggttcttcagctccgggatgcggtcgaaaccatgctcggtggcgaaggtggagatgcggctcatggtgttcacggtgactgccgggtacttgccgacggcggtctcgttggaggtcatggtggcgtcggcaccgtcgaggacggcgttggcgcagtcggatgcctctgcacgggtcgggaccggggagctgaccatggagccgaggacttcggtggccacgatgaccggcttggcgtactgacgagccagctcgatgcagcgcttggtggccagcgggacctcttccagcgggcactcgacggccatatcgccacgtgcgaccatgatgccgtcgaacgccttgacgatctcctcgaggttctcgagggcctgcggcttctcgatcttggcgacgaccgggatacggcggccttcctcgtccatgatctcatgggcgcgatcgatgtcggtggcgaagcgcacgaaggacatggcaatgatgtcggcgccggtgcggatggcccagcgcagatcctcttcgtccttctcggtcagagccggcagagacacggcgacgcccggaaggttgatgcccttgtggctggagaccggtccggcaacgacaaccttggtgtacacgttgttgccttcgaccttggtgacctcgaggcggaccttgccgtcgtcgatgaggatcggatcgcctgcatggcagtcgcccgggagacccttgaaggtggtggaggtgatgtgctcgtcgccttcgatgtcatcagtggtgatgacgaactcctggccttcggtcagctggaccttgtcctcgccgtcggcgttcttcttgaaccaaccgcagcggatcttcggaccctgcaggtcaaccagggctgcgacgttgcggccagtggccttggcggcggcacggaggttgttgtagaccttgaggtggtcttccggagtgccgtgggagcggttcagacgagcgacgtccatacctgcttcgacaaggctggtgatgccttccagggactcggtagcgggaccgatggtatctacgatcttggctttacgcatgaatgcctgcctattcttgttgatattgattttggatctgacgaccctgtttccaatggcatagcttactagcaaaaagcgcccacttccacctcagaactaggtgtgttgtgagcgctcacaatttcgtaggagaatagaaaagctctattctcccaacgtttgccggactgtcacttttcgttcgctttcatggtgcgcatcttaataacacttgccaaagccgcaccaccaatcgcaagaacgatcacgacaagcgacagccatgtgggcacttccggaacccaggaaatcggctggccgccattgaggaacggcagcgaattgccatgcagggcctccatgatgagtttgacgccgatgaagcccagcaccacggacaggcccagcggaagatagacgagcttgtcaagcagctctccgagcaggaagtacagctgctgcagaccgagcaatgcgaacacgttggacgtgaacacgatgaacggatctttggtcaggccgaaaatggcggggatcgaatcgaaagcgaacatcacgtcggtggtgccgatggtcaggaacacgatgagcatcggggtccaatgcttcacaccgttcttgatagtacgcagcttttcgccgtcgtattcatcggtgatcttgatgaccttgcgcagtgcgtgaatcaacgcgttctcatggtattcctcgtcctcgtctcccccggcgacgagtttgatggccgtgacgatgaggaacgcgccgaataggaagaacacccaagtgaagcgcgagatgatggcagcgcccaccaaaatgaacatgcctcgcagtacgagcgcgacggtgatgccgactgacagcacgaatttctgtagttccttcggcaccgcgaaattcgacatgataatgacaaacacgaacaggttgtctatgctcagcgaatattcggtcagccaacctgagtagaactcgatggcaggcttcgagccggcgaagaaccacatgagtccgccgaagatcaacgccatgaccacgaagaacgcgatatgctgcacgcattccttggtggagggcacatgcggcttgcgcccgatgatgaacaggtccaccacgaagaagacggcaagcaccgcaaacgtggcgatttcaaaaacaagtggtgtttcagccataatccactatggtacggatgccgtatgaccggtcgagaactatttgctcgcctccgtcatctgccgaagttcctttttcaggtcacggatctcgtcacgcagacgagccgcaagctcgaattgcagttgttctgcggcggtatgcatctgctcggacagttgtcgaatgagatcagctagatcctgtgcgggcaatccggccttgagaatctcctcgtgccgcctgccggattcctccttgctggtatgtggcacgccgagatgcgaattgccggctttgtccgcgtttcggtatccggtaccgagcaatgtctgggtgtcgacgtcctccttggcgagcatgtcgttgacatcggagatcttcttgatgagcggcttcggatcgatgccatgttccttattgtaggcgatctggatgtcacggcggcggttggtctcgtcgatggccttgcgcatggcttcggtgatgtcgtccgcatacatgacgacggtgccggacacgtttcgcgccgcacggccgatggtctggatgagcgaacggtaggaacgcaggaagccttccttatccgcgtcgaggattgcgaccaatgacacttccggcagatcgaggccctctcgtagcaggttgatgccgacgatgacgtcgatcttgccttcacgcagttcacgcagcagttcgacacgacgcaaggtgtccacatcggaatgcagatattcgactttgatgccgcgttccagcagatagtcggtcagatcctcggccattttcttagtgagcgtggtgaccagcgcacgttcgttccttgccacgcggtctttgatttcggcaagcaggtcatcgatctgcccttccaccggccgcacgtcgatctgcggatcgactagtccggtcggacgtatgatctgttcgaccacgccgtcgctcaaaccgagttcgtaatcgccgggcgttgccgacaggtacaccgtctgaccgacgcgttcctggaactccggccatttgagcggtcgattgtccattgccgacggcaggcggaaaccgtgttcgaccagcgtgcgtttgcggctcgcgtcgccttcgtacatggcaccgatctgcggcacggtgacatgtgattcgtcgatgacgagcaggaaatcatcggggaaaaagtcaagcagcgtgtgcggaggcgtgcccggcgcgcgtccgtcgaaatgccgcgaatagttctccacgccggagcatgtgccgacctgcgagagcatttccagatcgtatgtggtgcgcatggtgagacgctgcgcttcaagttccttgccttgcttatgcaattcggcggtacgctcgtcaagttcctgttggatggttttgagcgcccgttccatacgttccggtccggcaacgtaatgcgaggccgggaagatgtgcacctgcgattcgtgcgcgatcacgtcgccggtcagcggatgcagcgtggagatgcggtcgatttcgtcgccgaagaattcgatgcggatggccagttcctcgtatacggggatgatctcaacggtgtcgccgcgcacgcggaatgtgcctcgcgtgaaggcgatgtcgttgcgcttgtattgcatgtccacgaatttgcgcagtaaatcgtcacggtcgatctgctggccttcctggaggaacagcatacggccagcgtattcttccggcgttcccaaaccgtagatgcaggagacggtggccacgaccacgcaatcgcgacgggtcagaaggttcgcggtggcggcgtggcgcaatcgctccacatcgtcgttgatgttggaatccttctcgatgtaggtgtcggtctggggaatgtacgcttccggctggtagtagtcgtagtaggaaacgaagtagctcaccgcattgtccggcatgagttcgcggaattcggcgcacaactgcgcggcgagcgtcttgttcggctcgatgataagcgtcggtcgctgcagacgttcgatcagccacgctgtagtggcggttttgccggtgccggtggcgcccatgagcaccacgtcgttctcgccattctcgatgcgcgtggccagctcctcgatggccttcggctggtcgcctgaaggcttatatggagatttgaccacaaacggcttgttcactcgttcaatgttgaatcccatggttccgtctcgcttccttacgccactgttccatcagcctatcaacacagtcgaacatgtgttctacatcctgggatgagtcaatcaccgcatcggctatggattctcgtgccgcacgcgtgggctgatgcgcgatacgtgccttcgcctgtgcctcactcatgccacgggtgcgcatcatacgttccacacacgtctgttccggtgcttcgactgttacgatatggtcgaaacgcatgggtatgtcatcgattacttccgccaaaagcggaatatcatgtacgaccacggcatccggattcttttcgaccgcctgccgttcctccgacaatgcaagatcgtagatcaacggatgttcgatatcgtcaaggattctacgttcggattcggcattcggatcggagaagacgtgttcggacatccatcgccgattaagaccaccttgcgcgttcatcgcatccgacccgaaatgttccacgattcgttgcaggcccacgcttccgggttccacgacttttcgggcgagcacatcataatcgacaagcgtcgcgcccagttcacgcagatgcgtagcgaccgtgcttttgccggcggcgatgcctccggtcaacccaattcgaatcatcacaaccgccattgtaatgtttgacggactcgcaacatacgcaaatggccccgcacctgatggtgcggggccatttatcagcggtttacgcgaatcagtttattttgattcgtcgaaactcacttgccgagcagctggtcgcgcagagcggcgagctggtcggaatcggcgagggtgccgttggaggtgttgtcggaggagtagttggacacctcttcgaccttctcttccttcggagcctggccgtcttcggctgcggaagcctcggcgttctcgagttccttggcaacgaattccttgtgctgctcccacagatcgtgagcggtggcgtactgggactcccactcctcacgctgcttctcgtaaccagcgatccactcgttggttgccgggtcgaagccttccggatacttgtagttgccctgctcgtcgtactctgccggcatgccgtacagagccggatcgaagtcctcggaagccggatcaacggagtcgttggcctgcttgagggacagggagatgcggcgacggtcgagatcgacgtcaatcaccttgacgaagacttcctcgcccggcttgacgacggtctccgggttctccacatggcggttggccagctcggagatatgcacgaggccttcgatgccgtcttcgacggagatgaagacaccgaactgaacgatcttggtgaccttgcccttgacgatctggccaggaacgtgggtgcgggcgaagcgctgccacggatcttcctgggtggccttgagggacagggagatgcgctcacgatcgagatcaacgtcaagcacctcgacggtgaccttgtctccgaccttgacgacctcggacgggtgatcgatgtgcttccaagacagctcggaaacgtggatcaggccgtcaacaccgcccagatcgacgaacgcgccgaagttgacgatggaggacacgacgccttcacggatctggcccttcttaagctgggacaggaaggtctcgcgcacttcggactgggtctcctcgaggtactggcgacgggagaggaccacgttgttgcggttcttgtcgagctcgaggatcttggccttgatcttctggccgatgtacggggacagatcgcggacacgacgcatctcgacgagagatgccggcaggaagccacgcagaccgatgtcgacgatgaggccacccttgacagcttcgatgacagtgccttcgacaacgccatcggcttccttgatcttctcgatgtcgccccaagcgcgctcgtactgtgcacgcttcttggacagaatcagacggccttccttgtcttccttggtgacgacaagggcctcaatggtgtcgccgacctcgacgacttcgtcaggatcaacgtccttcttgatggaaagctcgcgggaggggatgacaccctcggtcttgtagccgatgtcgagcaggacctcgtcatgatcgaccttgacgacggtaccttcgaccagatcaccatcatcgaagttcttgatggtggaatcgactgccttgatgaagtcctcttcggtgccgatgtcgttgatggcgaccttggcgacttcgttattgttctctgccattaatgtggtttcttacaaaatagtggatggataaaatcgttcttcagttatacgtgcgtgcaaatacacacaaggcgaaagtctacaagaagccatgcacaaaaatcgggcgtgtcgcatgtcacgacacgcccgaaagcactatcgcgaaactcacaactgacgttcggccatctccacgacattctgcaacagcatggcacgcgtcatcggccctacgcctccaggattcggcgtatatgccaaagccttctcgtaacaggctttatcgacatcacccttgaccttgtatcggccggattcctcgtcgaacacgcgggatactccgacgtcgacgagaatcgacccttccttgatgtcttccggtttgacgaaaccagccactcccatggctgcgacgatcacatcggcccgtcgcatgtgttcacgcacatccttggttcccgtatggcacagcgtgacagtggcgttgaccgccttacgagtcaacaacagaccaatggtacggccgatggtgatgccacggcccagcacgcacacctccttgccatccaaatcgatgtcgtaggcgcgcaacagctcgatcacgccgcgaggcgtgcatggcaacggcgtggcaatgtctcctcgggcatgcagcacaagttcgccgagattatacggatgcatcccgtcggcgtccttcttgggatcgatcagatcgatgatggcgttctcgtcgattccccttggcaagggcaactgcacgatatatccggtacaggcgggatccgcattgagctggcggaccgcatcggcgacctgatcgaacgtcgcattctcaggcagctcgcgcttgatggaattcacgccgatttcggcgcaatcggcatgtttgccggcgacatatttcacggagccggggtctgatccgaccaaaatggtacccaacccaggttggattcccctcgccttcagcagttccacgcgtttggcgaggtccgccttggtccgtgccgccacctttttgccatcaatccttgttcccatgtggtccacttcctcgctaagtcgcttgtcgtattggcatttgcaagtatcgtaggctatcttggtttcagtcgtaagtcgcgcatgtgctatatgagatggacgcgaccgaaacgacggacgacccaagaggaaggcaatcgacatgcgctctcaccagcgtccatttttccgcatccttgccgcgggaatcacattgtgcacggtgctgggcaccgcttcctgctttggcgcttcttcggagcccgatcaaccaacggcacccgacacaccaaaggagcagaccaccccgatcaacgtggtggcgtcggtcaaccagtggggggctttggcggagcagatcggcggcgtgcacgtcaaagtcacctcgattctgtcctccacaacagaggacgcccacacgttcgaaccgaagaccactgctgtcgacaccctgcagaaggcacaggtcgtcgtgtccaacggagcgggatacgactcctgggccacaaaaaacctggaaagagacaccgtttccgtttcggccgcgcaaatggtcggagccgttgagggagacaatccccatctctggttctccagcgacgcacgcaacgccatggcgaaggagcttgccgacacctacagccgcatcatgcccaagcaaaagaaatacttcacaaacaaactcaaggcgtggaacagacgcgagacggtaatcgagagaagcatgaaagagttctccgatacacataggaacgtctcctacgcagccaccgagccggtcgcatattatctgctcagcgacatgggcctatccgataagactcccgaaagctacacgcagtccatctcggaaggctcgcaaccctcgtccaaggaactccaggacttccagaagattctggaggggcatcaagtggatatgctgatcaacaatgttcagaaggcggatgatgccacaaatattctgaccggcaccgcacacaaatccgatgtgccggtcatcgacgtcacggaacagatgccggccgacagcaaaagcctgatctcatggatcgcgcagctcatcaagcaaatgaatgaggcggtttcctccaaagatgatgcgacatcatcagattcggacgtctctccctctgaatcgaatggcgagcagccgtcgaacgacaatcccgactccgattccgacgccgcaacgccggacaacacagggcagacggaccccggtaaataaagccacggtcatcctccctcccccgattcgccgatgtcgagtaattccccgacatcggcggactcttttttccagcaacggttacgatccaggcggattcatcacgagacttttcatcgtccatgcatgcttcttattgagaatgattgtcaacaccgtttgcgagaatactatcgttgacttatcaagggagcgagccatgcacgacaaggcatcattctgtatcgaattcgacgacgcaggggtctcacgcggcggacacatcatctggcagcatggcaccttccgtatcccgcaaggctcggtgacagccatcgtcggcaccaacggagccgggaaaaccaccatgatgaaggccgaactcggattgattcccatcgcccacggcggcataaccgtgctcggcaagccggccggcgccatgaatcaccgtatagggtatgtgccgcagagctacgcatccgacatcgaatcgaacatcaccgccgaacagtcggtgctgcttggcctgaccggggcaaggttcggcattcatcccatcacccgcctgcaaaaagacaaagtacgcaatgcgctggaattcgtcggcatgcaggacaaggcgagataccggctgtcggaactctcaggaggcctgcggcaacgcgtcgccatcgcccaagcgctggtgtcggacccccaactactcatgttggatgaaccgctcgccaatcttgatctggccagccaacgcgccacagtgcacgtgctcgccaaactcaaccgagaactcggcatgtccattcaagtagtggcgcacgatttgaacatgcttctgccgattctcaccggagccgtatatctgctcgacgggcatccgcattatgcgaagatgaacgaggtgctggattcgaagctgctcacccatctatatggcaccacggtgcaggtggtcaccactccccaaggagatatgttcgtcactccaagcgaggatgagcccgatgacattgacgtcgacgcccacgcgccggaggaaatcgcaagattccaccaacacaaccgcatttcgcaggaggcatgatcatgaacgaaaccgctttctccttcgatccggattggatgggcacgctgaccgcgccattcatgacaaacgctttcctcgccggcctgtgcatcgccttggctgctggagtgatgggttacttcaccatcgcccgtcattccacgttcgccgcgcatgcgctggcgcacatcggactgccaggagcgaccggagccgtgctgttgggtctgccggtcagtgccggtctcggcgtgttcgctctcggcggagcattggtgatcggcgcactgggcaaaaaggcatcgcaacgcgaaatcgccacaggaaccgtattggcgttcgccacaggcatgggtctgtttttcgcacgcttgtccagttccgcctcgcagcagatgcaatcgattcttttcggctccatcctgacgatcacggacgggcagatcgtcggatttgcggttttcgacgtgttgttgctggccgttttggccgttatctatcgaccgctgctgttcagctcgcttgatgaacaggtggcgcaggcaaaaggcgtgccggtgaatctcatgaacatctgcttcatggccattatggccggtgtgatcaccatcgcggtgcccgccgtgggcacattgctgatattcgctcttgtggtcacgcccgccgcgactgcgaacatcatctcacggtccccattcgccgcgatggtcgtctccaccgtgatctgtttgatctccatttggggtggactgttggtttccgccatgttccccgctcccccaagcttcatcatcgtgacgatttccacactgttctggattgtcgccaaaataatcgaatcggcacgccgcaggtagcgaaagtatcagccgatcggttccaccaaggcgctggcgatggccgcgatgccctcgcccgaaccggtgaatcccatgccgtcggtagtggtggccgtcagcgacacttcacagccgatggcatggctcaacgcctgttgcgcctcgtcacgacgcttgccgattttcggacgattggccacgacgaccacgcttgcgctcaccggcctcatgccatgcgcacgcaaatacgcaaccgtcgcgcggagcatctcgtcgccgtgcttgccggcaccggcggaatcggaaccgactccgaaaagcatgcctatatcacccaatccggctgcggaaagcaacgcgtcaatcaacgcatgggctgcgacatcaccgtccgaatcaccttcgatgccgtcaccatcccaacgcaaacaggcaagccataacggcttgcctgcatcatgggacgcgaatcgatgggcgtcaaatccctgaccgatacgcatggaaattcccttacttcttcttggacttcttgttctccgcctcgacgcgcgccaaagtgtccatggccgcctcttcaggagcttcggtgtgatgatcctcgtcgccagggcgcggcggttcataaccaaggttcacgtcaagcagacgctgggcctcattctcattaagatgctccgacaacgcgatctcggaagtcaggatgctgcgagccttggtgagcatgcgcttctcaccggcggacagcccatgctcgtcgacatcacgctgggcgaggtctcgcacgacttcggcgattttattcacatcgccggtggcgatcttctcaacgttcagcttgtaccggcgggaccagttcatttccttttcgatgatcggagtacgcagaatctcgaagaccttcgcgacctccttggcgccgacgatgtctcggacacccactttcttggcgttctccaccggaacattgatgaccagcccgtcggacgacagcaccgacagctgcagatattctcgggtcacacccttgaccgttcgctcggtgatggcctccaccttcgctgcgccgtgacgcggatagacgaccatgtcgccgaccttgtaacccatgaatcctccgtgaaaagcttacacaaaacccgaattattgtgccatcagggttggacttgcctaaaaatccgccaaaaaaccaaaaaaagacgcgacacgggccaattttcaagcatttcatgcttacacttttcccatggctacagaatccaagatcaaagaagatagcgttgccgttcctgttgcacagggcgacctggatgcagtaagcaacggtacgttctacaatccacacgaggtgctcggcgggcatctcggtcccgacgagcatgaggatgtcgtcacgatccgcgtgcttcgtccgttggcgaaatccgtgacgatcatcaccgaaaatgcccgaacccaggcggtgcatgaacacaatggcgttttcatggcactcattccggccatcaagaccgatgacggcttcgacgtgcccgattatcgcatcagcaccgaatatgaagacggttccaccgtggtgtccgacgacccgtaccgttatctgcccaccatcggcgatttggacatgtacctgtttggcgagggacgccatgagcgcctttgggaggctttgggagcgcgcgtgctgcgctatgacgatccgttgggctccaatgacggcgtcaagggcgaacagctggtgggcaccgcattcaccgtgtgggctccgaatgcccatgcggtacgtgtggtgggagatttcaacggctggaacggacgcacccacgccatgcgtgaactgggctcctctggagtctgggagctattcattcctggtgtcgaagcgggaacgatttacaagtatgagatcctcaacgccaacaacgaatgggtcatgaaggccgatccgatggagcgttcgcatgagattccgccgcgcaccggttccatcgtcgtcgactccgtccatgcgtggcatgacgagaactggatggaccagcgagccaagaccgacccgcacaacggtccggtcagcatctacgaggtccatgcctctagctggcgcaaggatgtgaagaactatcgcgaactggccgacaagctggtcccctacgtccagaaggaaggtttcacccatgtggaattcatgccgctggccgagcatcccttctccggctcgtggggttatcaggtaaccggctattacgcgattgattcgcgccttggcggccctgacgacttcaagtatctcgtcgagaagatgcacgaggccggcatcggcgtaatcatggactgggttccggcgcatttcccgaaggacgcgttcgcccttggcagattcgatggcacgcctctgtacgaggatccggacccgacccgtggcgagcatccggattggggcacctacgtgttcaatttcggacgccgcgaagtgcgcaacttcctggtggccaacgcctgcttctggctggacgagtaccatatcgacgcgctgcgcgtggacgcggtctcctcgatgctgtacttggattacagccgcaagccgggccagtggcatccgaacatctacggtggacgagagaacctcgaggccatcgacttcctcaaggaagccacggcgaccgcgtacaagaacaatccgggcatcatgatgatcgccgaggaatccaccgcgtatcccggcatcaccgcaccgaccgatgccggcggtttgggcttcggcctcaagtggaacatgggttggatgcacgacaccctgcagtatctgcacgaggagccgatcaaccgtaagtggcaccacaacgagatcaccttctccatggtgtacgcatactcggagcattatgtgctgccgatcagccacgacgaggtcgtgtacggcaagggctcgctgttcggcaagatgccgggcgatgactggcagcgctatgccggcgtgcgcgcgctgttcgcctaccagtgggcccatccgggcaaaaagctctccttcatgggcaatgaggtggcgcagtacggcgaatgggatcatgacggttcggtggattgggatgctctcaattggcctgaccaccgtggcgtacagaagctcgtcgccgacctgaacaccctgtacaaggcgtctcccgcattgtggagccaggacttcgatcctgccggattccaatggctgaccagcgatgacgccgaccataacacgctcagcttcgtgcgtatcggcaaggatggcgagcagatggtcgttgtcgtgaacttctcgggcgaggcatgggaggattaccaggttccgctcaccaagggcggcaagtggaccgaagtgctgaccacggacgataagaagtacggcggttccgatattcacaacggcaccttcaaggcggtcaagggtgagtatcattcccgtgattggtccgcgaaaatcaccgttccggcactgggagcagtattcttgaagccggaactctgagaaaggcggaacgctatgctcaattcatcagcacaatccacagtaattccacgtaccgttctggtggtcgaagatgaaccgaccttggccaccgccatcgcgcagcgcatcactgcggagggttggaccgcgcgcgtggcttccgacggcgccagcgccgtccaggccgcttccacactccgtccggatctggtcatcatggatatcatgctgcccgtgatggatggtcttgaggccaccaagcgcatcgtggctgaacgtcctgtgcctgtgctgattctgacggcgcgagacgacgaggccgacaaggtcatcggtcttggtgccggagccgacgattacatgaccaagccgttctccatgcgcgagctcatcgcccggtgcaaggcgctacttcgtcgtgtggacagggcgaaggtcatcgccaagaactccgaaaacgagaaactgcttgatttcggctctctggtcatcgatccggcccagcgtatcgtcaccgtcaatggggagcaggtgcatttgaccccaacggaatttgatttgctggccactttggcccgcaagccgaagtccgtgctcactcgcgagaagctgctcgaggaagtgtgggattgggtggatgcgtccggcacccgtactgtggattcgcatgtcaaggcgctacgtcacaagctgggttcgaagaccattcgaaccgtgcatggcgtaggctacgcgttcgaaccgccggaagaatagtatgatgcgctaagatttggtggtatgcgtaccactgattcaaaaccagggcgttcggtcaatccgttggataccgaacgccctattggtttgttctcttcgctcaaaatggaattgagcgtgctgatcaccatttccaccatcatcgcattcatcatggcttggttcctgctcaaagtcggattgagcctgtggatagccatgccgatcacccttgccgtggctttgggcatcacctatttcttctctagaggactcacctctcccctgcgcgagatgcgggatgccgcggaagctatggcggacggcgactacaccgtccgggtgcatgtcgatgccaacagccgcgacgaagtcggacagctggctttgtctttcaatgagatggcggaggaactgcagcatgccgaccagatgagacgggacatggtagccaatgtgagccacgagctgcgtacgcctgtatccgcgttgcaggccatggtcgagaacatggccgacggcgttgtggaaccgaccccatcgaatctggaaagcattctcaaccaaacgcaccgtttgtcggatctgatcgcgtttctgcttgatttgtcccgcatggaagccggtgcggcgagcctgcagatcgataaattcaatttcgcggatttcatcgacgaaaccgtggaaccgttggaaatcgccgatgccgggcatgcccacaatatcgaaatccacgtgcccgacgacatcgaaatggaaggcgatcaggatcgtctgcgccagttgttcaccaatatcatcgccaatgcgctcaaacactccgcagacaataccgcggtgctcatcgaagcgcatgaaaacaaggatttcggcacgattgtgacgaatgtcgtcaacttcggctcgcagattccccaagaagcgcggtccgatatcttccgtcgattcgtcaaaggcaagacgggaccaggtaccgaatcgggaggaaccggtcttggactgtcaatcgcccgatgggcggcgcagttgcatggcggcacggtacgagtggtggatgatccgcgcggcgccgatttcgaaatcactttgccgaaatatcacatttccgatgacgagtgacgatttacgccgtcaaaggtctgccggccggagtgtgtgccaacgccagcacggtaatgaccaaagctccctgtgaagttagagcgtcaacacaacgacgcatggtggctccagaggtgacgatgtcatccaccagaatcaccgccttgttttgaagggtgacgcccggacgaaccatgacatgccccttaaggcgttgcgccctctgttccgtgcccttggtctcgacggatttgcctttgattcctttgttcgtcaacgcatcgcatacctgtacgcggaaacctgtccggcaccgtagaaacgccgacaaccgttttgccagcggcatcatgtgccgtcgtccgcgctgacgcatggaagcaatcgacgacgacgcgggaacgaccagtatggtatcgcagatctcacgaacgccatccatggcgtcaatcacaccggcgcgttccgcaagcctgcacaacgcatccgagaacggacggtcgcattcctcgtctccgtggtctttccatgccagaatcgactgtctggcggcaccccgataccatccgcacgcgaaccatcgacccatctcagccgtttccaatggttgggacagttcgcagtcgaatgacgcaagacaggcatcgcacaacacgtcatcaggcttgtcgcatcccgcacagcctcgtgggaacaacagattcgccatatgcgcgaatgaacccgccatcagattcacgccggctccgtcatcgggacaatctggcaatgatctcgccgcataatttcacggtatccgcgggaccgttcactttgacagcccttgtgccggccttcgccgcgggataatcattgccgtcgggttccatccggtctccgatgaacacgatctggccgacctcgatatcgagaatatccgcgagttcacggacggcgaacgacttatcgacgccacgctgcgagatatcaacactgctggagcctccaggtcttacttcaagattcggtagttcggcagcaaccgcacaggccaatcggttcttcttctcgttggtggggtcccaagcctccttggcctcgacgggggcaagctgccccaatgcggaaaaggtgatctgactgcctctgtcctcgatgcgctcgccccagacatgagtggcccaaatgccttgctcacgagcattccgttccagcgattccttcgccttggcacggtcctcgtcgcttagatcgtgggagaacactttcccccaccgttgcccgtcccaccggtagtagcgggttccgctggtcggcatgaggtgaagtttcgacttgtcggcatggtcggacagcctgtccaccacctgactttgcagcaacgagtatttgccgccggtgatcaccgcgacgtcaatcaatgatgtcaatgcagagaagcattcggccatgtccgctttcataggtttcttggaccgcgccaacgtgttgtcgaggtcaaacccaatcagccgcgcgccttcgcacagcatgttgacatcaacgatgttccaataaggtacggaaatatccgccatgatcatttctccccttgtcgagcagcccataccatggtatcgcatgtttcgaataagccctgataaggtagaaaccatgcaacagatgccttgggagaccccgatataccgcaaccgccatggacgtggcacgcgtacgcccatgtttggtaccagactgccccggtaccgtaccagaagcggtatgttcgacgatatgctggtggcgcaaatccgcagactcaacggggcatggcctgagctcatagctccggtccaattcgctgtggaggatgttccgccatccgatcccgcgccttgggaggacgttccgcatcttggatcgcagtcatttcccgccgggcacggcattccaccccgtatcgtgctgtaccgcatgccgctgcaatcgcatgcccgtaaccgtatggacctgcaattcgcaatcagggacgaggtggtctcacgtctggcggaaatctacggacgccgtccggaagaaatagatcctgattggggcatgtgactttcaacggacaacagtcatatcctgattcgcccagacctgctctctggcctccttcaaatcgacggcgccgatgatggcaagtccggcgagtttcgcaccggacacatctttctgtccgacacgaagattccagaccacggcttgggcgggatccttcaaacggatggcggcgacatcgccatcattaatatcggcgatgcgcaccgacgtcgaggccgagggacggatggcgatttcacgcctgtccacttgtttgccgtccgtgtcgtaagccgtcacgatcgcggtccgatccccatccgcggtgttgacgaaacctaccgtcgcggtggattggtcaggaaccgcgatggcggagatcttcgccggagcggacgcattgactagggcgaaatcggactgcccatcggggccatcgtctgaaatcttcgccgtggcagacaccggttcggaagcggctatggcgatgccggtagcggattttggaacgtctccaagatcgatggcggacgcgcggttcgccttcagctcctgctgattggtctgctgtgcccccttggagtcgatccaggatacggtgacatccgttttgcgggacgtatacaggtacagtgtcgcatggtctccgccattcaagccgtagagggccagagatttcgcgaaagcgttattcggaagcgcgtaatccgatccctttgaggtcaatccgtccatggagacggtgcggacgattgcggccacaggagtgtccgttccagtcaccgtggcatacagcgcgtcttggccggaagcagctgcggaaagattcagtaccgtttccttgcctgaggccacggtcagcgtcgatccggtggagagcgccagcgcgccggatttgtcggagccccagattctgatggtcaccgatgtgtccttggcggagggattggccacaacaagctgttgcgtcaagccggtcttcgtaccggaaagcaggaacgcctgtttcagcgccggcacgacgcaggaggctgctgatacgcccttcaaatcaccgtccgtggcccatgacatcactgaggaaaccgcgccggtaccgttcgaagccgtcagcagacgcgtgtcttgcaatcgggagccgtcatcgacattgccggaagccacaaagatgtcatcggacgagtcgtcttttttgtccagcatcgacacggatgccgtcatgtcggctcccatcgaggcgacggatgaatggaacaccgaaccgaaggcggcgtatctcgcggaagacgcgatattgccgttggatgcctggtattcgctatctccataggcatcggtatcggcaatggtcatgcgagacgggcagtacgtctgccgctgccgggggctgacggtacgacccaccgaggagcgttccaccgtgggcgtgtccgcatgcagccatgatggccggtatatgagcgtcacggccatcaggaccacgatgagcaataccgagattacggcaagcgcaatacgcaaaggcgtattgggacgagaatgtctgctcatgcttcctccagaccctgacgacgaatgcgcggaagcgccaccaggcaatacgctacaagaacgacgcccatgcaccacagccatgaacgacgccacacacttgagccggccttatcaagcccgcttcgatcgatatgctgcttggatagatcctgaaccgtcaaacgataatacgtgccattatccagactgacgacattctgtgtcccgtcggaggctccaatgttcgaattgagctggttcgaggcctctcgctgcgctttgtcgccgttctgcttgataacgtaaatgccgccgaagcccaacttgccaagctcgttgatggcatcggaatcggcattggccagcaactgggcgcaatcctgcgcaatggttctgctggacccgtcggaacgtcccgaaaccacttcgacgcgtcgcgcgggagagctgtcaatcaagtcgccacgaccggtacgcatcacactgtagctgaccgattcggcgctatcggcacgcaaggcaagcacgcgacgtgcatcatcctgcccaaggaaatcggtcgccaccatcggcagtccagcatcgctggtctttacctggctgtgatcgcattcgacatagttgaatcccgcacaggccacgacggagacggccaacaggcaaaccaatacggcacgacccacatgcgaggcaatcgacactgccttcgagccgcgtccttcgatttcgacggcgccggtcttctcatgctgtctcagcatgacgaaacgtcgaaccgcgccgcccgacatcatgcagatgcaggcgagcaagcccatcatcgcatatgtggttcccggaagcatggaaccggagaccggaccatccacatcgacggccaccgcaatcgccgcggacagcaaggccgtcgccaatcccgcgaacacggcgacccacatcatacgggacacgcgcagcacgaaaggcaacaccaatgacaccgcggccagcaatacgatcaacgccagtatggaaaccgccacataccgccatgcgccaccgtcggcgccgatgccgaatacccgcagcaacagatcggacagattcgcgacgaccggtttgtcatcatgcgcggaggagggcagcatgacgctgccgaacagctgacgccatgtaccgtcggaagcgaaacgaacggcattgaccaacgtcggcgcgcatacgaacgccgccggaagcggaatcagcagcaacgcgggcttatgggagcggacgaacagcaggaatcccaggaaggtgagcatcagcggcagcaacaactgcggctgcgcggcgacgaccggaatgaaacacagcgccgcaaccgccgccgcctggaccgacgcgtggggattgaccagatcctccgtccgatacatgccgaccgcacggaacgagaaggcgaaagcggccggaagaaacaccatgaccgtcagcatcgtgacatccgcgtcatcataaagtcccatggacaacgccaacgcgaaccacgccaacgcgaccacgcagcgcaccgcatccgagcgggtgaagatgccggccagcgcccagaaggaaaacaccatgagcggggctgcaaggaagaacatcagtccgacagctccggcaacatgtccaccagtgagcaccgacgccagcgcaagcaccaacagccatggcgcgttaggcgcactgatgcccgtgcctgaggcatacgaccatgacgtggtcgcggtatgaagcaactgggtgaagctcgcgcccgtgggcaacagctgtgcggaatacatcgacgcacccgaacatacggaacgaagcacgtcccaatacagcacgactatccatatgccggcaatcagcgccgcgccgaaggccaatccccatctacgcagcaaccgtttacgcagatggtccttctcaagaggactgagcagcacgacatccctctggtcgcgcaacgcacggcgacggtcaagccattccctgacctgccgatgattcgcagacagcgtggatagcgatttaagcgtgaccttgctttgcctgcgtaaccgcgcacgggcgcgccaagcaccccgcagacgcagcagcgcacgccacggcatcgccagctcgcagcatgcatgatacggctgtttgcgcgccaagcaaagcacggccaatcccaacgactggatgatggaccacagccaaagcaacggccaccatgaacggtgcatgtcagtgtacgcgtatttggcattcgcctcgcgtacggcaagatacggatcgatgcgaccgtcctcgtcttccacagggcgcccgttcttggaacggattccttcgaatcgggctcttctgtgggcgatgcgagcctggggaaccactacgacacgcccaccgccaagacatatgcggcggcacaggtccgtggattccgcgaaggtgccgaaccaggggtcagccccttcgaacgcacgcaacgtagccaacggcaccaacgcgcccgatagggagaccgacagcacatcctgacgcccgtcatattgctcctggtcaggctcgccgtcgaccaccaaggaaacgacatcatggtgcccggcatacaaacccacattgtgcaggttcttcgcctgccaatccaactgcttggcaccgagcagcgcggctgtcggcgtgtttctccacgcatccagcaacgtctcgaagcaccggtcatccgccggccgcgaatcgtcatgcaaggtccacaacgcgcggatgccggcatcaatgccgatctgatccatcgcacgcgttacagcgtccatgaaggacgccgcctgcttcactcccaccagaatgaccctcaccgttttggcttccggcacttccgtaagcacatcctgtgatgagtgaatgacatcgaaggtcatctgcatgggctgctcgatctgccccgtgcaatcggcgataacgatcattcctggaagcatgcgctgcgcaagcaccgctccaacggtagaagcgaggaatcgaaggtcatgctgcgcggtgatcaccgcagccacggacatatcgacgtcctgccgatgcgtatacggtctgctgttcagcacatcggtcacgattgtctggatatcgctgctggcgttagaattcataatttaagtgtacgcacgggacgcaccatgccttcaagcccgttccttgtgctcttttttgtagcgacgacgctcacgctcgctcataccgccccagataccgaaacgctcatcatggtcgatggcccatttcagacactgttcacggacttcacactgggcgcaaaccctcttcgcatccctggtggaaccgcctttttccgggaagaatgcttcgggatcggtctgcgagcacagcgctttgtgctgccaagacacgtcatcatcccgcttgaacaaaccccacagttcagcaagcggattctcagaagactcatcagtcacgccccacatgagtcctcccataattgtgtgcgcaccttttatgcgcatactttcacaccgcttcaaattacacacacgcaatgtaattttgtcaagtttccccgtgtcaatgcctatatttcagaaaatccatgctaaagttcagcccaatctggggtctacagtcgcagaatcggtgaaaatcggccattaaccctataattgcccatttggatagtggtaggttctaaaagcattgcgtcaaacgcgcatctcaatcaggaaggcaacaccgtggcaacgtcatcaaccggcaataagcttcctaacatcaatggtcttcaggatgcgaaaccacgtcacagcctgggatatcgcgtgcagcatcacgtcaggaccgcagtcgccgcggcaatcgccgcgactctggtgttcgtcggcactgcagctgccgctacttggatggacgtcaatggcatcatcaagaacaattcggtcgacgtgatcggccagggttccctgaatacggacgcatccatcatcgatccgaactccggcaagccgatcgagttcgtgctgatcggacaggattcccgtgacggcgcggagaaccaagccatcggaggcagtttcgatgacgtcatcggcaaccatcaggccgacaccgccatgattgtgcagatctccgccgaccgcaaggaaatcaacctggtctccattccacgagattccctggtggacgtgcctcagtgcgaaacgtcgaagggcacgattcccgcacagtataacgtcatgttcaattccatcttcgcaggtgcctacaaaaccggcggagatctctcctcggcggccagctgcacgctgaacgccgtgaacagtctcaccgggttgaatattcagaacttcatcgtcgtggacttcgccggcctggtcaagatgattgattcagtcggcggcgtggacctgtgcattccgcagaacgtcaacgacccgtacaccggactcaatctcgacaagggcatgcaccatcttgacggcgttgcggcgacgcagtacgcccggatccgtcacggcataggagacggatccgacacctcgcgtaccacacgtcagcagtatctcatcaagcagctgatgagcgaggcgctcagcaagaatctgttcactgataccgcgcagctgtaccagctggcgaaatccgcgctgaaatcgctcaacatatcccaaggcatggctgataccgcggctttggcgggacttgccatgagcctgaagaatttcaccatgaccaacctgcagacccagaccgtccccgtggtcccagcaccgtccgaccccaaccgttccgtctggaccgacgaagccgacaatctctgggagaagatgcgagcgggcaagccgattttcgataccgccgattcaaactcgggcgactcctccgacaccagttcagataattcagccagctccgacgattccggcacgaccgacagcaaccagtcggacaccactgccgagactcccgatcccgtcacgggactgatcaccaaatccgacggcacgttggtcgatccaagcactggcggcaccgtcgacccggatgacggctccattcatgacgcgaccacgggccagtatatcggccttgcggatcgataccttaatgcgaccgtatgtgccgttccggcaaagaactgacgtagaccacgcaatcacgtcccctttcaacgtatgacgcagggacgaatctttttggaggaaccatgagtgaaggcaaaggagcaaaagagcctacgagcgtgccaccaagtttcattccgtcatcaggacgcaaaaaaaccatgccgtccacggattcctcccgctcgcaaagcgcaccgagccagccagcgagtttcgcaccggcgaaacgttctgaccatgcatcatccgtaaaaccggccaaacgcacggcgcgtccttcttcctcggttccgcaaagcttccagcctgcagcacgggcaacgagcgagacaagaagaaacccttcatcatctccggtgtccttcgctccagaacatacccgcacggccaatccaacgcagcagttccgggggtcatcctccgtctccacggcgctccgatctgttccatcctctccagcgacggcttccgtgccaaaaagaagacctcgcgtcggacgtatcgtcctttccattttccttgtactgattctcgcactgggaataggggtattctccgcttggaactgggtcgatgaccagctcaacaaacagacctggctgacatccaaagcggacaccgccggcgaaagctggcttattcttggctccgacgaacgtgagggcaccatcggagacgccggcgacgtcgaaggtttcagaaccgacaccattcttgtactcaccaagccgaagacaggatcgtcctcgctgatttccattcctcgcgattccctggtggaaatcgatgggagctatatgaagatcaacgccgtggcgcagctgtacagccgcaaacagttggtcaacgaggtggaggacatcaccggccagaaaatcaaccatgtggcaatggtccgcttcggcggactcgtcaaagtggtcgatgccttgggaggcgtggacctatgctacgaccagaatgtgaatgacccttattcgggtatgaactggaccgccggatgccacaccgtggacggcaacaccgctttggcgttctcccgtatgcgatatgccgatgtgcaaggcgatttcggccgtgccgcacgtcagcgccaggtgatcaacgccatcgtcaagaagggcgcttccaaacagacgctcacgaatttcaacaagaccaaaaaggtcgccgcagcggcgttgagctccgtaaccgtggatgagaaagcatcgacttcctctctgcttcggatggcgttggctttcaaaagcgcctcaggcaaggatggcatttcgggaagcgtgtattggaccgatccggactattacgtcgatggggtcggatcgtgcgttctgctgaatgacgcgaagaacatccagcttttctccgaactctcacacggcacgcattccgcaggaaccgtgggcacgctggccgaacagcaaaactgacgacacgccggaggatgtggataacccacatcctccgaccacaaccctcatattggcttgcggcatgccgccgctcttgcccatgctggccgtatgaacaaaaaggcccctcaccgtataagcgaacaacatctcactgtattgagttggagcgcgcctttgctggcgcagctcatcatgctgattgtcatgtgtatgcaacgtcattggctctatgcggcgatgctcgctccgagtctgctcggcagcgcattgatgctcatcaccatgatcatgcgcgtcaggcatgaagaaacgaacagcaacaccattactggaagcgattcgccggttccaacgcatcataacggaaacgaaatcgaccatgctcagcttttcgccgacatgccgtccataagttttgagcatctgcatggcctggacaacgacccgctcatatggcgcaccatcgtgcgtaattggcttgtccgttccccaacgaacggcatcggcatgtcagaacatggcatattccatatagatctggcatcatccggaccacatgccatggtcgcggggaccacaggctcggggaaatccgaactgctgatcagttggtgcatggcattggcgattcggcatagtcctcaaaccctccatttcgtctttctggatttcaaaggaggatcgaccttcaacgctttggagcgtctgccgcataccgtgggcaacgtctgcgatcttgacctcgcccatgccgtccgtgcgctgaacgccatagaacaagaattggcacgcagggaggccttggtaagtgccgaacgcgtttccagattcgaccagctttcccatccccctgcacggctcgtggtggtcattgacgaattccatgcattgcgcgaccgtctacccgactatatgcagcgactcaatcgattggcgtcgctcggacgctctttgggtatgcatctcatcgtatgcacgcaaaatcccatgggtcaggtccatgccgatatgaaggccaacatatcgctgagcatctgcctacgcgtcaccgaccaaatgcaatcgaatgaactgatcggcaccaaggatgcagctttgattccaccggccttccccggtgccgcttactgtcatgacggtcaacgcactgttcctttccgctgcagcgcggtccatgacattgattccttggtgcatgccatcaacaccgcatcggcattcagcggcaccaccaatccctcccctttgttctccgcgccgctcgcaccacatgcaggcaaagacgatttgacggcgccacagcgagaggcatggcaccatgtgccttttgctttgagcgacgacggtgtactcatctccaccgcattccttgacgtaggacacggcaacatcgccgtgattggcgcatgcggaagcggcaaaaccaatctgctgctctgctgcgccagccgtctctatgaatccggtcgctgcaccatccggttcacacgcaagacgaacagcgaatggaccaccgacgacggcagaacatcgccgcagcacgaacgcaccatatggttcgtggatgacgccgacgaattgctctcccctttcgcagccatgcccgaagccgataagctcaagaccgcactcgccgatccgtccgtcacggtaatcgcagctgtggaaaagccgcaaagcaccctacttgaacgttgcctcacacgtgttgcgtttccttgcggagaaagagccaccgatgtgatgatggggattcccagcgcggttctcgacggtttcggcgtcgatgactatgccattgccgggcgtggggtcttcatccaacaagcacgggcatgtcccgtgcaatgcgcggaattccaaggattctaaaaaaacctggcttcttttgcgaaaaagtcttgaaaaatcatccgattcgtggttatctaaataacggatagaacgccacttatggcaagaggaaggcgattacatgagcagtgctttcgattggcgagccaaggccgcgtgccgggataaggatccggaactgtttttcccggtcggcaacaccggtgccgcctatcagcaaatcgaagaagccaaggccgtttgccgtacctgcaaggtgattgacgcgtgtctgaaatgcgcgctcgacaccaatcaggactacggcgtttggggcggtctgagcgaagacgagcggcgcgcgctcaagcggcgcgcgatgcgtgcacgtcgctcgcaggccatgcagatgcaggtctgattcttttcagggcatatggaagggccggtcggattcgatggaatccgaccggcccttccatatgccattccagttctagaggtcagttatcttgcgcggcacgcagtttcatgtcgagcaccacacgggtaccaccaccgcgacgtggctcccaatgcaccgttccgccaaaatcattggtgacgaacgtgttgatgatctgtgttccaagccctgatccggaagagcgagccatgccatcatgctcctcatccgccaagccggtgccatcatcctccaccaccacgttgaggttattgccaccgcggcccacggaaatcgtgatatgtccttccttacgtccttcgaaaccgtgttccaccgaattggtgatcagttcggtaagcaccaacgatagcggcgtggcatcctgtgccggcatcatgccgaatttgcctacgaaatcgacatcgatgtgctggtcgcgcatcgtagccaaatcgacggccatcttaagcaggttggaaatgaccttgtcatagtcgacgatctcatcggcggtctggctcaatccctcatgcaccatggcgatggtctgcacgcggcgctgtgcttccttgagctcctttttgacctcttcggacttggtcttgcgcgcctgcaagcgcagcaacgcggataccgcctgaagattgttcttcacacgatggtgaatctcggaaatggtggcgtccttggtctgcaattccttctcgcggcggcgcaattcgctgacgtcacggcacagcacgataccacccacgcgaccattggcgtccatcaacggcagagagcgcatggacaccgcggctttgttggcgtccaattcggaatccaccgcggctttgccgctcagtaccaatggcagcgtttccagcaccggatcgttctcatgcagcagtttggtgccgatctcgctcagatactccccctgcatggtgctgaccgatcccaaacgacggaaacagctgatggcgttcggagacgcgtatcggacgatgccgtcgacggtgagcacgatgaagccatccgccacacgtgcgttatggcgctggttcataaccgggttacggtacgggaactggccgcgcggaatcatctcatacagctgtttgccggcgctgatgctttcggactcataacggccgttcgattcgcgtgtggccatgttggtctcgcggaccaccaagccaagcgtcttgccattatgacgcaccggggcgtacacgttgcagaccttggccttgccgaccgtacgcagtttcgaggagcggaacaccgattcggagtccatggccgcgtcaagctcggcgcacagggattccgggacgacgttgccgaccacatcctcggctctcagactcatcaccgtggacggacggcattgctcggcaatgatgtacttgccctcgccgttctgcaggattagcagcaagtcggcgaaactcaaatcggcaatcacctgccaatcggccaccaactggtgcaaccattcacgatcgtcgtcaccgaaatccggacgggtcatcaggatatgtgagaaatcagccatgcaaccataatacgcatcaatggcgaggttgcataccatatgcccacgtataatgcggaaacgccgattgacatatccgacggttacgctaacgtaggttacggttccgtaacttatagtggaggcatccgatggcgaaacctacaaacgcagaaatcgaggcgaaacgcgcggtcatcgccgaagcacgcgagcaggccctgcaggcgaaagctgagaccattcgcgtgaaggcgcacaataaggccgagaacattcgacgcaaggcggatgcaaaagccaaacgtgccatcgccaaaggcgaagcccatgccgcaaaaatcgaaggcatcgtccccgccgaaatcgaacgcaaaatcagactcgacgtgcatggcaggccaaagccgctcctgcgtggctggatccacgccatcgccactcccctggctcttgccgcgggcatcgtgctgatctgcctcgctcatggcaccgggctcaaatgggcgtgcgccgtgttcatgacctgctcgctggtactgttcggcaattccgcctgttatcatctgggagattggtcaccacgggttaccgatgtgctccgtcgcatcgaccatatgaacatctttttgctgatcgccggcacttatacgcccgtttccttcgcgctcacgccattctggcgtgattccatcatcgcgggcatgtggatctgcaccacggtggcgctcatcatccatgtcatctggatcagcgcgcctcgctggctttatgttcttgtctatattattttcggcgtgtccggcgtcgcgttcatgggattgttctggatgtccccctatgccggacctaccgtggtgatactgctgtgtgccggcggcgcctgctatatcgccggagccatcgtgtatgcgctgcgcaagcccgacccctggccgaaggtgttcggcttccatgagatcttccataccggaaccgtggcgggatacgcctgccacatggtggccatctacatggtgatcgtgcaattgtggccctaaggcgtaatcaaccccacatggacaaaacaaaataagcccgtcccctcatcgtacgaatgcgatggaggaacgggctgttgttttcgtcacacgtatgtcaggcgagcggcttggcttccttgatggtcacggaaatctcacggccgttcggagcggtataggtcaccgtatctccggcatgagcgccattgatggcggcgccaatcggcgattcaggactgatgatgctgtaatccgtggcgatggacaggtctcgcgtgccaagcacgtacaccatttcacgtccgttgacttcaagggtcactagggatccgtcaccgacctcaccggccttgggcgcagtcagaatcttcgcattgcgcagtttgacggtcagttcgtcgatgcgtccctgattcacgcgctgcgcctcacgggcagcctgatagccgccgttctcgctcaaatcgccttcggcacgcgccgcggagaccttggacagaatctcgtcacggtactcgccctcacgccaggcgagttcttctttcatcttgtcgtacgcctcctgcgtcagcaggatcgtcttttcttcggccatgttatcctccttgaccttggaagaatgatacccgtcaatcagcgggtggagatgatgtcgatcacgaacaccagcgtgtcctcgccgccgatgccggcctgcggaacaccacgggagccataaccgtactccggcggaatggacaccaccaggcgggaaccgacgttgtgtcccggaacggtctgatcccagcccttgatgacctgtcccacaccgatgccgaacgtggccggctggtgacggtcgaagctggagtcgaacggggtgtccttgccccagaccacaccatggtagttgacggtgacggtgtctccacggcggaccatcgggccattgccttcaaagagctccacgaccttcaggccggcgggagcgatctcagtcgggaattcgatggtcgggcgatcgccgaattcggcattgacaacaggcatttcagatgccatggtgaacctccttgaaaaaacacagtgtcaccaagattagcaccatccatcgctagcattcaacaacattgaccgcaagaccgcctttcgacgtctccttgtacttggccatcatgtcctcgccggtgtccttcatggttttgatggcttggtcaagactcacgatatgcgtgccgtcgcccagcatggccatacggaccgcgttgatggcggtattggccgccatggcgttgcgttcgatgcagggaatctgcaccagaccaccgaccggatcgcaggtcagtcccagattgtgctcgataccgatttccgcggcattctccacttggtgaggcgtgccgcccatcacggcgcacagccccgccgcggccatggaacaggctgtgccgacctcgccttgacatccgacttcggcaccggaaatggacgcgttgcgtttgaacaagtatccaatcgcccctgcggtcagcaggaacgtcaccacaccatcctcatccgcatgatccacgaaatgccaataatagtggagcaccgccggaatgacgccagccgcaccgttggtaggcgcggtgacgatgcgtccgcctgccgcgttctcctcggaaaccgccaatgcgaacaggtcgacccatgcggcgtccgatgattcgagtacggcgtcggagcgcctgccgtcccgtttgagcacgtcgctgttggatgcgagccttgcatacatttttggcgccctgcggggcacgtcaaggccgccaggcagaacggtttggttggtattgcaaccgtgctgcacgcagcggcgcatcacatgccatacagtgtccaaatcgctgcgcacctgcacggcggaccgcatggccgtctcattggcccacaccacatcggccacactcatgtgacgttcatcgcacagcgagatcagttcgtcgcatgtggtgaacggatagggcatgtccatatcgatatcggttgaggaatcgtcggtctgatcggcgaaggccgttcccgcagggggtttctcatggatgccgatcatcaggtcgtcggcgtcgccttgtctgacgaatccaccgccaatggaataccagacctgttcatcgatgagattgttctgccggtcgaaggcttggaatcgcatgccgttgggatgggccgccatgcggtgccatacatccatcaccacatcgcgtccgtaatcgaaatcgatgcgatgcgtgccgttgagcatcagctcgccgcctgcctcgcattccatacggatattgctcatgtgatcggtatcgacggttttcggtacgttgccttccaagcccgccaccgtggcgcgatcggtaccgtgcccaagaccggtcagggcgagcgaaccatacagtaccgttcgcacgcggccgacccggttcagtatgccgtcacgttcaagggaggcagcgaatctgctggccgcgaccatcggccctacggtgtgcgacgagctggggccgacgccgatggtgaacatctccagaatgctgaacatgtatattgcgctctcttttccgcgtcttcgccgtcacgccgcgtaaagcacgctgaacatgcgaatcatgatgagtaggccgatgatggcaatgacgatttccgcgataagcagaattatcgcaacggttttgcgattgccgagtttgacgtcgagcagttttgcgaaaaggaaagcgacgaagcccaaggctgctccgttcagcgcgatcgcgccgacctggccgttggtaagaacgctttccccgaccttggcgagtatcgaattgatggtggcggtgaacaccagcaggctccatacgccgtatccaatcaatcctaccgccgcatagccgaacgggcggaatcgttccttgagtttgaaagtgaacgattcggcgcaccacaacaatgcgaagcccacaacgaaggtgaacgccacggcaaggaatgcggcttccaatgcccacggaacgagtgccaacgaatggtccatcaaggtaaagtacagcggagaacatgcgatttcgccgatagcgagcacgccggcaacgataatcacctgcgcaagcatcagggggatttcagtggcgagctgttcgattacaggcttgatgtctttcgaagtcatgcgtcatccgtttcagtcggtgtcatacggtttgtaatgtccgacagtgtacctacggaatgtttcgggaacgatatgccacattttgcctacacattgcccacatttttccataacccaccgtggaaaagggttgaatcgcagtgaatcgcgatgatgccaaaaccgttggagaataaaggaaaaccgccatctctggcggtttccaaaagtgcctccagcgggactcgaacccacaggagaaaagcttcaaacacttgccgtttcaacggttccatcaatgccttgcgtcgcttttgcccacattttgcccacattctgcgaaaagagcaaaccgcccattctctccgacaaatcgtccagatcatcgtcgaaaaggtcggcatacacgtcgagcgtcatggcggcggacttgtgccccaattgcctttgcacggtcttgacattagcgccggactgcaccatgagcgaagcggcggtatgccgcagatcgtgaatcgtcatgtggccacgccccacgcccgcgcggcgaagcgccaccgcgaaccacccatcgtgccgcgtcggattccagccgttgcccatcggctcgtccagaggctcgccgggagcggtgaaaagaaaatcggacggctcgcgcccctcgcattgcttggcgagcagcggacgcaacaccagggggaacatcaccgagcgtccatcatgggttttcgggtcggtctccaccatcctgctggaaagacgcgtgatgctcctatatatatgcagccgacagcgttgcagatcgacatcctcgacacggagcgccacaagctcaccccacctcatgccgcacaggcccaaggtcagcacgatcggctcacgccacccgcactgcatcgccacacgagacaattcgtcagccgagagatagacgtgcttccgcacctgcttgcgcggcagctcgatgccgtcgcatggattgtcgtggatgcaccgatcggcctttgccctctccatgaggctgcgaagcagattctcggcgcgaatcgtcaccgacgcactgcgtcgtcctgccagatcggtgacccaccgctgcacttcgtcgcgcgtgattgactgcatctccctcatgccccactgcggctccacatgcactcgccaagcgtcttccagcgacttgatgtagcttggcttcgccttggtcttcttggcggccagccacggctcccagaagtcctccacgagcctgcgcccggcttgcgggtcgatgtatgctccgacgtttttcgccgtggtgacattggcggcgccccacgcgtcggcgtccatcttgcgcttgaagccacgccttccggtggacgaaccgtccggcttacggtagcgcacctcgtatctttttccgtctttggtggcgtattgtctgattgtgtaggccatgctcgccccttcgtttgcgtggcatcaagtctatcaatccgttgattttttctctgttttttgtgtttcggcttgcaatactttacatactttgttataatagttatgtcaacggaaaggaggtgagcatgaaatggacggacatcgtgaccgccatcagctcggtggtgagcaacatcatcgcactggcggcgctcatcatctcgatacggcgccgaccacgccataagagatgacgaaagggttccgagcagacctagtgcccggaaccccggttccatcctatttcatggccatcatgaaaacaagcaccatattcgccgtctgcggcatcacatgcggcctgctgtcggccatgctcggcttcgctggaaaaccatggcaggccggactgttcggactcgcggccggcatctggagccttgccacgctcgccatggacagacggggcggcaaggatgactgaacgctatctgagcatgaccgaggtggccgaacgcctcggaatcaccaaaggcgcactggcacgctacaggctgcccgacccggacgtggttgtcggcaaggccagaggctggcgcgaggacaccatcgaccaatggaacgcacaacgccccggccgcggtgtcggcggaggaaggccacgcaaacacgccgaataacaagaaaaagcccctcccccagcaatgctgagagaggggcaatgtttaaccgagttttccgatgatccgcttctcgttttcgctgagcggccatatggtcacgtcctccgcggccttcagctccgcggccttcagctccgcggccttcagctccgcggccttagcttcgctcaggagatagccgccgccgtagatggccttcttcacggccttctgcgagtcgagagccctcgtgaacgcaacatctgaagccttgacgcagaactcgacctgcttgccaatcttcccgagcctgctcacggtaagcagttcacgcggatacgcgtatttcggcggatgcctgcgttgctctttcctgacgcgcttcacggtctcgtcgatcgcgttggccaagtccggcgcggtgcggatcaggtcatcaccgaaactcgtcacgaacgacgtgttgacctgcgcgccgttcgcgtattcgatggtcgaatccgtgacgatcatgtgcgccccattgcgcgacgtgctggagaagatcgtgagatacggcgcgaacaggaagaacgggatatgacggtcacggtagaacgtgcatatcttcgatagaatcgagaaaggtggattgtccaccaccaccttgccgtccgaatagtcgaaccgctcgtaatcgccgcccggatagaacgggcgcaccaccttatcagggtctataccgtattcccggcaagcccagtcttttatcgcctcatacactgcggggggggtgtagcagtcgtccgtggtcttcttcggtttgaatttctccacgaacgacccataatcgtcaatcgtctgctgtctgatgcccattttgaaagtcctaaaaataaggcccctcctccatgatggagaaggggcaaatgttaaaaaacgggtgtaaaaaattccacggacactacagtgccgcaaatttttccacacctgatgttgagtttccgtcgcgagtttgagtctcacgccagaaaaatcaatcacggcgcagcggattgtaggccactccgagaccgctggcgatgaagccggccacggtcgaaatgtagccgccgacagccgcatcaccaaaggtcatgaaaccaaggccaacgcaagaggcgaccaagccaagcacgtagaccacggtcctcacctgcttgctgaaaaccggcgtatacacgtccggcggctggttgtcctgaccatcctcacgctcgttggtcaggttgttgactgtagtttccaaagtcgtttgcgctgcatgctgagccattgaaacctccctagaatcgtccttggttgagcgccgactgcaaggcgcgtgcggtcgcagggccgaagctcgcatcctgagccaacccgtaatgcgcttggatggcgcgaatggtggccggtccgagcagaccatcaacaccacagcccaggcgacgctgcacggcacggatcagatcactgccgccagcgccgtagcggaccacgctcgaatcgatggcgggacgcgcgtaagtcctgccgtcaggcacctgctggccgctgatgatgccatccaccgcggtgcccatcacctgctgccaacggcggacagtggccggaccaacattgccgtcaaccgcgagagcgccggcggaagccgaagagacgccgccgtagcgcaaatagcagttccacggatagttgtagtagcccctgatatttgtctcgcgggcggtctgatcgcccgccctgccatacgcggtgccacgctccgagatgcttgcctgcgcgagcctgccgccacccagatagaccgcgacgtggtgcacgtcgttgagcaggatgtcgcccggctgcggactgccgttgacgggcagacgcctccacccacgcttggtcagattgtcggacaggttgccggtgtaggtggcgctgccggtgtcaaaacccgcctcgcgcaggcagtggattaccaggctggagcagtcgcagttgcccgacgaagcgttaaaattccaacggtccgcctgcgaatagcccaagttggccacggcgcaccagtagcgcatgcggttgatcaaagcgccgacgcttgccatgctcagtcctccaatccatctacggccttggccgcatcctcctcggacacgacctgaatgttctcgggcggcagactgtcgccctgcggtgtcatctctggtgtcatgacggtgttctcgtccatgacgcttcctccttccgccccgttttggggcatgaaaaaaggccatccgatcacgaatggccttatggttgaaaaatgctcagcgcttgtgcgcgccatgattgaacatgagaatgagcgcgagcagcagcaggtatatgccgcctgcgatggctagacgtgtcattgccggtcctccaaatatttttctgcggcagcgattatccagcattgcgcgtccaatttctcaagcttcgacagctcgtagctgacggcctcgctgtggtcggtatccttgtcgccgtaaatcaggctgatgatcgtgtttttgatcgtgtcacgacacaactcgtccatgcggtcgaaataagaaaattgacgatcgccttataaggaaaggcgcatcgcacaaaaaccccatcatcgtttgaccgatccctcggcaccacgatcgaaacgaccatggccgatgatgaactggcaatcattgactataaagaagtagtacaaatacgctcttgagttctcaaaccaccaccactcacccacctcgcggaccggaaccatccggaccactcgctgagcggcagcaagagataaacttacagcacgatcgcgatccgcgcaacccgggccgcatgaacaacgcgtgaaccgttggaaatccaacgttccatcggcgtgtcgaaacttgacaaatcagagcctcttgttctcccaatcgcccatttcgacgccacgcagccacgcaacacacgtgatcactggcagttgaactggtacaacgcccagcccttcgcatatgaagccatattcgaataatcctgaaccttgcgcatcgtgccatctttggcgtactggtcgatcagcttctgatcgtggaacgtgtcgtactgctgcttgaacgtgaacatctgcaggctcggcgcctggccgcccatgctcaggaagtatgcatcgccatccgcgctcagcgggcagacggtattcgtcagcaccttgccgtcgcccgacgcgaacgcattctccgtctgaccgaaaatcgcaccattcttctcggccttcgcgttgtaaatcgggaacagcatatccgcgccgtacatcgccgtcgcatacatggaaccgttcagcggatcggaaaccaccaccgaatcggtaccagtctccttcaccaccttcttgagaatcttctccttcgtggcagtgagctgctcgtccggccgcgcatcgtcaatcgtcatattcgcatagacggcatccgacagggcggaacgaacagtattgccgaattggcaggaaatggcgagcgccgcaagcagaacaatcgcaatgattttcgtgacgttcggcagacggccggcacgcaacaatacgacggcggcgaagacgatcagcggcagcacgccgaacggaatcatggtaagcggtcgggtttcggcgcgataccaggcggcggccacgatgttggggaaccagccggtcagcgcggtcgagcagacgtagacgagaccgaccaggaagaaggccagcagaatggcgatcgcgtcgcggcggagttgcgaggcgtcggaacgtggagtgcggtagctgacggaagtcttgcgattcctacgatcggcaggcatagccgcaaaatcggcaacctgttcgtgcggttgcgctgacgtgctatcggatgcacggtcaatcgcagaagcgccgggcacagtagcggaatcggcgcgattggcggcgaaccattgcgggcggatgatggctgcgacggtgacggcaaacgcgatcagcacgattgcggccatgaaccagccttgcacgccgccgatattgtcggtgacgtagattttgagcgcttcgggcaccgtgcggttcggaacgaaggtgtggaaccagctggcgggattgaagtagcggtccgattcgtagctggacatcatgtatacgaggaacacggcggcgccgagaaccactacgccagcaaggcctgcgatggctttccatggcagtcgcgtcagcacgaagggggccatgagcaggagccaggtgaacacgatgcgcggatgggcgaacatgcagacgccggcagtgacgaagaaccatatgatccatttgacgaggtgttcgcgggtggcgagcgcgtcgagcaggcgaagtgtggcgtacagccagaacggcagaagcgtggcggccaggccgaaggcgatcagcggaccggaagccagcatttggaaggggtgcgaggcggaagcgacggcgagcggggggatgatgagcgcgagtatcgcggggaatagcggaactacgacagacgcgacattgcgggccgaggactttcgtgcgttcgcaaatcggggggagcatacggattgtgccgaatgcgacaggcgacgcgtgaaataggaagcgtacagctgaatcgcaatcggccaaaccaagccggatgatgccagccagaccgtgttgaacgcggcgtaaatcgacagattgacgccgaacaagctggcgagcttaatcatgccggctgcaagcagatggaacaacggcggatagtattcgtcgttcggccacaggtgggtggccgcgccgacgccttcgccgaggatcttgcggatgaagtaatagtgcgcgggcgcgtcgatttcgtgcaatgggttcgtccaagcggcgggaccgtgcggaaaccaggcccatacgattgcggcggcgagcgcgacgccgatgacggaacagaccggcagtgcgatgcgggataggcggggaacggcggaatcgcaaggcaaaggagaagtatcgttcgtcgtcttgtttgctatcttgtccgtcgttttagccgtcgtttcgtctgtcgtcttgcttgcggcgactgcgctgtcggcttcatcgactgcgtcgccggccgctgtgggaatcgtattgtctgtgctgtgctgcttcatcgccatccatcgtagccgaagccgcgaaagcaagccacaaatcgcaatcgcacctgcattttgtaattcaaaactggaccgtgcggcaacaaaagctggaaaggcatctaaaaacggatggaacatgcgcgggatgggcgcaagacggacgcggaacgcgggaagaataggcggacgtagagcggagacgagcgcgagcaggaacaaaatcgccgcttatccaaccttcgattttcaggaagtattcagacttcacacagaggtataacagtgttgcgcaagaaaacaatcacgttggatgggcaggatgattgcacggggcgcattgcgctgtgagcgtactcgctgtcgttgcttgactgtgtgcgtcccggccaacgctggcgtcggcatgcgtcgacgcgtaactacagagaactggagaagtaccgcatgttcgttctcaagaacgcatgggctgcgctcggtcgcgtcaaatggcgtaccgcgctgacggctttgcttgcactgctggtgtcgttctcagccgccgtggatctggcggtgctgagagccgacgacaaggcgaataacgaaacataccaatcgcagaaagcttcggcggtaattcggccaagcgcgaaagtcactgcgaaacgcgacggcgcggactccaattacaccgccaattacatgacgtgggacatgtacaccaagtacgcggaagcggtgcagaagaacaacttgacgttcgaatacacgctcgccacgtcggtgccggtgcgcgccagcaagtcgctgcaggcgatcgcggcgaaaagcgacacgagcgaggacaataccggcggcaacctgacgttgcaagccttctacacgaacgatgcggcgaaaatcaacgactacggcacgttcaaagtggtcaagggcaagcagctgaactacaagacggccaacgacggcgtgctggtctctcaggcagtggccaagaagaacaatctcaaagtgggcgacaaggtgaccgtcggcaatccgacgaaggcttccgaaacctacaaattcaccgtgagcggcatctacgagtacaccggcgagacgccggccggatacggttccgacgcgaaatacgcgaaagacaaccgcgagaacgtggtgtacacgtcgtacatcaacttcgcgcaaagcggtctggatgtggccggcaccaagggctgggccatcccgaacctcaacatcatcttcacgctgaccgatccggccacatacaacaagttcgtgcgactggtgacaaaggccaagctggacacgtcaaagttcacaatctcatcgccgtcgcttgatgcgtacaagaagcgcatcgcaccgctggacgccgccgccaaggccgcgcgcacggcgttgttggcgaccctgatcgtcggcgggctcgcgctgctggcattagtgctgtgggccgcgatcggtggacgccgtgacgaaatcggcatggcgatggtttccggcgtcaccaagggacgtttgggatggcaattcatgctggaaacgttcatgatgaccgttccaggctgggcaatcggattgattgccggcgcgctgctggccaagccgcttggcaccgcatgggccggtggacaggctgtggccatcacatccgcatccgcgtggaacatgatctggtacggactgggcgcctgcctggttctgggcatcatcgcgttcatgcgcgtgggattcttcgatttgggtcagctgttcgcaggccgttctgacgattcgaacgaatctgccgaagcgaagaacgcagacgagccggaggaaacagtcgagtcgacggaacgtacggaggtgaacgcatgagcgagaaagacgtgaaagacaacgaaaccgaagcattgaacaacgctgctgcggaaaacgcggacatcgaggcgggcgaaaccgatatggccacgtcgatcgaatcggtcgatttcgcggtggtgtatgacgatggaggcgattccatcgcaaccgaatcggcagaaaacgcggaaaatacggaaggcatcgccacggaagacagcgttgccagcgacaacgcgaatcgcgtgaacgaaacgctcgcattgggcgcgaccgacgacgaacagtcgctcgaccagcacgaaaccgtacaggcggactccgcaaccagcgtgtcatcgcaaatcgaccgcgaaatcaaacatcatcgcaagaaggacgcattcttcttcaaggcgaacccgacattcgcgctcgaccatgtgacggtgcacaaccgcaaaaccggacgtgacgtgctcgacgacgtttccctggcgttccatgccggcgcgacccacgcggtgctggtggatgccgaagatgtcgaacagcatcaggcgctggtggccaccatggtcggcatgatgcggacgaccagcggcaacgtgatgcacaaaagcacgaacctcgccgacgcgacaccggtcgacgtgcttggacaccgcatcggtttcattccgcagcggttcgccgtgcgcggcgaccttgacgcggaaggcaacgtgctgtacgccatggacgcgtcgaaccgcaatttcctgcagcccaagccggtgattgcgcgcgagctgctcaagcgcgtgggattcgaggaagtgacttccggtctgccggtgggcaagatgagtgcgttggaccagcgtcgtgtggcaatcgcgcgtgcgctgagctgcgaggcggaggtgattattgccgacgagccgaccgctggattgaaccgtgacgacgccgccgtggtgctggggctgctgaagaaggccaagcgcgatgaagatcgtaagcgtgcgattattgtggtgaccgataatccggaggtcgccgatcagatggaacattgcgcggagcttgagtagcgagcggcgttctgcgaggcgaaagccttgcggactggtgttgcatgccagtccgcaaggcttttttcgtgctgattctggttcgtgccgattcgcgctggtttgcggtgacacaccgctaaaaacatgtcatatgcgctatgtgtggcagactctttcatctttggaatctcaaaccgctatgtgtggcagatcgtttgacgcctcgtgagttagagggtctgttttataccccctaatgtatggcgggaaaagagaagtgccacagatagcggttttcagtgcgcaaaactcgggcggcagccaggcttcgaggaattttcgggtgtatctcgcttatgaatggcggatttttccgctcgacgcgtgctatctcgcttatagatggcggatggttttgccgcatgagacttagaggggattgaacttgccccctaacacctagtcttcctgagacacccgccattcataagcgagatagcatccggcagacaccgaaatccgccattcataagcgagataagtaggttcgctactcggcgatgcgcatgtggtactgctcggcgagcggtttgacgtcgaggacgccgtaacgttccagaaggcgcagccattcgcgcttgttgctttcgccgaaacgggcggccttgcgcgtgtaggcttcggcggtcaggaacttcggcggaatcgacttgctgttgtacttgtccgccaccatgacgacctcctgctcgaggttcatcggcacgtagtcggccgggggcaacggcaatccctgcgattccacggtttcgcgggtgaggcccacacctgtgtggttgcgtgcgaactgggcgatcgattcgtcaacgccctcgttcagcaagtattcgtagcctttgagcccgtgctgaacatagtgcggaccgtcgaatttgagcggttcgccgtcggaaccgtcctgcttgagcaggaaatacgtgccgatgtcgtgcagcaaaccgccaatgaccaccagatgctcgtcgatgagccgcggcggaacggtacctccggtcagcccttccgtggacggcaccgcaggcatgtgcaacatgccgagcgattcctcgccggtattgtctttcgtcagttccagcccgaagtcgccggtcttttcgggagcgtccgtcggcagggtgcagcggcgggtgaacagcgcgttctgccggcgggccatgcggcgggcgatgtcggccacgaccacgcaatggccgtggataaggtcgtatgcggcttgcgattgcgcaattttgcgatgtagctcatccacttgcgcaagagtggggatatagccggtcgtcggcttgttcgattcggttgtttcgttcgattcgttcgtcatacgcccatcttaggcacgttccatcacgcccagcatacggttcctgacgcagtttccagaacggttcccaacagccgaagggattcatacaccacgccagataaatcccggaacggacacggattcaacggtttccccgtcttgtcaacgatgttccaaggaatgccgccttaaaacgagcattcatcagctgcccgcagcgaacggcacgatacgcggggacgttatgtgcggaaaatcagatggaacggacgcggaattcgccggtgcggttggaagccacgatcatctggtcgttttcgaggcgggtccagccgtcttcggcacgctggtcgaagccggagctggccacgaccacgcccttcggctgggcatcgtcgtttccaccgagcgcacggtagcgcagcacgcggtagtcgcgcgcctgctcgccacgaccgtactggtcgtagatttcgacgatgcgcttggaagtgacctcacggccggccgcgcacagggcgatgaactggtcctggctttggatcatgcagttgtagctggacttcggatagcttttgcgcagttcgcgcacggcctgcgccaccgcctcgtcgagtgcgaagccaaagccgatgtattgcaggatgacggcgaagaaaatggcggaatcggaacggccgccagtggactgcacgatgctcggatcgaccgggaacgcgcggttcgtaatgatgttgcggccctggtcgtcagaaatgtcgccattgtggatgaagctcaggccgttcgcatagaagggctgctggttctcaagaatcagcggcaggttggagctggccaggcgcaggtgccacaggccgccgcgcgccggagtgttggcgagctcgtcgaaaatcggatcatgacgggcggcgatggtgtttttgtagatcgcggtgccggtttccggagtcggcgcaccgccgtcgcgacggtatggcgattcgtctggcacggtgatcagcgcggcgccccagccgtcgttgtggatctcgctcagatttcggaaatcgcgcacgttctgcatgccgagcacgccattgaggttggtgttgctgcctgccgtcgcgaatccaagtaatctgcacatggttgattactttagcgacggcaggtttcgacgcgcgcgtgccgttatcggagttggttatagcctgcgattcagccgccgattcatacgcatcgcacgtcgcaaaacgcacgtcacgaacgtaagttgtcccgcaaacgagcaggaggaccgacatatcctgttgcagaccgtaaaaactcggcctgagcggcccggagcgtgtcggtaataggatatgacggtcctcctgcggacttggcggtattcagcaaaaggaaaagggctgggggcatcttgttcgtgacacactcaaggccgttcggccaagcctacggtcacaaacgaaatgtcccagccctccttgcgtagataagccgtgctcgcagagcggattcacacgcgcttcagacgcggcggacgctcggtggcgaggaacagcggctgaatctcaatcagcggattgtagggagcgagtccgaaccatttgaccggagagccggccaaatgacgaatcgcgtacttgatctgcagtgagatcgcgcccttctgggacaccttcgactcgggcatcaacgccttgtgaatcagcacgtagcggataggtccgatgttcggatcggcatccagcttcgggtagcgggtggtctgcttgggcagatcgccggacttcgacagatcgttcatgatctggtggatgtatgcaggaatcgactgcgacaccttgaagcccaagcgaatacgcacgcggaacaggaagtccgtgccgaaattctccaccgaatactcgcgcgtgaacgggttgtcggacgtttccaccgacaccgcccaccatgcgcgggcgcgcttcggatggtccgcgaaaatcgagaagaagatgtcggtatcgacacgcttcatttccggatcggacgtcagatagacgatgttgtccgtgaaatacggaatcgaatcgtcctcatgaagctgcttcagaaccggcacgcaatcggcgggctgcatatgccggcgttgcgcgcgttccagcttcgtgccttcgttccacgtgtacataatcagcagaatcgccaatgtcagcagcatggtgaaccagccaccgtgcaggaacttcgccatcgaagcgaagaagaacaggaactggatggccaggaacaccactgtgaacacgaccgcgccgacgcgcttgccatcgtgccaaatgtagacggccagcagaatcgtcgtggtgatcatcgtgacggtcaatgccaagccgtacgcggcggaaatatgctccgaatcgcggaacatcgccaaaaccagcagggtggagacgcacagcacggcgttgaccaccggaatgtacagctggccgcgggtacgagccggatagcgcacctgcaggtggggcatccagttgagtcgcgtcgcttcggaaaccatggtgtaggcgccggtgatcaacgcctgcgaagcgatcacgccggcgcacacggacagcagcaccgccacgtagcgtacggacggggtcatcatttcgaagaacggattgaggccgtgcatgtggttgtacgcggtgtcgtcccaatggttgagcatccacgcgccctggccgaaatagcagagcacaagggcgatcttgatgaacggccacgtgaagtagatgttgccgcggccgacgtggcccatgtcggaatacagcgcttcggcgccggtggtggacaggaacacggtgcccatgacggcgaggcctgccgcattgtggtggctgaagaggaactccacgccgtacaccggattcagcgcttcaagcacgctccaatcggagctcaggttcaccaagccgacgacggcgaggaacgagaaccagatcatgaccaccgtgccgaacgtgcggccgatgcgttcggtaccgcgcgactgcactgcgaacaggcagacgatgatcacaatggtgatcatcagcgtcagttctttgttttcgctcatgatcggttccagcagcggcagtgtttccaagccttccactgccgagctgatcgagacggccggcgtaagcacggaatcggcgaggaacgcggcgccgcccagcatggcgggaatcgcaagccatgccccatatttgcggatcagcgaatacagtgcgaagatgccgccttcgccgttgttgtcgatgcgcatggcgatgaacacgtatttgacggtggtgatcagcgtgatcgaccagaagaccagcgacaggatgcccagcaccgcggcgcgatccgtatgcgccaaaccgccttggccgttgaggaacgtctgcatggtgtacagcggcgaggtaccgatgtcgccgtataccacgccaagcgccacgatggccatggccggcgtgattttgtccgggccggactggagacggctccaccagcggccgatgcggcccttgctggcggcctcgtcaagtttcgcggcttcctgctgctgcgcctcgtgctccttgatgagcgtctggcgctcctccttggtcaggaccttgtgcgagacctttggcgcctgcgtgtacgtcgctgcgtgaagcagcggctgttcttcttcgttcggctcgttagccataacgcttcctccaagtggcgggccttccaacccgctccccaaaataaaacgcaaggtgtgacactaggagcctgacaaacagttgtcaaatcttcacatgacatctggcatgtcttgtcagcaattcaagtaagcttaattgtttgttttacttggattatgaagcgcttcactagatgccgtacaccacacgcgtcgtattgcgcgtggctttggcgatttcagccaacggtctgtcaagatagtcggcgagcgcctgcagggtgtacgggatcatatacggcgcgttggtgcggccgcggtagggcatcggacttaagtagggggcatcggtttcgaccatgacgtggctcatgccgacgagtttcgccgattcgcggattccgtcgttgcctttgtagctggatgtgccggaaaggctgagataccaaccgttttcgcgggcgatttcgcccatttcggcgtcgccggagtagctgtggaacacagtacgttcgggggctccgtcggcgagcaacgtttcaatgacttccttgtgcgagtcgcggtcatggatttgcatgggcaggttgagttccttggcgagcgcgacgtgggcgcggaacgcctcgcgttgcagttccttggcggattcgccggtacgaaacaggtccatgccggtttcgccgatggcgacgacctggttggggtaggtggtggcgaggcggtgcacttcggccatggcttcgtcgaaggggatgtcgtgccagggcttgtatttgatgggcaggccgtcggggccgggtgcgccgcggtggccgtgcagcacggcttcgttggggtgtatggcgattgcggcgtgcacggttccgggatgctcgcgggccatgtcgatggcggtcatgaggttgggcagctcgcaaccgcagtcgattacgccttcgacgccgactttctgggcttgttccagcagttcgtcgacgctgtagacgggtacttcgccttggcctttttccatggcttcgtgactcatggcttgggagaagggcacgacggatgcgacgtgggtgtggttgtcgatgacgtgcgcgtcttcgggcagcggctgtggggccggggcccaattacgattgcggtggtgcttgctcatgttttccagattagtcccgattggccctgcactgcgggcgaactctcgttcgagggttcaaacgagggtccgcccgtttcgcggcatacacgtcacttaatcgtgatggtggtgaacgaccatgccgatgccgtgtagtcgccgtctgtcagatcaatcgcggtctgccgcggcctggtcggtgattcctcaccgacctgtcccgcatacggattgtctccggctaggacggtggccgtggcggatgccgccgatgctgtggaaatattcaactcggcaagaatctgacgtaggtcgacgcttattggcgcgtccatggcattgaccacgcgcacgtaggtctctccggctttgtcattacgtgatacggtgacggtacgccttggctcgtccttaacctccgtgccatccgcaatcagcgttccatcgatgtacagcttcatggcttggccgcgatcggtgacgtcaacgtgcacctgccaagtggtgcccggtcgcacttcgttcatggagacttcggtgccggcaagcgcgtaggcggtgccgtcgcggaccacgcgcacgctgtgtcctcgaccaagtgagatgatgttgtggttcttgccgtcgatatcgccacagatgaggtccatgccccatcgtccctcgtaatagacgacggtagtgtcgatactgtaggaatcagcgtgcaggtcgagggcggtgtcgatggttctgccatcgtaggccacgttgccgagattaatcgtctccccggatgcggtggtgatgacaagattgttaaggtcggctttggcgttgcccgcgatgcgcagtctcacggtgtccggcagggtgcggcgcagcgtggacgggccttcgacggtgacgggccacgcggtgtcggccgtggtggtggcgtacatctgctgcacccaatagctgtagggatggtaggcgcgttcgttgtcgaagtagatgaggtccggattccagctatggtgcccattcttggcgaacagcggggcgtaggaggccatggccaccacatcgccgttgagttccatgcgtcccatgaaggccgcttcggacaggccgttgatcagttgggtgttccaggagccgtattcgccgaggtagaccttcggccccttgcggtccgtgtggtcgtagtggtcgaggttgtggaaccaccagctggacgactggtaggaatgttcgtcgacgatcggcagacccgcttcgcgcgcgtacttccagccttcctcgtaatcctgaccgctgggggcgggaccgacggtgccgacgacgacgatgtccggatatgcggctttgacggcgtcgaaaatctgctggaagcggttcttgaacacgtcgtcgataagatcctcgttgccgatgccgaggtattcgaggccgaacggctccggatggcccatggcggcgcgcttggcaccccattcggtggcggtgctgccgttgcagaattcgatgaggtggagcacttcatcgatgtaagcgggcatatcctcctgcgccaccggcaccgggccttggctggtgttttggcagctcacgccggcgggcagcaccggcagcggcttggcgccgatagtttcgcacaggcacaggtattcgtagtagccgatgcggaatgactggtggtagccccagaggttgaagttgtgcggacggtgctcgaccggtccgatggtgcggtcccagtggtacatgttgtccatgccgaggccgtgggtgatgcagccgccggggaatcgcatgaatcgtggtttgaggtcggcgagcgcctccaccagatccgggcggaagtgcttgagaccgtggtaggtggtgcgcggctccaaggtgacgaagtcgaggtcgatgacgccttcgccggcgaaggccagacgcaatgtgccctgtgtggccacgctcgagccggcatcgccgtgctcaggaacggtcagcgaggcttggtatgtcgtccatgccgaggctgagacggtgatggtgttttcggcgatgatgctgccgtcgtctccgcgcagcgagaccgtcaccggcatcgcgctttccgatcgcacgcgcatccaggcggtgaaatcgtaggtttctccggcgcggaacaccatgccgtcccagccggtgttgtccagcgcggcaggggcgtgttcgacttccaccgtcgcgtaatgcgggttttcggtggcgaccgggtcgttgtcatggatgcagaacgcggcgaacgagccttccggcacgattttgcgccagaagctgtagttgctccaatcgatggagtcggcgcggttgtattcgaaggcgccgttctgcacgaggtcggcgttgaggccgccgtcgccggagtagctgatgtcttcgaagaagatgccccacaggtcggtgctgatggcgcgcacgcccgctttgtcgagtgtggcggtgagtttgtcggtcatggtgtggccgtcagccggatattcgtcagccggggcgacggaaacggtggttgggatcgtcatcgaacctctcttttcgttcgggatcgctatgggggctgtgtcgcggaaagcaggacgccgtcatgcgaaccgtatatgtatcgttacatatactagcgcaaatccaatcatccgcaatggaggcaatatatcggtgagtctttgtatttgcaacgattttacagaatcaagagaatataatatcgttacatatcaatcataagttttcaaggagcggcatatgaccagcagcacaccgacgctacgcgacgtggccgcggaagcgggcgtctcccccatgaccgcgtcgaacgcgctgcgcggcaagccaggcgtcaaggaatcgacccgcgccaaagtgatcgccgcagcgaagaaactcaattaccgcatcaatctgacggccagcatgctcaaatcgggccgcagcaacatcatccacgtcatcgtcaacgaattcgattcgccgttctattcaaagctcacgcaggcgttgagcaacgaaatcgtgtcccgcggacttattccattcatcgagcagacgcagtattcgccggacgctgccgagcacgcgctgagcagcaatccgttctccgggcagctgttcgatggcgagatcctgcacgccacaggcttgggcacaaatgtgccgctggccaaactcaatggcggcagaccattcgtgctgctggacgcctgcgaggagacgccgaccgtcgatgccgtgaacttccccaacgaggaggccgaacgcgcggcgatgcagcatctcatcgaccgtggatgccgcaatatcgcgatcgtcggccaccggttcgccccccgcgccgatctggcgcatgcccagaacgcgttcgctctgcgattgcgcggcgcatgcggagcgctgtccgacgccggactgccctatgacgagtcgatggtgttcgaagccggggatgtggccaatggcatcatcgccgggcatgcgattgcggaacgtattctcgccgcacggagcggacatggtggcaccgagttcgacggcgcgtgctgcgccaacgatttcgcggcgttcggcgtgatacgcgggctcgcggaccgcggactgcgcgtgccgcaggacgtgaaggtgatcggtttcgacggcgtgacctccgggtcgtacacgacgccggcgttgagcaccatccaggtcgatttcacgcagcttgcgaaattctcggtcgacatgctgtccgagcgtatcgatcatggagcagacgaggcgttgccgccaagacgggccatcatcggctaccagctggtggaccgggaatcgaccgcggtctgaggatgacgcccctatggcaggcaatccgccataggcagcagccttcgcggccaatcccactcaatcggaatcactcaatcggaatcaatcgccatcattcatcaaggaatctctaggagcatcatgagcatcgacacccaggcctatctgttcgtgcatttcgtcggcgaggaacgcaatcccaccgacgaacagctgtacttcgcgctgagccgcgacggcgtgcattggagggatctgcgcccggccggcagtccggcgttgacgtggctaggcggcgagaagggcgtgcgcgacccgcatattgtgcgcgacccacgtgatggattccacattgtggccaccgatttgagcatctattaccgtggcggctgggggccgaacgatggcgccaccacgaatggatcgaccggcctggtgatctgggactcccctgacctggtccattggagcgagccgcgcctggtggacgtggcctcgaagattccggacgctggcatggcttgggctccggaggcgaattgggatccggatcgcgggcagtggatcgtgttctggtccacgaagagcaacgccgaaagctccgcggatccgttggccaacgagctcggcgatccgacgaatgtgtattatgcgacgaccgttgatttcagggtgttctccgatccggtcaagtggatcgatcgtaagaatgtgatcatcgattcgaccatgctgcgcgacgatgacggctggtggtaccgcgcgtccaaggactcggaaatcaccatcgaacgcacccgtaacccgtatgcgacgacctacgaggtgctgcgcaccgacgacccgaatgagtggtcgtatgtgggcacgctcaccgacatcttcggcaatggccggtattccatgcactacttggaagggccggaactgttccgttacaacgacgaagacgtgaaggtgatcaacggcaggaccatgccattcggcctgatgtgcgaccagtacgcggagtccaagggctacctgtcgttccgcgccgcctcgctcgcctcgcatgatccggccgattggcagcgcgcagacgatatcgatttcggcgcgctgaagaagcgtcacggcgcgattctgccgatcacggccgccgaatacgacgccatcgaaaccgccttcgccctgtaggcggcgcgattgcccatccgtcgcaaccgctcaggcgcggcggatggcgaagatgcgggcggacggctgcttggaggtggccgcgttgagccggaccgtctcggggtccatgcgctcgacggtccacggcttggcgtcgggcgcatgctcgggaacggccggattcgggaagatctgctcgatatggcagtcctcggacagcggcacgttcacggaaggcgtgccgccgcgacgccagacaatgatgtaatcgcacgaatcgtcgtcctccgacgggaggaatgacggatggcgcagaccgacgacgagccaatcgccatcgaaatcaggcagacgggccggccagaacggcaccaattcctgctgctcggtcagcacacggcggtgcaaggccaccgcatcccgcaccaaggcaagccgatgctcgtccatgcggtcaatgaatccggacaggtacaacctgccgagtatgcccgtggccagcgtgaagacggcggtctcatcgtccatctcctgctgggcgtaaccccagttgccttgctgttccggcaggatcgtcagtccggcgccggcggcgatcgcggcgtaaatcagcggatcacactggtcggaggtggattgcaggtccaatcgttgcaactgcgcgtaatcggcgcgcatcgcaccggaaccgcagttttcgatcataacgtccggatggcggcggcgcaggtcgtccagccaatccaaataggcacggcagtggccgagcaggccagcgccggcggattcggcgtcgagatcagtgccgacgccggggacggtgttgtagtcgaatttgaagaagaccgcgccgaaatcgtcaatcagccggtcgacggtgcgagtgacgtgctcgcgtgcggcgggcgagcggaagtcaagcaggtaccggcccgaatcgcagacgcgcacaccgtggcgctggaagaacgcgtcatcgggcagactttgggcgagcggcgatttcacaccgatcacctcaggctcgagccacaatcccaagcccatgccatgcgcgcggatggtgtcggccaaacccttgagtccagcttcgccgaaacggttcgtggaggcctgccattctccgaccatgtcccaccaaccgccgtccgtgctgtcgtaccagccggcgtcgatgcagaagatgtccgcgccgacgcgtgccgcgccctcgacgagcggcagctccttctccaagcgcgggtcgccgaacagggtgttcatgtaatcgttgtagatgacgagtccctgcgtgcgttcgaactgctcggaacgacccaattcgcgagccttggcggcacgcaacgcacggcgctgcaatgtcatttcggcgacggactgctgccaatcgccggccgagatcgcgaaggagaccggcaccgattcgaaatcgtggccttcacccagctccgtataccaatggtggtcctgatattccggtccgaacgcgctgatgtgcaaaccgggatcatcctcgccgatctcccattcccatgggccgttgtgctcgatctgccacattacggagaagtcgcgcgattggcggcgcgagccctcgacctgtacgatgccggccggctcatgcacgccggtgctccatgtggaggcggagctcatggcgaatcgcgagctggattggccgggattgatgacttgattgcgattgcgcaccgatacgtcgcgcagtggacggctgcgccaatcgttttccaccgcccacgcggagtctccccagaatacgcgggaatggtcgattttgccgcagttgacgcgcatcggcaccgtcagattcaacgacgacaccgcctcgataggcagcgggcgcgcggagctcaaccgcgcgtaggtgcgcactgcggacagacccgggaacgcttcgaatacggaagtgactaccagcccagccgtggcgtcggcatggcggacggtttccggcgagggctgcgcggcggcttcggcccgttcggcggcggtcggttcgaacgcgcgcccgtgcggctccagttccgcatacgaagcgaattggacgatctccaaacgatatggttcggcggacccttcctccggctcggaggcggcggccgagacgaatcgcaatacgctgcccgccaccgtggcgatcaaggtgaggcgattgtcctgcgatccggtgttggcggcacgcacttcgacgatcggacgcggatcacgttccagcacggttcttccatcgtcggcaacacggccgccgatgggccccatgccgcggcctgcaacgttgcacaatcggacgggggaatcgcctgccgtgtcgaacagcatggaaaccacgccattgccccattcgagacgcccgtcctcacggggacatacggggttcattgcaccggcaccgcttatcatcttcgactcctcaaccgtgttcagataccgcctgatcattgacatgcatcgattgacgtacctggtactagcttaagcggtaaatggggcaaatcgcacgtgcgtgtctactcgaagcggagatatgcgatgaactcgactggcgcatccttggttttggcgatgttgccgaaaccaaggacagcccctttgtcgggcagtcccttcgtcactcgtcatgctcacccgcgtaggaacaccgtcatctcgttctcgccacggttggcccatgcgaagtatggaatcagcgtggccgtcgtcgtcttgcgttcggcgggacgccaatcatggtacaacgcggaggtttgcgcggagtcttccacttcacgccaagcgggaatcgccagcgtggtcatcggcatatcgacggcgtccacctcgccgagcccctgctcgtcctgcgcgacggcgccggcatggaagacgatgcgatcaacggacacgcaggatggatcggatgcgatgcgcgcggtatcggcgtgcagcagatgcaggttcgcgccattatcgacaccttccgcgcagtaggccagcggtccgcgcacgaacgccacctttccggcgtcctcgcgcacgagcggattcgcggcgaccatgtggaccggcatcgggaaatcgaaatcgacgacgtcgccgtcatgccatgcgccggtcagatacaggtatccgtctctgatgacgcgggagatgtcgtcgcggccgcgcacggtgaccgcatcggaagcggtttcgccaccggcccaagcgggcagacggagggcgatcgtgaaaaccgcgtccttggatgcatcggaagcagaatcgcctgcatcaaagcccaccgcgacggatcccttgccggaccagggcatatcggacatgacgtcaaggcgcacatcggtgccggaaagcctggcatggacgccgccgcccatatacagatgcacatacagggtggatgagtcgtctccgatcgtgtaggcgtactgctgcacgtcctccacgatgcgtgcgatgttcggcgggcagcaggcgcatccgaaccacttctggcgcaccggcttgacgtgcgccttgcgttcatcgcgatggcatgcctcgggcaccacttcgagcgggttcacgtagaagaagcttttgccatcgagtgccatgccggcgagcgtggtgttgtacagcgccgattccatgacgtccgcatattcggatttcggctggatttccagcatgcggcgggcgaagaacgcgagcgcgatggcggcgcagctttccgaataggcggtgtcgttcggcagatcatagtcgaaggagaaggcctcccccatgtgtgtggcgccgataccgccggtgatgtagatctttcggtcgacgatgttgcgccacagctgttcacaggatgccagcaggtcggggtcgccggtcaggcgtgccacatcggcggctccggcgtagaagtaggcagcgcggacggcgtggccgagggcttccgtttgttccgtgattggcttatcggcctggtagtaggcgtagttctgttcgcgcggctcgtagtcgcggccgccctcatgggcacggcggcgatcttcgagctcgaagtagagcggctgctggccgcgttggcgcacgaagtattcggcgaggtcggcgtagcgctgttcgccggtggtctcggcgagtttgacgagtgccatttcggcgatttcgtgcccgggatagccgtgcagcttgccgtcggcggtgccgaatcggaaatcgatgtaatcagcgaaacggcaggccgcgtcgagcagcttgcgtttgccggtggcttgatagtaggcaatcgcgccttcggtcaggtggccgaagcagtacagctcatggtggtccttcaggttggtgaagtgccggtccatgccgttgaggatgtagtaggtgtccaggtagccgttgtcgagctgcgccgcgcagacgatatcgatggcggtgtcggcggtcgcttcaaggtcagcgtccgggtggtgggtcagcgagtagccgaccgcttcgatccatttggagaaatcagtgtcttggaacacgaagccgtagaacttgtcgggatcggggtgcgccgggtcgtccggcagggcttcgaagccgcggaacgtgtatttcggcggcacgaaggccttgccttccttgtggtgttctgcgttctgcgcggcggcggccttgaagttgtgcatgcagtagctgggtgcggcgccgggaacgttgtcgttcagcgcgttccactggtagggaatcacctgggtgcgcacgagttcctgccgcgatgcccagaacgggtcggtgacggtggcgtcgcgcaatgcgattggatggctggtgcgattggtggtagtcatgagtgcaagcgctccttagtgcatcgttgtcttgttaacgctcacaatccattattccacgggttgctccaaagtacattccgcatggcggcatgtccgacgggaatcccaccgcggcagccggcccaagatggccgcgcattggctgcgcgaccgttggacaggcatttcggattgcggatatacgggctaaggggcagagcagctagccgccggggctggcggtcggctgctcagaccttgatcatggcgtactgcgattcgtagagccggtagtaggcgccatggcgggcgagcagctcggcatggttgccctgctccacgatctgcccgtggtcgatgtagcagatctcatccgcattctcgatcgtggacaggcggtgcgcgatgatgaagctcgtgcgtcccttgagcagatggttcagaccggcctgcagcgcctcctcggtacgcgtgtcgatattcgacgtggcctcgtcgaggatcaggatgcgcgggtcggcgagcagcacgcgcgcgaacgcgatgagctggcgttggcccgcggacagggtcgagccgcgctcctccaccacggtgtcgtagccgtctggcagttccatgatgaattcgtgcgcatgcaccgctttggccgcggccacgatctcctcgtcggtggcgtccagtttgccgtagcggatgttctcacgcacgttgccggagaagatgaacgtgtcctgcagcatgacgcccatctgccggcgcaggctttccaacgtgacggaacgcacgtcgtggccgtcgatcgtcaccgagccttcggcgacgtcgtagaaacgcgacagcaggttgatgatcgtggttttgccggcacccgtaggaccgaccagcgcaatcgtcttgcctggctcgacatgcaggtcgaccaggttcaggatgttgcggccgtccggctcatagcggaagacgacgtcgttgaagtcgacgcggccctcgatctgcggcagatcgacggcgtccggcgcgttgcggatctccggctgcacatccagcgtctcgaagatgcgctcgagatacgcggagcaggtgatcagctggttgtagaagtttccgatgctgattaccgggttccagaagttgttcgcgtagccgacgaacgcgatcagcacacccgtggtcacgtccacaccgccgaaaccggtgacgcccacataatagatgaacgcgatcgtcatgacggaaatcgtctggatgcccggccacataagcgtctggatatgcaccgtacgcatccacgcggaacgcacagcgccctgctgttcctggaatgtgcggaactgcgtgtcctcgcgcgcgaacgtctgggtggtcttcacgccggcgatcgattcgtggatgaacgcgttgagattgctctgcttattggatagcacctggtacgcgcgacgctggaaatgctgtaatcccagcacccacgcgatgagcagcgggaacaacgcgagactgtacagcgcgagacgccaatccacgacgaacatgaccactagcgtgatgaagaacgtgaacacgtcggaaatcacgttgaccagaccggagctcagggtgtccgaaagcgtgttcacatagttgaccacgcggatgaggattttgccatgcggacgcgagtcgaaatagctgaacggcaacgtctgaatgtgcgtaaacaggtcgcggcgcatgtctttaagcatgagctggccgacgcgcgtgatttccacagtacggtagcgcaaaccgaattcgtaaatgacgatgagcaccgccagcagtgccaccagctcgccaagcagcgcaaggtttttcgccggaatgacactgtcgatcatgattttcgtcagatacggttccacgacgttgatgcagcccattgccgccacgacgatgaggatccagaccacgcgggccatgtacggtttcaggtagacgccgacgcgcgcgaggtcgcgcatattgatcttctcttcaaggtcttcatcgtcacggaaggtgttgcgttgtgccatgatgttatcctcccccgcgtcttacgcttcgaatccctgcgagcggccggcatccacgcccaactgcttgctgtaaatctgccaatatcggccgtgcgaggccaccaattcgtcgtgcgtgccacgttccacaatgcgcccatgctccagcacgagaatcaagtcggaatccttgaccgacgaaatgcggtgggcgattgtgacaatcgtcttcttctcgtccaaatcgcgcaagtgccgctgaatctctgcttccgtttccatatcgacggcgctggtcgtatcgtccataatcagaatcgacggattgtcggcgagagcacgcgccaagctcagtcgctgcttctgtccgccggacaggccgacgccgcgttcgccgacgacggtatcgtagccgtccggcatgctgctgatgaagccatccgcgccggcaatggcggccatgcggcgcacgtactgttcgtcgtaaccacgtcgtctgcgctggccgtcgtactgaccgttgtactcaagtcggttgcctcggtcgcccgcgccaaagctgatgttgctgccgatcgtatcggaaaacaggaacgtatcctgcgcgacgatgcagacttgcgatcgcaacgtggcgagcggccagtcgcgcgcgtcgatgccgtcgatgagcacacgaccggcggttgggtcgtagaaacgggagataaggttgacgagagtcgatttgccggagccggtttcgccgaggattccgagtttcgcgcctgcgggaacgtggaagtcgatgtcgctgagcacaggcgtccccagatcgtcggggaaagcgaagtcgacgtgctggaagtcgatggttcctgcgattctagccgatttatcggcggcttgcgccccttgcgtaccttgcgtaccgactcgcgtagtgctttgcgtggctttccccgcaaactccggcttttcgcgaatacgcgattcggcggtgagcagcttacggatttttatgcatgccgcgttgaaacgttgccagtcgttggtaagccatccggattggcggattgggctgtcaagcatccacaggtatgagttgaacgccacaaggttgccaagagtcatgtaccctttgatgacgagaaagccgccgaaaccgagtgtgataagttgcagcgaaaagccgagaccgtcaagccagggcatgtatttgcggctgttgtatgcctgggccatgttgcgttgcatatagtcgtcgttgcgtccgtcaaatttttcggtttcgtacgattcgcgcacaaacgctttgacgacgcggttgccttcgatgttttcctcgaccatcgaattcatttcggcgagcgagtttcggatatcgaagaacaggggtcgtgcatgcttcgacagaccgcgtgtcaaaatgaacagtggtggcgtgacgcaagcgagcgcaagagcaagtcgccaatcaatcgaaaacatcatggcgagcgcgccgatgaacatgaccacgcagtcaagcgcttgcaggctcacccagctcagtgcgtggcggatggcgtcggtgtcggacgtcatgcggctcatgatgtcgccagtgcgagtgtggttgaagtaggtgaagtcaagttcgtggagtttttcgaattcgtcgctgacgagacgatagatggagttctgtccgaagcgttccatccacatttggcagccgtaacgggagccgacacgcaccacggtgagcacgagcatcatgacgcacagtcgggtcagttcgtccacatggccttgggtgatgacgcggtccacgatcagtccggacagcagcgggatggtgagggccatggtgttgttcacgcagaacagtacgaccgcgccggccacgcgcggcaggtcgggtttgcagtacggcaggatccatgcaaggttgcccgcctgctggttgcgtttcggatcgacatacatacgtagcgttccttcgaattgtttgcttgggtcttggttgggttgttgttgggttgtggtgttgcggccattcgttgccgccacgattcacgtccgtcgtgtgtcgagcgtcccgtcaccggcatgccgccgccggccgaaacccctgttcggattcgcaaactcgacttattttaaacgaaccgtacgccgatgcaacagatgcgttttcggcgtgtcgcaatcataataaaatcaacatatataccgttacataccactggtttgcgggtgctgcgaaaaccgtcatcggagcctggctcgccggaatcggagcatcgcatcggaacatcgcacgataatggaatcaagctcgaactatcgatacaagcatcggcgacgcacgtcgaggaaaggacggcaaggatgacggacttggagcgcatccgcgcgaagttcgctgcggaatatggcctgtcggaggacatgctcaggaacgcggaacgttggacggagaccacgggcgacctcgaaggggttcccgagaacctgctgccgggcattctgggaatgcgatttggcgcgatcgccatcgatacgccgcgttccgaacgctggagcacgccggaagacatcgatgtaatcgccgacctcgcctacctgccggatggcgggtacgatacggccgcgggagcgtgccgcggccatttgctcgacctgtatctgccgcatgacgcggtattgcgcggtgggcacaccctgccggtgtacatcgatatccatggcggcggattcacttacggatacaaggagctgaaccggaatttcaacgtgcatctcgcggaacagggcttcgcggtgttttcattgaactatcgtccggcgccgcagaccgacttgcgtgggcaattggccgatatccaggcggcattgcgttggatcgcagcccatatggccgattatccggtcaatccgaacgcggtgttcctcaccggcgattccgcaggtggcgcgttgacgctactgaccttggccattgaaaacaatgcggaagccgcggctgcgtttggcgtcgacaagccgtccggcatccgattcgcgggtgccgctccggtgtgcggcgcgtacagttcggcgtcgttggagaccatgggccgcaagctgacggtcgggtatgacccgaaccgccgtatcggtcttgagcagatgttgggcgtcgatttctttgcggggctcgaagccgccgatccgaagttcctcaccgctgagggtctggcgttcaacgtcgatctgccacccttgctcatcatcacctgcggcgacgatttccttgaagccgacaatctggcgttggccgccgccttgtcgcgcaaaggcgccgattttgaattgttcgacccgaagccgcgccgccatgagacgttggggcatgtgttcgtcatcggcatgccatggcttgaggaaagccgggaatgccttgatcgaatccgccgcttctcatacgaacgctgttgaataacgtgaatggggtgaatactcctccggagtgcccgccccattcaatggccgtcgatgccgcgacgccgtatcagcggcggaccatttcctcttcgatctgttcgagcgacttgcccttggtctcaggcacgaaacgcagcacgaacgggatggacagcgcggagaacacgccaaagatggtgaacgggccgccgacgttgttgccgaacatggccagcagcatgaggaagaactgggagaccacgaaattgcccagccagttggcagcggaaccgaaggagctgccgatgccgcgcacgctcaacgggaagatctcgccgatgagcacccatgcgatcggaccccatgacagcgcgaagccgaggatatagcaggcgatcagcaccatggtcggcacggccagcgtggccacatcgccggtgaagttaagcacggccagcaccgcgagggcgatggtcatcgtcaccgatccgaagatcagcagcttcttgcgggggaatttgtccatgataagcgtggccgcgatagtggccacgaagttgaccacgccaatgccgaccgacacccagatggcatggttttcggggaatccgaagcctttgatgaacacctgcggcaggaaatagatcacggagttgatgccgacgagctgctggaacagcatgatgccgatcgcggcgacgagcgcaggacgggcgatgcggaacagctcgcggacaccgcccttggtgttctgcgcggcgacggccttgatctcgtcgagctcgagctgcacctgcgtctgatcgacgtccttgcgaataagggtaagtactttgaacgcctcacgatccttgcctcgactcaccagatatcgcggcgattccggcagcagcaggccgccgatcagcagcagggccgccggcacgagcgccgaccccagcatccaccgccaatcgcggatgccggcgatattgtggccgaggaagccgagattggacgcgtatgccagcaggatgccgaaagtgatcatcagctggaatagcgtggacagcgatccacgacgttccttcggcgcaagctcggcaagatatgccggagtcagcgaggaggccgcgccgacggcgagaccgaggatgatgcgggccacgaccatcatcaggaatcccgtggatcccgcgcacatgcccgaaccgagcaggaacagtatcgccgccagaatcagcagcttcttgcggccgaaacgatcggacagcgcgccgatggacagggctcccgcgcaggaaccgatcaacacggatgatgtgatgaacccggtctgagccacggacaggccgaaatcggattcgatgagcggcgaggctccggagatgatgccggtgtcgaagccgaacagcatgcctcccagcgcgccgaacgtgaagatgaacgcgctgttgagcgggaaacgtgtggaaacgccacgccccacctcccgctcgacggcgtcgatcgtcgcgccgacctcatggatgccggcttccaccgcaccttcggcgtcgtgtactggattggacgtctgcaccgcagtcatgattccaccttccattcccatcgatcctcatcgatatgagatgcagcaatcgcagcaaacaaaaaagacctggaacgacgtatagtgacgtcgttccaggtcttgcctcgcattgagtagcaaccctgccgcgcttgtatgctgcgtatattgcattcaagtgtaggtcatggcgacatgcgacactccgattttttagaaaacgtttaccggttatttttcagtgcaggaaagcgtgaagcacaggccagcggcacatgcttttccctcgtgcggagagcctcctcggatatccacgagcaagcggaccgaatcaagccgtcaaaccatccacaagcaagccggcaaaaagaaagccggcggagagaaggccgccggctgagagagaagagagaagaagggttcagttatgggattcttgaaagaacctcgccaacagccgtaaccgttgacatgttctatataaccgcccgacccttggaggaacgatgtgtgttcctgtcaattccctgagaatttcgtagcggaaatgtcacgacggtgcgaattcgggggtttatcccactgaatatcgccccaacggccttcctgcagcttgttcagcgcggcaacagacgattgcacggcatctgccgacaccgtcatgaaacgccgctatacaacaccgccgctcaacgacgccgtgcactcacacgcaatcgcgcatctcactcggtgaatttgtcgacgcggcgatcgtaggtcagcaggccgttgagctcctcctccacgtcggaaacctgcgtatacacgtatcccgcaagtccgcgcgattccagtgcggccgcggaggcgagcacggaacgcacggcggcccgccaatcgtcgatcgaatcgtattcaccgtaaccgtaggcgcgcgacaccgccgcatgctccggtacgagctgcgccaatccgccgaattccgaaatcacgaacgcgcgtacgccgtgccgtgcgaccggcagcaccacgtaatgcgcggccctgcggcgacggcggtgcttcttctcgaattcggccacgtatccgcgcaacggacccttgtccgggtagatttccagcggccggaaatagttgtgcacgctatggaagtcgccgcaatgctggtcgtaccagccgctggtcgcgtcaatcggacgggtcgggtcgagcgcgtggatgcgttcggcagcatcgcacgcgtcgaattggccccagccttcgttgaacagcacccatgtcacgatggaggggtgcccgccgagcatgtgcaccatcgcgtcgcacgtacgcgaccaatcgcgccggtagatcgggtcgtccgcgccgagcgccgtgaaatgtttggcggtgtcgtcgcggaatttgttccatgtggagcggatgagcgtcggcttgcgattcgtggtccacgcattgtattcgccgtccgtgccgccgccggacaccgcgtcctgccagacgagcatgccgaggcggtcgcaatggtagtaccagcgggccgactcgattttgatgtgcttgcgcagcatgttgaagccggcgtttttcatggccgtgatgtcatgcgtcagcgcctcgtcgtcgggcgcggtcatgaggccgtccggccagtagccttggtcgagcacacctttgacgaagagcggcttgccgttgagatggaagcgcgccacccccttcgtatccggtttgatttcgacggaacggaacgcgcagtaggaacttacgacatccatcggctgcgattgcgcgaccgccgcatcacccgccgtttccgcgggtttcgccgacccgtatcgcaattcggcccgcacgtcatacaaatacggatcggccggcgaccacagatgttcggcagctgttgcgatttccgcacgcaccttgcgcacgcccgccggcagcgtctcatccgccaccaccgtgccgtccgcagggtcggtgacgacgatgtgcagtttcgcgttcggcttgtcgccgccgatttccgcacggacgaacaacttgccgtcggatgcccccttgagtgtcagcgtgcgcaggtaggcttccggcacgatttccagccagacgctttgccaaatgccgctttgcgcggtgtaccagatgccttcgcgctcgattttctgcttgccgcgcaactgcgtgcccgaatcgttcggatcgtagacgcacagcgcgatttcaaacgcgtcatcagggtcgataaatgccgaaatatcgacgtcgaacggcaggtagccgccgacgtgcgtgcccgcgagctggccgttgacatagcaggcgcagacataatcgaccgcttcgaaatgcaggatgaggcgattcgcgtcgccgatctgccggaccgtttcctctccgccgagcgtgacgggatgcacgacggtgcggtaccacagcaggttgtcggggtaaatggtctggtgcacgccggacagcgcggattccggcgagaacggcacgaggatcttgccgtcgaacgtttgcggaatggcggtttccttgactgcgcggaccgcttcgtcgcgggtcagcatcgccgccgttttgcgccatttcggcgcggtttcgtcttccggaatggacgcgatcgcgtaatcccaccagccattgagcatggtgcagttgtcgcgtaccatggtcgggcgcgggtgctcgccgagtatgggggtacgaccctcgtccagcgtgcgttcgccttcctcggcgggattgaacgccttgttgccggcgcgcgcggacagccattcgtgctcgattcgttcgccccacagcgtccacaactgctgcagcggctcacgggagcgcattttcgtaggcgcggccttcagtacgcgtttgatatccagcatggagagcccccttcctgcagctttgcacgtctctgcgttttattatactgagcggcttgcgttttttaacgattcgtaccgcggtttgcagtaccgtcttgcgacaccccgccaagaccagctgaaaaatcgcacgcatttctacccaaaacaatgcgaaagcaaccggaacatacctacgaaaaggatgcggtcggtcgtatatgcgttgtaaggccataggcttggccgaacggccttgagtgtgccgtcaacgcatacctcaaccggccgccgggcccgccaatcgcacaaaacgtcgcacatgtggaaacgtgatacgggaatgagacgctgaaacggcacaaaatgtcgcacgacttcgatttttcggcacttttttcaagtcgtgcgacacggcaatcaaaacaaataccccctaaccgccattttccggtcactttgacctaaaaacagcagttagggggcacttatcgcaccgcagctgtcgcacgacttgaagaaatcgtccaaaaatcaaagtcgtgcgacgcgtacgggggttatgcgacggaatcagccttccagcttggccttttcggcggcgagacgggcggcctcggcttcgcggcgggccttcagctcggcatcgaagcgggcgagctcctcttcgacggcctccggcggaatcttcgcgaagatcgggtgcggcttcggcaccgaggtgccggccacgatcggctcggaagcccacggatgcacggtttcgcccagcttgtagtcgcccgtgatgatcgggtaggtgaagcccggcttgtcgagatcctcaacctcttccagatgaggcagcggcgagaagacgccggttccgccgagggcctcccacaccttctgtgcggagtgcggcaggaacggggccagcaggtggttggcgtcggacacggcctgggcggcggtgtgcagcacggtgccgaggcgggccggattgtccttgatcttccacggttcggtggcggagatgtacttgttgatgtcgccgaccacgcgcatcgcttcggacagcgcgttcttctggcggtggttttcgatgagtccgccgacggtttcgaacgcggccttggtttcggccagcagcgcacggtcctcgtcggtggcggaagcctcgtcgaacgccggaatctcgccgaagttcttgttgatgaggttggccacgcggttcaccaggttgccccaggatgcggcgagctcctcattgttgtggcgcacgaactcggcccaagtgaagtcggaatcggagctttccggtccggccacggagatgtagtaacgcacggcatccacggggtaacgggcgaggatgtccttcacgtagatgacgatgccgcgggaggacgagaacttcttgccttccatggtcatgaactcggaggccacgacctgctccggcatgttcagcggaccgagcttgccggtttcgccgcccttggagccctggccgttgtaggccagcatttcggacggccagatctgggagtggaacgtgatattgtccttgcccatgaagtagtagcccggggtggtcggatcgttccaccacgcacgccatgcctccgggtcgcccttgcggcgggcccattcgatggatgcggacaagtagccgatcacagcgtcgaaccacacgtacagcttcttgttcgggttgtcgatccagcccttgaccggcaccggaatgccccagtcgatgtcacgcgtgatggcgcgcggcttgacttccttgaacaggccgatggagaagttgatgacgttggtgcgccagccttcgcgggtcttgagccacgcgagattggcttcggcgagcgccggcaggtcgaggaagaagtgttcggtttcctcgaagcgcggggtttcgccgttgatcttggatacggggttgagcagctcgtccgggtcgagttcgttgccgcaggcgtcgcactggtcgccacgggctccgtcggcgccgcagatcgggcaggtgccttcgatgtagcggtccggcagggtgcgtccggtggacggggagatggcgactttctgggtgcccttgtagatgtagccgttttcgaggcactgtttgaacagttcctgcacgaccttttcgtgattgccggtggtggtgcgggtgaacagatcgtagctcaggccgagatcgcataggtccttggcgatcacgcggttgtagcggttggcgagctcctgcgcgctcacgccttccttgtcggcttccaccaggattggggtgccgtgctcgtcggtgccggacaccatcagcacgtcattgcccttcatgcgctcgtagcgcgcgtacacgtcggacggcacgccgaagccggcgacgtggccgatatgacgggggccgttggcatacggccatgcaacattcaccaaaatatgactcatggtgcccgattatacaaagcgccatatcccgtgttttcggcgcattccgattggcggaaaacgggcggatggggtcgatgacgttctcgcagaccggcctgcatcaggctacggtagtccacaaggttatccacattgttgtatcacgcaacaatcatcgtccacttatccacttttttcgcgaagccggtggcacgccgctttccgtatcagctacggtaccccgcatggatacctcccctccccttttgggcgacgccgacctgcccggccccatttgtttgaatcgtttgcattccctaggcgtggtatgcaaacttgacaacgacaacgcctactcgtatcacgattcgcgcacgctgtacggccgcgccagcatcatctcaacgctgatgccgagccgttccgtggcgtgcgccggcaccgctgcgtgggtgtggttgggtggcatgtttcccaacacgatcgacatcattgcaaaagcgcattaccgaacggcgaggtacggtcgcaaagtcagcgttttcaaccgacaggcgcccgacgaacatgtcaccgacgtcggcccgatcaccgtcaccacgcccacacgcaccgcatgcgaccttgccatgaactgcacgccggaaacgcagtcgccggtcacggaaatcgtatgcatgctcatgcaggaattccggttccgccccgacgattgcctgcaggtcatgcaggaggccacccatattcgcaacgcgccacgggcacgccagtttttccggacgattgacggaaagcagtgacggatatgcgcgaatcgcaacggccgtcggaaaaaccacggcaaacgagacagacacggcaaacgtcggcacagtcgcggcgcacggcaagcaagagatatgaagagcgcacgaaacgtagcaaacgtcatgggcaacgacatgaacagcatggacaccatggcaaacgccacgaacgacgtcgcgcgccgccgaaatatcagccgcacgcgcggcagcgggcattggtcgaaccgcctgcgccgccgatcgaattgacgccgttggtggcgtgcagcgccgacaccgcgcaagatgtgctgtggcatatcgcggaatatgcgccgcgattgcgcaagtggctggtcgccaatccttcggcgacgcctgcgatgctggaatatcttgcgcaggtcggcgggccgggtgttcccgaagcgctgcggatattgctgaaatcgttggaaatgaacggttccggaagcgatcaacccttcatcgcaagcacggcattgtagacctgcttgcgattggcgagcgagccgtcagacagcggatgttcggcgacgacctgtgaaatcgcgtccttgatacgcaggttgtcttcctgcgcgcggtcgactgacagcaccgccagatcatcgatggacagcgttgcgggcgcggcagcgtcggcctcctcctcggaagcgccggcgatgacgagcaccatttcgccacgcagcggatcgtcgacgacgctttggcggatttcggcgatggttccgcggcggatctgctcgtaatccttggtcagctcgcgacacaacgccattttgcgattcggcccgaacacgtcaagcaggtcggccatggactcgtcgatgcgatgcagggtttcgtagaagacgatggtgcgacgttccgatttgagcgcgcgcaggtgctgcacacgttcgctgtgcttgcgcggcaggaagccttcgtagcagaagcggtcggtcggcaggccggacaggcacagcgcgtcgagcacggcggatgggccgggagcgcaggtgacgggcagaccgcgttcgatggccctgcggacgatcgccagtcccggatcgttgatggtgggcatgcccgcgtcggatacgacgagcacggtggcgccttgttcgacctggtcgagcaggccgtcggccttgtcgcgttcgttgtggtcgtggtaggcgacgacgcggccgggcacgcggatgccaaggcggttcgcgagcgcgtataggcggcgcgtatcctcggctgccacgatgtcggcgccttccatgagagcgatcaggcgggcggacgcgtctccggtgttgccgatcggcgtggccgcgagcacgaccgttccgcgcggaatgttgacgtcggcgaccagtccgtcgagcccgaattcggcacgttccgtggcttgcgcggtttcctcggcattttccgcattctcgccgatttcggcaatctgaccaatatttgttttcacggtttgtttcacggcgttaccagccttctcggcatcagtctgttcgctcaagttctccatatttccagtatcgcccacagcgtccccaaaccatcagcccccgccatttctccgcctttcgcaaccgaccaatcgaaacccgaccaaaccaccgacgacgccacacgtcctcaccggtaaatcaaaatgcacccctcacacatccgggtttccacccgccacgcattcggatttttcttcgtacgacattcggattttcctttgcgtaggattcggattttctcagacgggggtgagacggcgattcaacacgactttggacatgccatcgatagcatggaatcatgcgttattttgaagatgaaatttccggaatcgacggcagcacggccacgttcgtcggctactgccttgacaacagcagcgaaatcgacccgaatcgcaagcgcccgtccgtgctggtgattcccggcggcggctacgaaatgacgtccgaccgcgaagccgaaccaatcgccatgcaattccttgcagccggcttcaacgcgttcgtgctgcgctattccgtgaaaccgtccatcttcccggtcgcgttgctggaagcggctgaagcgatgcggcggattcgtacgcatgccgacgaatggcattgcgatgccgacgcgatcgcggtgatcggcttctccgccggcggtcaccttgccgccaatcttgcgacttccgccagcgacgacgtgctcgcggcacatggttacgatgcggatgcggtgcgcccgaacggcctgatgctcgcctacccggtggtcacgtccggcccgctcgcccaccgcggcagtttcgatgcgctgctcggcgaccgcaaggccgatccggaagcgctcgacgccgtttcgatcgaaaagcatatcgacgcgaagacgccgccggtgttcgtctggcataccgttccggacgattgcgtgccgtatgagaacacgctgatgctcgtcgacgcctgcaagaaggccggcgtgagcgtcgaggcgcacctgttccccagcggcggccacggcctgtcactcggcaccgccgaaaccgcatggcagggggtcaacggcatcgaaccgtgcgtgcaggtctggccggaacttgcgatcgcgtggatgcgtcgtacatttgcggataccgacgctgccacgaccggctctgccacagccgacgcgattgccgaataatcgccattcctgcgttttttctgcgtcttttcacgtcttttttgtcgcacgacttcgcttttcggaccaaaaaacaagtcgtgcgatatttaatcgagtaaaaataccccctaaccggcattttccggtcgaaaacggcacttagggggtatttggcgtcgcacgacttgaaaataaccgccaaaaatcaaagacgtgcgacgtttcgcgccacctaatcgccaaaatcagacggaacgcgactcgtgcaccatctgacgatcgccgtaatacaacgagttcaggccaggattcgccggcgtgccccacgcggacgccggacgcgccggacgcaccggacagccgctgagcacgctggacagctgccggacaaccattgaacaaccaccgggcaccaccggccgaacaccacctacaagcacacgcacataggctcccataggcacatattgacgatttgtgcagatttgccacccgtcgtcgcactgcgacgcacactgcatagacccgttggtagtctgtgattggttcgcaacggcacattcgttgcgcacgatggaaaagcaagccacacgaaccgaccccgcgcaaccgcgcaaaaacacacagagagacccatgaatatcatcaatttcttcgtcaacctcatcaaggacccccgtaccgcgatcgccagctggatcgcgatgggcgtcgccccgaccctcggcttcatcttcctcatcgtcttcatcgagaccggtgtggtcttcttcccgttcctgccgggcgattccctgctgttcgcggccggcttcttcgccgcgcccgacgcgaagaccggcgtgtccgcgctgccgctgttcgcgctactgccggtggtctggtgcgcgccgatcatcggcgaccagtgcaactactggatcggccatttcttcggccgtcgcatccttgaatccggcaaagtcaaggccatgaccccggagcgcatcgagaaaaccgagaagatgattgagaagtggggcccgctggccgtgttccttggccgtttcttcccgttcatccgcacgttcatgccgttcatttccggtatttccggcatgcgttggagccgtttcacgccgttctcggtgctcggcggcctgtgctggtcgacgctgttcacgctgctcggctatttcttcggtggcattccggccgtgcagaagcattttgaattggtgattattgcgattcttgtgctgtcgctgattccaacgatcgtcggcctgctcaaggccaagttcggcaagaagaagccggctgccgaggacactgcggaaaccgccgacgccgaataagcagcgttcaatcgtcgtaaaaatatcggcgaatacaacgcaagcacaacacgcggagtgtggaattgcatttttccacactccgtactaatatttcgagagttgtcttgctaaataaggtgacgcacatggggctgtagctcagttggtagagcgcttcgttcgcatcgaagaggtcgcggtttcgactaccgtcagctccacgaagcccgctgcattcattccaccgcagcgggctttttcttttgttttccgccgtttccggtatttcttgcgattcccatacgcactttccagcgctcttcgcaccgtgcatacgcccgtccgcacgcacgcaccgcgccgtccgcaccggccacgcaaacgcaacccagccgaatcgccatacatgccgacttctaaaaaccatttaacggggtcattttcgcgatttttacgattttaaccccgttaaaatcgcatttttcgcaaaacccgtacgatagtccacgtcaaacagtccacacaaacccaaaaatacgttaaactagcgttttaacggggtcatttttgcaattttcgcaattttgaccccgttaaaccatatctcagggattatcggtatctaaaaagtcacaaggagcaccacatgagcacctatcgcagagagcactatttggccaagctccgtcctttctacaacgattccggtctcatcaaagtaatcaccggcatccgcagatgcggcaaatccagcctgctcatcacagttctcaacgagctctttgagcagggaatccctgaaaccaatctcatctacctcaacctcgatcgccgcgaataccgtaatgtgaccactccggaccaactcgatcaactcatcgaacaagccatgtcgaatgcctacggtgcaggactgcgttatctgttcatcgatgaagtacagaacgtgaaaggcttcgaaaccgtcatcaacggctggcgggaggaaggtaattgctccattttcatcactggctcaaattcctatctgctgtccggagagcttgccacgaaacttaccggccgctatatcaagctggaaatgttcaccctttcctttcaggaatacctcggcatgcggaatttcctaaacaaaccggaaattccggtatcgcaagccttccgcgactatctcacatacggcgggttcccgaaatcgctggaatatgacgatcccgacgcaaaagccgcatatattcaagacgtcatcgggcagatcttcaacaaggacatcaccgcccacaaaaaagtacgcaatcgcgatactttcacccgtgtgcaggactatctcatcaataatttcgcagcgcccacgaatctttccggcattatcgcgtatctgaaacacagcgaaggcatcagcatcaaacgcgaaacgcttgccagctacgtccgtttgctggaaagcgccaaaatcctctacaagtgtcctcgcttcgatctgaaatcccgcaagtcgctcaggggcggggaaaaatactatcttgccgatcccggtatccggttcgcccgtaataccgatacgcgagtcagctacggtccgtcactggagaacgcgctatatacgcatctgcggtcgaaaggctatgacgtcagcgtcggcaccatcggcaaacttgaatgtgacttcattgtccgaaagcgcaaccagtacgcctatatccaagtgtctatgagcgttcaggatccgcaggtcgaggaacgcgaatatcgcccgttcagcaaattggcggacgggtatccgaaatacctgttcacattggatccgctaccattgcagcgcgacggcgtacgtcacctcaatctcatggaatttctgcaaaacgacggcgatatcgacttcgattaaacattaataatggcgattatgtcgtgtggcgcgccggttgtgcagacgcaccacacgcattgcggaggcgtcaggcgttgcggctacgtacgtaggcgtcgagcgtggcggcggtgatgccgtcgtagccgttgattgaggcgaattgcgggccgttggaattgtcgatgcgcatgaagccggtctggccgagcgtggtggcaccggatgcggccgcggagcgcaggccggacatggaatcctccaccgcgatgcaatacttcatgtcttcgggcgcgatgccaagcttgcggcccgccgcaagatacggtgcgggcgacggcttcttctcgacatcgtcatcgccgcacacgtaaccggcgaacgtgccggccggtgcctgcgcgatcaggttttccgccagatgacgcggcgatgtggtgacaagcatcgacggcacgcccgcctccttcagcgacagcagcacgtcttcgacgccattgatccacggaatgcgctcgaattccttctgcgccacgtaatcgatcatgcctttgccgatttcctctatcgacagcttgcagccgtgctccaccatgcggcgggccacgtccggaaccggcgttccggaaccctgccaagcgaggtcctcatcccagtatccgccgtggtcggctgcgattttcagctcgccttcatgccaatacggttcggaatcgatcagcgtgccgtccatgtcccagaacacggctttgagcatcagcttcgaaacttcctgggcgccgttctggataccgttgttcagctcggtcattacgtttcctcgcaatcgttacgcttcgttctccgatagctacattcttcgtcagctacgaccatttcagcagagcggcacgacggaagcgcttcagcgcgcagaaaaaaacaggacggttccatcaagccggtccgccaatcggttcataccaatcggctcgcaccaatcggttcacgcaaaccgactcatgcacaagccaattcgcgcaagccaacgcagcaaccaacccatagcaacggaggcacttggaaatcccccaagtgcctccgcaacgaacaacgcatccgacgaaatcggtcggccgcaatcgcagcaatccgtcatagaccccttttagacgaatcgcaagacttgcgtgcgactactcctgagcctcctgctcctgagcggccttctcggcattctccgccttccagcgggcgatgcaacgctcgacgcgcttgtagccgatgatcttcggatccaagccggcctcgcggaaaatcgcggcaggcgagccaccctcggcatacctgcgcatgcagtcgtcacggaattccttggaatagcaaattcgatactgagtgactgattccacagcatcgagagaccccaggtatttgcgggtctttgcggtgaacgcaactcttggcactgtacgctcctaacctttctgtatccaccgcatgccctcccccgattcttcgcggaaataagcagtcatatttcatcgaagctgtaggccagccggaagaaatgcgaacttcaacgcggatacgtaatattattcctcacaatagagacatcattgcgagacagatgcggcgttatgagtagttgcataccaaaaatcgggcatacccccgcgatatatgcccgattttgctgtttttttagatttttttagggttttccagcgcttttcaggaaagtcagcgaatgggctgtcagcgaattccccaaactaccactgacctggagcccatatcgtccccctcttccgcacgttccgcccgtacggattcgcgcgacggaagctgccgtgcatcggctcgcagctgcctgcgccacatgcgcgcgcgctgggaccgctcgacttccacgatgccaccgtccgcgtccgcggcgaacacgctggaaccggccggcttgcgcagccgctccacttggcggcgcagctcgcggttctcttcctcaagttcgaggatgcgcgtgattccagccaggttgatgccttcctcctggctgagttgctgcgcttgcgcgaggcgggagatgtcgcgcagcgaatagcgtcgcgcgccaccttccgtacgttgcggtacgaccaagccaaggcgatcatactggcgcagcgtctgcggatgcacgttggcgagctcgccggccgcaccgaccgagaagacgggcagctcgatgtcgaaaccgacttcggcggcaccgtccaggtcggcccggccggccacgatcgccatggcgcacatttcatacagccgcttgatctgccgtgcggcgcgcgcttgggaggcttgggaagtccgcgatgagcgtgccatggcggtcagcgctcccgaacgagctcgtcggcgaagtcaccgcacgccttgtcgaattccttcgcggcatgcttggcaacgaggttcggatgctctggaacgcggatctccacacggccgaccaaatcgccgttctcgtgcggattggccacgcccttgcctgcgatgcgcacttccgcgccgctggacgagccggcaggcactttgaaggcgatttcgtttccgtcgatatccgtggccgtcactttcgcgccgttcacggcttggctgacggtgatgggcagcggcatgatgatgtcacgtccgcgcagggtgaatttcgggtcttcggcgacggtgatatgcaggtacagatcgccgtttttgccgccattgcggcccggcttgcccttaccggtgagacggatcttctgcccgtcgcgcacgccggcggggatgtgcgtcttgaacttcttgccgtccgcggacagcgaaaccgtggctcccttgacggcctggcggaaggtcaggcggatcttggagttgcggtcctcgccgttttccggctgcggctgctcgtaatcgtcagcgccgtagcgttcgtagacggagcctgcgcccgggccgcccgcaccgccgccgaacatcgagaagatgtcgttgaggttcggattgccgccgccattggtctggaagcggatacgcgagccattgccgcccatgcctgcgccgccgccgaacatcgagccgaagatgtcggagaacgcgcccgcgtcgaagccgccctggccggaaccgccggcgaaacgcgcgccgcccatgccgaactggcgaatcgcatcgtatttctgacgattctccttgttgctcagcacgtcgtacgcttcggagatgtccttgaacttctcctccgcttccttcgtcttgttcaggtcgggatggtatttgcgcgccagcttgcggtacgctttggtgatttcggcgtcggtggcgtctttggagacaccgaggaccttatagaaatccttgctcagccattcattctcagccatgatgtgcctcctttcgtgaggttttcatgcagtaaaaagtacagtttttcaaactttcaaacagttgtcgttgaaccgttgtttcaggtaatcgaaggcccctcgtttttcagaggggcccgattactcgtcacatgcgtttcgcgcggatacgcggattgtgcgaatgcgcgatcagttctgcggagaagccacgaccacacgggccgcgcggatcacgcggtcgccgatgcggtagccggcttccaccacggtgtcgacggtttccttctcggcattcggatccggcttgtgcaggatcgcgtcatgcttcgtcgggtcgaaatcctcgcccttttcgccgaacttctcaacgccgaacttctcgaacgccttgtcgatcttgttggcgacggccttgaacgaatcgtccatttcgctgtgttcgcgaatgcggtcgatgtcgtcgagggccggcagcagggcggtcagcacgtcgatgatgccgtgctgacggaagcgttcctgctccttctgcgcgcggttgcggaagttgatgaactccgcgcgttcgcgctgcagtgcctccaagtattcggcggcttccttcttggcctggccaaggggggtcagcgtatcgtcggccttgccgtcggcagcgcctgccttgtcagcaccgtcagcggcagcggaatcgccattttcttgcgattgcgcggcagccggctgagctgcaccttcctgcgttgcgccagcggcggaatcggcggaagcgccgtcagcagcggaagcggcggccggggcggcctgcccggacaggtcatccatgtcgggcaggtcgttcaggtactcgtccttgttgaaatcggacatgattacttgttgtccttgtcgtcatcgtccacgacttcggcgtcaaccacgtcgtcgtcggagccgttggaagcggagccggcagcgcctgcgccagcagcgtcggccgcaccggcggcgtcggcggcaccctgctgtgcgtagagggcctggccgatcttctgggcggaggtcatcagctcggtctgggcggacttgatcttctcaatgtcctcacccttcagggcttccttgagctcgttgaccttgtcggtgacttccttggccacatcgtcggagagcttgtccttgttgtcattgacgagcttctcggtctgataggcgaaggactcggcctggttgcgggtctcggcgtcttccttacgcttcttgtcctcggcctcgtgggcttcggcttccttgaccatgcggtcgatctcgtccttcggcaggccggaaccaccggtgatggtcatggactgttccttgccggtgcccttgtccttggcggacacgtgcacgatgccgttggcgtcgatgtcgaaggtgacttcgatctgcgggacgccacgcggagccggagcgatgccggtcagttcgaaggtgcccagcggcttgttgtcgcgagcgaactcacgctcgccctggtagacctggatgagcacggacggctggttgtcttcagcggtggagaagacttcggaacgcttcgtcgggatggcggtgttgcgctcgatcagcttggtcatgatgccacccttggtttcgatgccgagggacagcggggtcacgtcgataagcaggacgtccttacggtcacccttgatgacgccggactgcacggctgcgccgacggccacgacttcatccgggttcacggactggttggcttccttaccgccggtgagctccttgacgagctccttgacggccggcatacgggtggagccaccgacgaggaccacgtggtcgatgtcggagacgctgatgccagcgtcgcgcagcacgttgttgaacggggtgcggcagcggcccagcaggtcggaggtcatttcctcgaagtgggcacgggtcagggtctcgtccaggtgcaccggggtgccgtcaggggtcatggccaggtactgcatggagatggaggtgctggtggagctggacagttccttcttggcctgctcggcggcttccttcagacgctgcagggcgatcttgtccttgctcaggtcaacgccgtacttgttcttgacttcgccgacgagccagtcgatgatcttctggtcccaatcgtcgccgcccaggtggttgtcgccgttggtggcctgcacctggatggtggagaagccgtcgtcgtccttgccgatttccagcagggacacatcgaaggtgccgccaccgagatcgaagaccaggatgcgctcgtcttccttgcccttttcaaggccgtaggccagtgcggctgcggtcggctcgttgatgatacgcaggacgttcaggcccgcgatggtgccggcgtccttggtggcctgacgctgggcgtcgttgaagtatgccgggcaggtgatcacggcgtcggtgaccggttcgccaaggtaggcttcggcgtcgcgcttcagcttcatcaggacctgggcggaaatctcctgcggggtccacttcttgccgtcgatctcaacggtccagtcggtgcccatgtggcgcttgacggagctgatggtgcggtcgacgttggtgacggcctgacgcttggcgacttcgccgaccagaatctcgccggacttgctgaatgccacgaccgacggtgtggtgcgagcgccttcggcgttcacgataacggtgggctggccaccttcaagagttgcgatgcaggaattggtagtacccagatcgatgccaactgcgcgtcccataacttgtctcctttgtagataggttcgctatacgttcttttcgttcttcgctcgagtttcggatcgccgtttccggattgccgtctctcatgctttccaaaacttgagcctacaccactcaactttgaatcgcaagttattattcccgaaatcgcaaaaattcttgagcacacctcactcaactttgcgcaaaacccaaaaccgccggcgctggggagcatctcagcggcagcggtttcggggattatcggaggttattcagccaatcagcggtcgttcttggcggccttcgcggtcttgatgagcatcgcgacggcaaccagcatggcgatcgcaacagccgcagccagcacagcggtgccggtcttgccgagcagtgcggcgccaaacgggccggccttcgtatcgttgttgaccttgccggaagcgatcacgccgttcttgtcagcgttgccagcgcccggcttgccgttgttcttatcggcggagttggcggccggagcctggaagtcgacggtcacggccttgccggactggcggccggtgacggtgagcttgtattcggaaccttcggtgacgccgtccagcgcgatcggagtggtctgtgcggtcttgacgcgcacgccggagagcggagtggaggaatcggacgcggccacggtcttgtcgttcttgtccttcagctcgtagctgagcacagcgtcgccgttgaagccatcgacgtccgcggtgaatttaccgtcggcagcagagaccttcacagtgccgttgtcagacagtgccttctgcgattcggtggaagtggccagtcccagagcgccagcgatggtgtagaagttgtcggtctggtcggtcaggccgatgacgcgctgtgcgccagggccggaagccgcgatacgcagctgggtgccggtgtgctccatgtcgccgccgttgtagccgccgtctgcatcgcgagaatcgtcctgggcggtgccgtaggagacgaccatgttgttgccatcagcggtcttcagcacggtggacagtgcgtaagccggctgggcgttgaggatctgggaggtgtgcgcgtggtcggcggtgacgatcaccagcgtgttcgtgaggtccacgttctgcatggcgtaggcaatggcctggtcgaagtcgtcggtctcgccaatctggccgcaggcattgcctgcgtggtcctgcttatcgatcgaggcgccctcgacctgcaggaagaagccgttcttctggccgttcgggttgtcattcagcaaatcgagcgccttcttggtcatgtccttgagcgaggagccctgattgccgagccagtcggcgttcggggtgcacacggtcgggttggcgtccttagctggatccttggcggtggccttggacgggttgaacttggtcggcatgttgccgtcactcatcagggcgagcactggctggccgtccttgtactgcagggcgttcatcgcggccggatcgttctcgacggtctggaagcccatttccttggcctgctcccacacagtcttgcccttgtattcaccgccctgcacggtctgacggaagtacttggaaccaccgccgatggttacgtcggcgcgggtgtcgagcagctgctcggagatggagccgatgccgccgttttccttaagctggttgatgaggcactgcttggaggcattgttggacgtgccgtcggtcttgccctgtgggccgtagcaggcacgttcggacgaatgcgattccagcacggccggggtagcatcctggatttcggcggtggtcacattgccggtggctttgccggccgccttggccagctcgaagaggttcagctgcggattgccgtaaatatcaacgtcaacggcgttgttgtaggtcttggtgccggtggcccatgcggaaccggatgcggaggaatcggttacgggggtaagcttgcccggattggggttggcgaccagcttgccgtcgccatccttgccgacagcgctgtccttgctgccgttgccgaccgagaaggtcgtgtactggccggtgcccgcctgcacgtcgtcaagcgcgctcggctggccgaccgcgtcaagtccgtcgaagtggccgttggcgcccttcagatagtcacgggcgacggtgatttccgaatcgcccatgccgtcgccgaggaacaggatgacgttcttcgcgttcttgttgccgatggtggcgatgcgctgcgcgccgccatgcttggcgagttccgcgaccggcttgccgttggggctgtaggtggtgtcagctgcgagcgccggtgcggcgagcgcgccgagcgttgcgacggaggcgagtgctgcgattgcgcccgtgagagccttgtgcttgctcatgtttcttctttcttccatgcagtttcttccgtgccgtccaacctgccgtttcggttgcgcccgttaggtaacgcccgtttcgaccatgttttccggctgcgcggaacctttccgcggctgcattgcttggatctttcgatgccaccgcccacgctatgcgccgcaagccaacgcacaccgcactacagaagaacgacagatgaacactcatcgccatatgatgaccgcaacatatccaccgcatgaacagggggaatacggccaataaaatcgccatattccgtcaaacaacacccccaccgcaccccacaagccaaaatcccccactggctggataaatccaacctctcagaccccactcacacgccaaaaatcccagtgactggataaaaaccacctctgacgcaccactcacgcgactaaatcatccagccactgggaaaaatgcccgcgccactcagccccgcgcaacccgcgccgcgcgcgtggcctttacggccacgaacacggaccgcaccagcagcacgcacagatagcaggcgaacataatcgccccaactcgtggcgaaacctcccccgcaatccacgtgccgagcggcgcggtcacagccgccgtcacgccaataatcagcgcggttttcacatgcgctagcctgcgcttcaagttcgccgcgctggtcgtgatcgaattcggaaacattgccaacagcgaagtgccgcgcgcaaccaggtcggacgcgccaaacagcatcgacagcgacggcaccgcaagcgcaccacccccaatgcccagcagccccgccagcgtgccgatgaccacacccagcaacgccaagccaatgccggtcaccaccgtcatgacgatctggtggtcgcgcgacggcacaaaactcacctgattgatcaccacaaacacgagaaacgccacgaaaatccaccgcagcaccaattccggcagccgcgacagcagccaactgccgatctgcccgccgacaaacataccgcaaaacagcaacgccgcggcgagccagtcgacgtgcccgccggtcgcgtacgaaacgacgccggaaatggaggtcggcacgatcgccagcgtggacgtggcggccgcgttgcgttgcgacaggccgagccagacgagcgcgggcacgatcaccgtgccgccgccgatgccgaacgtgcccgacagcacccccaccaacatgccgaccacaatcagcacgatgatgctgcgcgccgacccgtcaagcgccgtctcccccgctcgcgattccatcttttgcgattccgttcgtacggcatccgcccgatccgcagtttccccttcatcacacatggcagctccttccacgtcttccgcgcccgatactacccacctgccgcgcgcagcaatcagccgattccataattttgcgatttcgccgccgcagcgcccggttcacgcgctttctcgcttatagatggcggattcgcgggatcgacggatggtatctcgcttatagatggcggccccttgcggaaacaagacatctagggggcatgcatgctaccccctaacgacctattgcccaaaccgacccgccacctataagcgagataccaccggacacccggccgaatccgccatctataagccagatacccagccaaaaccacgaccgcacgcctacacccacgcctacaccggcacacccgcacgcccacacccacgcaagacccattgcacacacccccgtacgcacacgaccgcgcgcggaccggcaaaatcgcaagtcatgagcgaaaaggggcatcaaaagcgtccgaaacaggccgaatcacacccccatccgctcacagacaagcaaaaccagcccaactcacaagtcgtgagcaaaaggggaggccacccaacatcaaaacagcccgaaacatccagaatcgtacccccatccgctcacaaccgcgccaaaaccgtcaaaaccgcaagtcatgagcaaaaggggcatcaaaagcgtccgaaacaggccgaataataccccatccgctcacaacccatgcttcagcacgattcaggccatatgcgcaccgcaacaacacccctgcgcaacatcagacatgcacacgcacgcaaacacaagtacacacactgaaacgcaacacgtaccacaagcacacaaacaccacgcaccacataccgagcacgaccagacgcacacccccgcacaccggagaagcgatgtcaccggcctgcggcggcgctaggctagacactacccccgaacaccagacgaatggcgcgcgccggccccggcgcacaacccgtgccgcacaatccaggagcgtcgccatagccgcgcgagccccacaaaagcgcagccagccacaaacacgagcagtccgatcaccgcagccgccacggctgtcatttcgcccggctcgtcgtattgcgtcttgtctggcactttcggattcggaatccggtgcccgcgcacgagcagcctgtgtgagttgacaccgtacggcgtgcaggtaatcagcgtcgcgtaatcggccccggactcaatattcagcttgctgatttcgctcggcagcaccactgagatctggtccacttggtacgtgtaggtttcgtcgagcacgtggaatgcgaacgtgtcgccttttttcagttcgtcgaggccggtgagcagtcgcgcggatggcagtccggtgtgtccggagactaccgcgtgcgtggtcgctccgcctactggcagcgaggttccggccaggtgtccggcggcgatctgcagtacgccgtcgctggtgccgtggtagacgggcagtttcactttgatgcgcgggatggtcacgtatcccatgatgccggtgccggtcacgtcgagcgtttcatcatattcgcgcttctgcgcgtcggtcatgtgccaccggtcgccgttcgcggcgagccgttcattgtattcgtgcgccgctttcagcatggccttgcgttcggcgccggacatgtctttggtctgttccacgtagcctgccacggagtatgactggtgcatgcggttccaccagtcgctgaatgtcggatacgcgatgaggcccagcgcaccgatcatggcgattgcggagatggcaatcatcacattgagcagcgcattcgatttcttatgcttggcagccggtttaacctgcgcacccggtttaacctgcgcatccaattcgacttgcgcagctggcttggcgtccgattcatccgtcacgttatttatgctacgcccgcttccgcaaagccgtcttggcaacgatcagcagcaccaagcccgcgcccaagatggccacggcaatccaagcggcctgctgcacgtcggcgccggtgtgcggctggtccggcgtggtgggtggcgtgtgcgtgttggtgatttcagtggagtcgccttccacatcggagatggtggtgtagccgtcgggcaccgccgcttcgaccacggtccattcgtggtccgcgtcgagatccgtccacgaatgcgtccacttgttggactcgttcagcttcacgttttccacgggctcgccgtcgcgcaggagtttcacggtgatggattcggggcgcttgccgtcggaattgttccggtcattccagattttgcgcacagtgcgttccacggttttcggcggttgcgccacacattcggttttcggttcgatactcagcacacgcgacccgccggagacgccgtcttcgggcactgcgacgagcatactgccggaagagcacgtccatgtctggttctttccggaagcgttggtgaccttcacgtcaacactgtcggacacggccaggtacaagccgtcggacagtccggtgaaggtcaggtgtccggaagcgttggtgacgccggttgccgtggcgtcgggtttgttcaccgcgatgagtccggcgagcgtattggccatgtctcgccacacctgcgcgtccttgccggtcatcttcgaccagtcgacggggtaggcggtggagtcggtgaacggtgcgacgggttcgaaggtggcgccgccgcttgccgggatctgcccgactttgtagaggttgaagctggcgtccgaaatggcgaagttggtagaatcgtcgccagtttcggagtccgagctcttatggtggtacgaaatggcgatgctgccgctggcagagtctgttgttggagccgcgacggcatcgcgagtagtgaatgcacaggctgccgcggcgaatgtggcggcgattgcgcagcatgcggcgatgacgcggcttgcgatcgtgcgttccttcattgccgacccctcttctgtggattggaaagtaagcatgtttgattcgccccccccaacggcaaaccggaaaatatatggagccaggctggatactcaagaaaattaggcagtgtacaagggattgaggtggtccagcccagcatatgtgggttcagttattatttaattttcagtttttaaattatgtattgcgattcccgtaagccgctgctgacttgcgtcaacgcggctcacgggttttgcatggttacttcagattcttatggaatccggaggatcaggcattgcgacgacgcagagccatcaccagggtcgcgccagcaagcacgaacacggcgatgccagccacgtacagcatcacagtgcccataccaccggtggacggcaggttggagcccttctggttcacaacatcggcggtaaccgtaccggtagtggtgttgccgggagtggtgttgatcttgagcaccgtaagctgcgggttgtcagactcgacgtcatggtcagcggtgatttcgaagagcgtgtcggcggcggtgttgaagcctgccggagtcttggtttccacgagcttgtacttgccgtcatcaacgcgcttgaaggaagcggtgtacttgccgccctcggtcttggtgatggtcacctcgccacggtcaatggtgtaatcgttcgtggtgctatcgaacttgtagagcttgaacttcggcagatcgttctcagccggggtgccaccgttgaaggtcttgttgatgtccagctggtaggtgaacacaatgaccttgtcggtcggggtcttgccggtttcgccttcgccgccaacattcgggttgttggagaactcaagggaagcctcattcgggttgcccgtagagccgatcacagcgttctcgttcagcgtggacgtgtattcgacggtgaacttgccaccggcggcaacggtgattgcgttgtcttcagcatccttgacggccttcgcgtcagcgatggtgatgtcgaaggtgtccttatcttcgggattctcagtgacagtgtaggagccagcgccaagagtcttgtcgccgtacttgacgaccacggacttcttattgaaggtcaggccagcggactgctgatcgtggaagaccagcttgtaggtcttgtaggctgcgaagtctgcttcggtcgtcggcagggtagcggtcagctggaacggcacttcgtcgttcacatcgtaatcggcggaatcctgccagttggtcttatcaccagtggagtcgttgacgtccttgaccttcttttcgaaggtcggcttgtcggccttacggttcacggtcaccgggccgttgacctggacgatgaacagcgttgccgcgtcgttgccggtcacagcatccttatccttaagcaggtagtagccagcaggagcggacaaagccgtcttggcggaaacctcgccataggcagtaccagccaaatcaacgtacggggtgatggctgccagctttgccgtgttgtcagcataagtaccctgagcaatctcagcagcagcatcggcagcggacttgttcgccgtattgttcttgttgaagttctggccggccttgatattgctcagcgtgccttcgctcagatcgccggtgaagacctggtacacggagtaggtgtgcgtgtcggtcgtcggcacggtgatgtcgtagttgttttcagccgcagttgcggtggaggcgccggcgaaaccggcgacggccattgccgcggtggctgccacagcgacgaggcccttgagaaccttgttcattgttctccctttctttcttgtttgaaatcttgaatcttcagttatgtgtgttcagttattgcctagtgggcattgggtcgctacgctacggtccagcccccctgccctagacgagttcatcattgccgcctcctgaggctcaaggccagaccggccacggcaatcgccactgcgaggaatcccgcagcgtacatcttgtttactccctcgccgcctgtaccaggcagaacgacgccgggggtgttggtaatggaaccaccgtcaacggtgaatgcggcagacttctgatagtcggcggtagtctccggcttgaaaccggaagacgtgtaccacgtgcctttcacgttcgcgccttcggccggcccgatgcggaacacgtgcggagtcgtatcgatgttgtacccgtcaggagccttggactcgattaactggtattcaccccactcaagaccaacgatggagaacttaccggcgtcgccatcacgatccgtataccattccgtctgcgcggagcaggtcttctcactgctattcacgcaatccttgatggttgcgaccggatcagtactgccggtctcggtataaaccgcgttgccgttatcccacgagaagttcctagtcttgtacagcttccattcggaaccggccagcagcttgttggtgtcagtctcgtcggttttcttccagttcaccgtaccggtaagacgcgagttctcaatgttgcccgcgctaggaagattggaactcgtgacttgcccattctcaataacgatggtgtaagtcttcgtcttactgacatcgaaaccgttcggcgcgatgatttccttcagcgtgtaggtaccattcgtaagatcggacaccttgaactggccgcccttcggatcctcatcctgccgcgtgtcagctgccttggcagtcgtgttggtaatagcgcgcaccaccggctgatcgtagaacactgcattcttcaccgcggaacgacggaaacgattctccacgtatgcgctggtcaccgtgcagccggaggggactgtttctttttggaaatcattccacgcctccacaacctgaacatccttacccgtaaaggtaaacataccgtgattcgcggcggtgtacttatcgtcattgggcagatcgaaccctttagcattgccaagatagaactggtaatttgttataacagaactcttcggcagctggaaacgcacatagtcaccgcacgcgctggaactttgtacatcaccgctccagttattgctgtccgtgctcttcttatatttcagccagtattcgttccaagacacattcgacttcttgaagtacacagagaccattggctccgtcaccttgatcttcacagtggctgtgttctggttacactgttcggtggcggtgatggtcacatagtctgaagtcacgttcttagcagttacggtgactgcggtaccgcttgtgggatttacggacacctcatccgtattgttcgaagtccatttcaccgtgttgccttcaggtgccacggtagccgtcagcgtcatggtcttgccttgttccaggctgattttctggccttcggtatacttatcgatgctcacagcactttccacggtcacaccgtttaccgtaaccgggaacctcagagtcttgtcgcctgctgtgaacacgatgttcgtagtgccgttgctatacggctgcaactgcgtgccatcgctggcaatgcctgcaacggcagggctttcggacttccactgcaccttcgtggcgagctccttgccatccttatccacggcaacataagaaatgcttaccggagtggaattcgtgaagctccacgaactaacttcagtttcattgatcttgaccacgatgtttgcgatttcgctgtcggaatcatcatccgtaatagtccacgactggtcgggatcgcccttcttggtcaattcccaagtggaacccgcgagcaacgtgttctggtcttctgcgtcaaccttcgaccatgcgatggaagtaccggcactcacgttgacaatggcgccattgtgcagctgcttggcggtgtcatcggtgatttcagcgccagtagcgctgtacaccttgtcgatggttgaaacggtatccgtactgtcgtgcgtgacgatgcgatagatgttcgtgttcaacgcatactggctgctgccggtaccgctttccttcaggtagtatgtggccttctttgcgagactgcccaaagtgacgctaccgttatccgcatcatccgcatcattccagccgccatcggcaaccgtggtgatggggttcgtgccattcatggcattatccctcgtgccgtacaccgtccacgaagtacctttcagggctttgccctcggcatcgaccttatcccacttgattgcggcgcaggaggtggtcatctgcccataccaagacaggttatgacgttcctgatccatatccactgcagaggtggaatatttgccttcggcgttgacgaaattgccgctgtttgtggtaacgacatccttgttgtacatttcaaaatcgccagtagtccacacacgaccattagtggagacatgcgactggaaattgcccttggcaccaaaatcattgcccgttaccataacggaacccatccatgcggcagacggatcatcagttacattgacgccataccagtcttccttgtcgccatgcttctgatccttgtaccagccggtgttgatgcgccccgaccccttaccaccaagaatcgtaagggtattggtgttatagaagttccacatcagctggcttgcgcgcttgacgtactcctgcccatgcgtattgttgtagcggtttgtgcccgtcgaattcatcatgacgtagccgtcggagatatcaacgtcgttccacttgaactgccagccattacggaacttcacatcattgccattaccgttgatgttgatggcgaccgaagcattgtcggagatgttcttgaagttgaacaccacgccggcatcaccaatgctattcagctttgatgcgtctaaattgaacacctgcaactcgtctttgccatcgccggtcagcgtgatttccgtctgacgggagttgttctcaatatcgaaccggtaaacgttgtttgcgtaagtgttgtagctgtatgaataacgtttgcctgtgtaattatcctcattgcccttcgtaacagtgttgctggaggaaatcttcgcgagcttgccagacagcgtagtcacataattcttatattcggaatatgtgtaatccgaacccgtcgaggggttcttcactccggaaataacggtgttgctctgattccagttgactttgccgttgccgcccatgtcgtacacggaatactgttcaccgttcttccaagtgttgcggctttgcactgtggtctgattaccagcaatgttcgcgttaaagttatggtcattcgtctcgccggtagcgccattccccgctccggttccaagccagctggatccctgattagcgtcatccgtccagccctgagcaccaccgaaccaattcaactcggaattggtgctattgccgccaaccgaaagcacagtcgaaccgtccttcggacggaactgcgaaccaaaaccgacgatgccccaacgaaaaccacgcgaacgattgaatgagccatccttattccagatgttccaagcctgcttcattggatgaagcaaaagctttccgttcacagcggtcaagccttcggcctcaacagcgtaagaaccctcaggcgcattgttgttattggcagaagtaatgcccgacttcttgccacctacatacatgtcaccgccaacgaaagtagcgataccttcatcgttaccgccgccggaggtctgatcgcctaacggttctgtggtaggtgtgcagattgcgccgtcattgcgactttcgtcagctttggcattgtaggtggggaggagggaagttactgctacggtggccatcatggctaccgctatggcggcggcggtcagggagcgggtacgcgaaagcacgcgaccggttgccgatcgcgttcctgcatagtgtcgtggtgcgttgccgacaccattacgccattgcctcatcttgtcccctatccgcaaagtgttcacccttctgagtccctcaactcgagggttgatatcctttgcataatgccgttatcacttctgttttacgtatagcttctgcgctgttcccatctccggcaacacagccggaaacctctgttttccctttttctctgacctacggtttactatgataacctttgcagttatgaaaacaaaatgaaacagaaagaacccacaccccctcccccgatacgttttttcgtcccctctcacggggacaacgctttaaagcctgatattcaacggtttgtcaacgattgcaaaatcaaaaaacacatgctgatcattgaatgaaattcatcattcatcagcccccgattggcgtgtcatgaaacacatcactgcaaattgtttcattttttttcctgaaaacgtatgccacacaccgtgactacagtgggggtatcccttatcaatccaccccaggccatcacaatcagcccgtcggcattgacgggctgcggaagggtaatgagactcggctctcagcggccagtgccgtacacggaatcggtgccgcgtagtacgagctgggcgcgcacaatctcatgcgcgttctcaagcggcttgccttcgataagcttcatggccttttgtgcggccgcgcgacccatcgcatacggatcctggcgcatggtggtcaggttcacagtgtcggcgtacggcgaatcgtcgaagccgataatcgaatagtcactcggcgtgtggtggccgtaacgttccaaacgcaacaccagcggaatcgccatcatatccatctggcagcagatcgcgtccgggaactcgtccaacgcaagcagcgcggtcaacgccgagtcggcgaaggtcttgccacgcggcacagagacgacgcgccacttgaagtcatgggaggcccccatcgtcttgcaggcgcggatgaagccctgtcctcgcgcatcgatggaggaattaatggaatcgaccgcatcggagcacacgtacacgatattcttgtgccccagattgatcagatgctgggcggcggtgaacatgccgtcctcatcgtcgatggagatggtggcgtcgaagccgttttgcgtcggcgtattgatgccaataatcggtacgtggatgcgcttgagctgctggatttccttcggctccacgccgaacgatgtcacgaatactgcgtccacgttgcggcggaccggcagattcgtgaagaagtcgcggcggttttcggcggtgtcgacgtgctggaacagcgatacgtcatacccggcattatgcatgacggattcgattccagcgaacacttccgtattgaaccagctagtgatctcttcattcatcagcatcgccacacggtacgattgacccgatttcaacgatgtcgcggaacgtgagatgttgaaatcaagcttgtccgccgtttccagcaccttgcggcgcgtacgttcggacaccagttccggccgcgtgaacgcgcgcgataccgtggaaatcgacacacccgcggccttggccacctcgcgaatgcctgctctatccatctctcaacccctttgcggtttctgcatcataatcacaaacgttcccagccttggaaacactcgcttgagcggcgatgctctctcaatctgtttctatcatactgcgaacgttgtcaaaaatcacgccagtgttgcacaaatcgcacaaattatcaaaataaccgggtaaaccgcgtaaaaagcccatttcgtccactgatgcttatagcccagcttgccgttgtagtagtgcacgaacgccacgcccacgcccggcgcgatcatcatcacggcgccgaacaggccggctgtgaacatcatcgaattctcatactggcgcatcagagcgaaaatcagcacgaagccaagcgtcaccgaaccgatgctcatcatgtgctggcgtaggccgatacgcagcagcaggtcccacagcagaccaatcaccaccagtccgaccgacaacagcaccttcatggccttctgatagcgcgacgccacccagtcgagcgcggcaagcacaacaaacgcaacgaacaggccgaaaacgggattctgcgagcccaggtcgaaagccttatgcgatgtggcgaggtcgtacggcacctcgcacaccacggcgagaatgaacagctgcaggccgtacgcgacccggctgtgcgtttcacggaaaccctgcaccagcagccacgcgtagatcggaatggcgaaccaggacaccacttcgctcaggaccatcgccgtcagcgacgtcatattgttggtatcggagccgaagaacagcggcacgatggtggtgctgccggcggacaaggccaacgccaccgcgccgatgaccttaagttggaacaccgtcagtccgcgacgttttttcctgttgcggcgagcgccgccgaatccgatttggtcggtcgaatcggttcgagctccctgctcggcatagccttccatatgtcctcctattgcgatttttccgcgcgtcgcacgtggcacgtgcaccttacgcacgccttacgcacgtatgccttttacgacttgcgactttcccgcacgccacagcggcttcccgcacgtcccatgcgatttaagctcagcgcccaccgcgcgccttatgcgtccagcacgaatttcagcagcccgtcgtagtcggctccagtaaacgaacataccgcatgtgccgaaacgtccgggtcgtccgccggtgaaatttccgtgcggaagtatgccgcgtcgaggccggcggaattggcgccgatgatgtcgttgcgctcgtcgttgccgaccatgagcgcgtgcttggcggtgacgaattcacggtcgagcgccagcatgtacaggtcgcgtgcgggcttgcggattttctcttcactggagatgatcacgtcgtccagtatgctggcaaggccggtctcttccagttcggggcgtgtgtagcaggcttgcgcgttgctcagcagcgccacgaccatgccggcgtcctgcagttgttcgatcatgtcgagcgcgccggggtacagccggaacaggctggtgctgccttggcggaacgcccatgcggctttcagcgcggcctgcggtagcgcgagtttcttttccgcttcctcgctgcgattcatgagcagggaccggtagaccggcaggatgtcgaattcgtcccacccgttgcgaacgattgcacggtcggcttggtggaccatttcgcgggcttcgagcttttcgaactggtcgcgcatcacgtcgacggattcgtactgcgcgcccaattcggtcacgcaatcgtacagcgcctgccatgcggcctcgctctgctcatcggtacgaatgtcgatcagcgttccgtacaggtcgaaaaacaccacctcgtaccgcggattgcgcgctccgattcccactgtcgtatcctttctggttttcctgccccattgccgtatctgttacggcaaccgcagctttgcggtcgccgttttgtagcttccctactgagagtattactgcaaccgccagattgcaaacgtatgcggtggaacaatcaaataatcgccatcacctgcgctcacattgccttccaccggactgacggacgagccgagaccacaccagtatctccgtattccgccaatcggttccaaacccgttacggccacgtcaataacgccgacgtgtctgcctggattggcggccatcagataatcgccgacgcggaacacgagttcgtcgccttccgtatcgacgatattgcgattgccgtcgaaccactgtggatcagacttgcgcaatgcaatcaacttcgcgtaatactcaatcaaatcgcgcttctgccatgcacggttccaatcgagccagttaagctctttggcggaatcgtaagaatcagagctgccgaatttggtacgtgcgaactcctcgccggacagcatgaacgggatgccagcggaggtaagcgtgatacccacagccagcttgttggcgtccatcacgtcggtcagcgcggccgcaatctgcggaccgacaccggccagcccttccgccgagaaatcggcgtcatacatgacttttggcacatccacggtattttcgttaacgccttcggccacggtgctgcccaacgaaccagccgcaaagctcgcgcacaacttgtcccacagcgtgaggtcgtcgtgcgcggacacgtattgaatgacctggcctgccactccttccgaatgtttgccgcgacgccacgcgtccacggcctcacgcgcagccgctacgttctcgtgcatgccaccgttcacataacccgggcggtccgagaagaacacatggcccttgatggtgtctcgcgtggtgtcgcagaagtggccgatgcgactgtcaagcttcgacaggcctgacttgtcagccagcacggtgtcgctgggcagcggcgcggtggcgcccgcggaccacggttcgccgtacatgagaatgtcgcgtccacggccgggaatctcatccagagcagcacgcacggcattcatggtgtccacgtcgatcagacccatcaggtcgaaacggaagccgtccatgtggtattcgcgcgcccagaacgtcacggattccacgatgaaccggcggaacatcttgcgttcggtggccatatcgcagccgcagccggatccgttggccagcgcgccgttgggcttacggcgcaggaaatagtccggcaccgaccgctcaaaccaattatcgggcgagaacatgtggttgtagaccacgtccatgatcactttgatgccggcgttgtgcagcgcctgcaccatctgcttcacttcgcggatgcgcaccgacccgtcgaacggattggtggaatacgagccttccggcacgttgtaattgaccggatcgtacccccagttgtagcgatcgcaggtctcttcgtccacggaaccgaaatcgtaaatcggcatgagctgcaccgcggtgacgccaagtttcttgagatatgcgatgcccgtgggaaagtcgggatgcccgtccagagacgtaccgtcgtcggtgaacgccagatacttgccccgatgcgattcggggaaaccgccggcgggatcattgctgaaatcgcccacatgggtttcccagaccaccgtctgcgcaagcggcacgtccggcatatggtcgcggtaccaaccatccggattggtacggctgaagtccacgaccatgctgcgccggccgttcacaccggccccgcgcgcccacgggtcggcgatgcggtcgacggaaccgcaatcgcgttcgatcaaaaagtcgtaatacacgccgtgcatgttgtcggcgaaatcgtacgtccaggaaccatcggattccggacgcatcgtgtactgtccaatcagagcgtcgccgctttcccccatggagccacgcgagaacagtctcagggtcaccttttgtgcggaaggagcccagagagcgaactgggtgccggattgagcaaccacggcacccagaggccgttccaaacaaagcgggaacggttcggcgacgctcgtgttcggctgtgcaaagttgtctacgagcgtcattattgcgttacctttccgtcagcccttcacggagcccgacatggactcctgatagaagcgctgcatcacaatgaacaggatggcgatcggaacggagatcacgaccgcggccgcggcgaagcgggcaaaccagttctggatatattccttctgcagcatgagccacaggcccaatgccacggtgtagttggattgcgtacggcagatcaccttggccatgacaaagtcgagccacggggtcaggaagccgatgatggcctggtagacgatcatgggcttgcagatcgggatgatgatcttatggaacacctggaaacgggtgcaaccgtcgagcagggcggcttcgtccagcgaggtcggaatggtgtccatatagcccttcatcacgtagaagccagcgccggaaccggcggagtacacgagaatcaacgccacggtagtcatggtgccgcttgacaggcccaaggccttcaagatgaagtagatggcggtgacggccatgatacccgggaacatgccaagaatcagcacaacgttcatgaaagtcttgcgcacacggaaacgcatacggctcatgcagtatgccacggagagcacgaagatcagagaaatcgcacaggtgaagcaggcgatgatgaacgtggtgccgaacatcttcgggaagtccaacacgttgcggtcggtgaacagcaccctatagttgtccagagtccactccttcgggaagaaggagctggtgtacggggcggtgttcttattgaacgactccgcgaacacccatacgattgggacgagccagatgacggccagaatggccaggaacaagtgggcgaacacgtcgccggtgatacggcggatcttctggtcgtgcagaaggccgtggctttccactttggttgcggaatgcttgttgctcatcggaatgcctcctcattcttataggagccggaattgcggtaggtgatcagcgaaacgatggccaacacgacgaaggtcatgatgccgatcacggcaccgagattgtaatcctgcttgtccacggtcagcttgtacagccaggtgataagcaaatcagtggagcctgcggaatcgcccaatggcgtaggatcgccgccggacagcaggtaaatgacgttgaagttgttcacattgcccgtgaaggtggtgatcagatacggggtgagcacgaagataatgtacggcatggtgatcttagtaaagatctgccaccagttggcaccgtcgatcttcgccgcctcatactgatcggccggaatgttctgcagaataccagtgatctgcatgatggtgtacggaataccgacccacaggttgatgacgattacggtgacacgggcccaagtggcgtcggtgaagaacggcagcgggccgtcaatccaaccccacgtctgcagcatgcggttcaccgcaccctgcggctggagcatggtgtgcatgaccagcagggacacgaactgcggaacggcgatggacatggagaagcaggcacgccagaaacccttgaaatgggtggtcttgcggttgatgatcatggccacgaacatgccgaagaagaagttcaggaaggtggcgaagaaggcccagaccaaggtccacaccagcacgcgtccgaacagtgcggcgttaacggtgccgccgctgttggagaagaccttggcgaagttctcaaagccgacccagtggaacagcacgaggtgcttgtggtcatagctggtgaatgccatggaaatcatgaagatcaacggaagcacagtgaacacggcaatgcccagcgtgggcaggaacatcagcaggacgtgagccttggcatcgagcagctcgcggacatcgtccatgaagctcggagccttgccgttctcctcgagcagcacctgggacttgtatgcagagcgcacggacatgacccacaggccgatgaaggcagcggtgataaccagagtggcgacaccgtacaacaggatgaccacggaacggtcaggttcggtgtagacccagaagccgtcgaccagcttcttgccgcctgcattggtgcccaaggtcggcaacttggaaagatagtccacaccattgattgccatgaacacgaagtatgcgatttccagcgccagcatggcaatgcccttgacatactgcttgcgcacgatatcgccaagaccaaacaccactgcggaaagcttagtgaacaggtcaccacgccggaacgccgcccttaccgtgtaaggcgacggagaaacataatcagcaccctgcttccgaaggcgcttcatctcccgcggggaaagagttgttgctgtcatttcgactgccctctcatatggatattgaaagataaaaaaagctttgctcccggacaaggggaaggagaatttaaaaaccttgcccgggaatgcaaagctcggaggaggagtgagccactatgcaaagtggagagagacaccgcgactcgaagcgtctctcaaagctgcaggatggctggggggatttggcagtgccaaccacctgcattcttcagttattggatttttagaattactgatttcactcagcgatcttgccaccggcctgcttgacccaatcctggtacttggcggcagcgttgtccttggtgatttccttgttgaccagggccttgccgaaggtttcggccggagtccaccaatcgttcatgccagacagaccggactgcaggagggcggtgttggccatggtgtcggcctgggccttggctgcgacgtcgtcggtggtcagatcagacagggacttgtcggtcggcgggatggcgcgcatctcgtagtgcagcttctgagcttcggtggagccgaggtaagccgcgaactgagcggcggccttcgggttcttggcgttcgggttgtaagcagcggccttggtggcggcgaaggacttcatctgcttcttctggccgttcacggtgaaggtcggcagagaggtggcggcgtagttgtcacccagggcctccttcacgtccttagcggaccaggtaccggagaacagcacgtcggcggagccatccttgatggctgcgaggccggaagcgccatcgtcgttggagaagttcgggttggcgaccacatcaaccagataagaggtgatatcggcgccgtccttcgggaagaccatgcctgcgtcagcatcattgcccttctcgccgaacaggctcaggccatcatagaagccgttgatgtaccaagaattctgcagggagaacgcgaccttggccttggaaaggatggtatcgaagtccttggcctcatcctcggtgatcttggacttgttgtagtacatgaaccacgtgttgtcggtgtacggcacgccatagagcttgccatcggtgccggtgacggagttgacttcgaggtcgccgttctgttccttcacctgcttctcagcgtcggtgcccagctggccaatggccttggcgtccattagaacacccaactgatcggaagcgaacatatagacatcggccgccgcggacggatcagtgctgacctgcttggaagcatcgccttcggagaccacgtcattcttccacgtgatattgtattccggatgcgccttggcgaagttctcttcgaccttgcccagccagttggtgtccttggcctggtcttcctgcggggcccacacgctcagcgtgacggcctcggtggagccggaagcgttcttatcgccaccgtcggaggagccaccgcacgcagcgagcggaaccagcatagaaacggcagcagtaagtccgattgccttcttccaatcgatcttcattgatcttcctttcctcacataaccttgtgttcctcaacatctccggttaaatggtacggaccaaaaccctgcatacgttcacatcatcgttcttggatgattaccaacaacactggggccaccaaaaatgtatcagtgattgttagtgtagcacgtttctgccaacgtttgcaattcagcgttatgattgtttcaaagaaacaccgcaaaccgcgaaatatcaaggagacacaccctcatgcttccccccgcgaaacacccccaccccaaatggcttgccgacgcaattttttatgaaatctatccacagtccttcgtcgactccaatggcgacggcatcggagacatccccggaatcactttaaaactggactacatcaaggatctcggatgcaacgcgatctggctcaatccctgtttcgactcgccattcaaagacgccggctacgacgtgcgcgactacaaaaaggtggcatcacgctacggcaccaacgacgatctcattgcgttgttcgacgccgcccaccggcgcgacatgcacgtgatcctcgatctcgtgccaggccacaccagcgaggaacacgagtggttccaccgcagttgcaaggtcgagcgaaacaattattccgaccgctacatctggacagactcatggatctccggtggcgacggactgccattcatcggcggcgaatcgccccgcaacggtacctacatcttgaacttcttcaaatgccagccggcgctcaactacggtttcgcgcaccccgaacgtagctggcagaagccagcccttggtccggacgcgaaggccacttgcgacgcgatggtggacgtcatgcggttctggctttcccgtggcgcagacggcttccgcgtggatatggccgacagcctcgtcaaaaaggacgatgagggcaagccttacaccatccgcacctggcagtacatgttcgcccggatccgcccggccttccccgaagccgcgttcgtttcggaatggggacggccagaggagtcgatggccgccggcttcgacatggatttctatctcgattggcgttgggacggcgttcccaacggctacaacatgctgttgcgcaacgtggacgacccgttgagccgcaagggcgacaagagctatttcaacgccgattccggcacgccgatcagcgaattcctggacgagtacgagccgcgtctgcgcgaagcggaaacggccgacggaaattttaatttcatcacctgcaaccacgacaccgcacgcgtggcgccgcgactgtcgcagcgcgaaatcgccctggcatactgcacgctgttcgcgatgccgggcgtgccgttcctgtattacggcgacgaaatcggcatgcgataccgcgcactgcccggcaaagaaggcggctacgtgcgcaccggttcgcgcacaccgatgcagtggggtgcgaacgacgcatccggagcacttcacgtgtccgattctgcagaatcggacactcgggctggcgatgtgaccggtggcagctacctgcccgccgacccgtccgccgacgccccgaccgtcgccgcacagcaggccgacgccgaatcactgtggcatacggtgcgctccatactccacgtcaagggggaatgcgacgccttgcggtcgggggctacgttccatgcaatcgaacgcgatagagtgttcgttttcgagcgttccacccacctgcagaagctgatcatagccgtcaatccaagccgcgattgcaaagctttgcagttaccagatggtagttatcggacgattttcagcatcggcgaaaacgaaattagcggcacttcgctgcgtctaggtctgcaaagctttgcaattctcgaagccgagtagcagacgagcaatgccccgttggaataatcgtttgcaatgcggagcgctgcgccttcgtattgcaaacgatagtcaatatggaaaaacaattccggttatctatattcctgaaattagagcaaaatcgcaatatagcaacactctcttaccgcaaaacacgctttgaaaacgatatcataccgtgatatagttatctttggtgcgaatgccaccagcatcgaagctgcggcaatcgcaagcaatgtagcatgtcagccgtcacaaacggcgcggaaagaagggacctatgacacagacccagcagaccgaaagcgcagaacgcatcgcacggcctcttatccagctcgccaagctcaatggcatttccacgtcgtatatcgaccagctcggcacctatgtggaaatccgcgacgaagtgctcgtctccgtattggccgcactcggcgtggacgcatccagcgacgaagcgatcaccgcctcctatgcggcgacccagcagcgcatcgcagacacacttgttgagccgaccgtcgtgaagttcatcggcaaggaagccgtcacgccaatccgcgcgaaaggaaacgacgtggcgctgaagctgacgttggaagacggcacggaatatgcgggcgatctgaccgcgtatctgacgggctcgaacgcagatgacggctcgctgcaactgacgctgccggacgatattcccgccggctaccacacgctggccgtcgatgccggcccgctgcacgccgaagccgcgctgatctgcgcaccggcacgcatcgaactgccgccagcagtagcggaaaagcaacgttggggctggatggcacagatgtattccatccgttccgctgaatcctggggcgtgggcgactatggcgatctgaagctgctgctgtccgacgcggcaacgaaatcgcatgccgatttcatgcttatcaacccgattcacgccaccgcgccggtgccgccgctggagccgtcgccgtatcttcccgaatcgcgtcgttttctcaatgtgacgtacatccgtccgcaggatatcgctgaatatgcggaactcaacgaggcggaccaggccgaagtggcgcgtctgcacgcggaagcctcgccagccaacgacagtatcgagccgctcgacatcaattccgcttggtggcacaagcgccaggcgctgcagcttgtgtacaacgtgccgcgttccgtcgagcgtcaggccgcgttcaacgcgttcaaggaggccgcgggtccggatctgcgcgcgttcgccgcatggtcggtggcgttccaggtgtggggcgcgccgtgggaaggcacgtggttcaaggacacgaaccgcgattcgcctgaagtggtggagctcatgcgcgagcacgccgatatggtcgatttcgaatgctggctgcagtggatcgccgacgagcaggtgacagccgcgcagaacgccgcccgtgacagcggtatggcactcggcctcatgcaggatatggccgtgggcgtgcactcgctcggcgcggacgtgtggtggaatccggaacgtttcgcagtaggcagcgtaaccgtgggctgcccaccggacttctacaaccagcagggtcaggattggggccagccgccgttcaatccgaattatctggccaaaactggttatggcgtgtatcgcgagatggtgcacaacatgttctcgcacgcgggcgcggtgcgcatcgaccatgtactcggcctattccgtctgtggtggattccgcagggcgaaggcgcgcgcggtggcgcgtacgttacgtacgactatgaggcgatgatcgcgatcctgaccattgaagcgtcccgcgtgaacggtttggtggtcggcgaggatctgggcaccgtgcctgattacgtacgcacggtactcggcgagcacggcctgctgggctgcatggtggaatggttcgcccgcgtggacgactcccccaacgccggcgacccgtacgccgatccgtccacgtaccgcaagtacgcgctggcttccgtcaccacgcacgacctgccgccgaccgccggctacctgcagttcgagcacgtcaagctgcgcgaacagctgcacctgctgtccggcccggtcgaggagttccaggcttccgccaccgccgaacgcgacgcgatgatggaccgtctcgtggagtccggcctgatcacgccggaagtggcgggcgatgtggaaggccacatccaggaaatcgtcgaggcgatgcacaagatgctgctcaagtcgccgtccgtgctgctgcaggccgcgctggtggatggcgtgggcgagacgcgcacgcagaaccagccgggcacgtccagtgaatactccaactggcgtgtgccgctggcaggcccggacctcaaggtggtgcacaccgatgaggtgttcgatctgccgcgcgtgcaatcgcttgccgccatcatgaacggcgagaagtagcgtttaaacttaccattcccctttccttacaaaccaaaattccggtcctccttgtggagggccggaatttttcatatatgcaaggcgatttgggagcggttaggccgcctgagaacaatcgcaacctcagccagcagtgcaacggccagattcagcggtcgatcagcccagcagcagccatacggaggcgtcgctatccagcttgccgtcgtccgtcaacggcacggaatttgcgatggcgaccgcatcgtccggcagggcgatcggctcgtcgccgaaattggtgacggacaggaatcgacggccttccgtggccggacgcgagtaggcgaccaccgtatcgcccatgtccagcaggtcggcggacgtgtctccggttgccgtcagcaccgtctgtcgcaactgcaacagcttgcggtacaagtgcagcatggaaccgttgtcatcggcctcgacgtcggccgcgaaatccttgaaccaggccggctgcggcaggtgcgcgtcggcggaatcgccctgctccgggccgaaaccgaacgtgccgccggtgatgaagtccgggctccacgaagccggttcgccgcaatcggcagccttccacggcatcggcacacggcacccgtcacgacccttgtcggtgaagttgcgacgggtgttgaacggcgtcggatcctcaagacgatcccacggaatgttcgccacttcgaacaggcccagttcctcgccctgatacacgtaggcggaacccggcaggcccagttccatcagcgcggctgcgcgggcgcgacgggtgccgagctcacgattctcgcggtaggtctctccgtcacgcaacagccaatcgtgcgccagctggtggtacggagcatccttcacctgcggcagaccgaaacgcgacggactgcgcggcacatcgtggttgttcataacccacgtcgtggtggaaccgtgcgtttcctcggcggcgcgcaagccgtcagcaatggccgtacggaactcgtcggcgaaccagttggcttcggcgaactcgaaattgaacacctggccgagctcgtcggtggacgcgtacagatgctgcgattcggccttcacccacgcctcgccgacggcgaaacgcggcggattgtactcgttgaacacctgacgccattcgcggtagatgtcgtgcacttccggacgatcccacagcgggctgaacgcgccgtccgccggcagcacatgctgcaccgcggccggatccatgtcggccagcggcacggaatcgaggtccttggccaagccgtgcgccacgtcgatgcggaagccgtcggtgccgtggtcggaccagaatctcaacgttttcttgaattcctcgtgcacgtccggattcttccaattcagatccggctgctccttggcgaacatgtgcaggtaccactgtccgtcatcgacctgctgccacgccgggccgccgaacagcgactgccagtcgttcggcggcagctcgccgtgctcgccgcggccttcgcggaagatgtagcggtcgcgtgcggccgaacctcggccggcggcgagcgcctcgatgaacatcttgtgcttgttggacgtgtggttcggcacgatgtcgacgatcaccttgatgccggcttcatgcgcggcggcggccatcgcgtcgaaatcggccatggtgccgaggcgcgggtccacgttgcggtagtcgatcacgtcgtagccgccgtcggccaggtcggacgggtagaacgggctcagccagatcgcgtcgatgccgagattcttcaggtaatccattttctcggtgacgccggcgatgtctcccaacccgtcgccgttcacgtctttgaagctgcgcgggtagatctggtagacgacggcttgcttccaccaatcgtcacgcatgttattcgcggtcattatgcccctttcgtctgtgcctgcaaccgttgtaccgctgacaacgatagcattgcagggcgtccgctgcgggggcgcgcgggcaatcgcgtttccgtttgcgcagaccggccggcggtgcgatcgttcgtgccggcgttcgcgctgcgcaaaccagcagatcgtgtcgccgaccgcacgaccgaccgcgccacacaaaccggtcagccgcatcgccgttcgtacagccgaacgcgccgcacaaaccgaccgaccacacgatcgaccgcacggcgcaaaccggccaatcgcaagatggcgtgcgtcgagtagaatcgcaagaagatccgacttgcatacgttgccatacggatgccatacgaaaggcgattatgaagttcctctcccccgattccggctttatgcgcggcctgagcgacgccgtcgacgcgatctggatcaacattctgatgctcatcaccagtattccgatcattacgatcggcgcggcgctgaccgccggccacgacgccacccgccgcacgctgtccggcgaaggcacggcgacgcgcaactatttcgccgccttccgctcgaatttcgcgaaatcaaccggctactggctgattttcggcacgaccggcgcgctgtgcgtctactcgtggatcgtgctgcagatcacgccgctgctgattccgaaattcgcgctgacgatcgtatggctgatcggttttgaatgggtttgggcattgcaggcacgtttcgaaaactcgttttggcgcacgctcggcaacgcttttgtgttcggcgtgagcaacatcgggcatacgttggcattgattgcgattgacgcggtgtacgtcgcgctgctcgtggccagctggttctacatgccgcagggcctgttcctgctgctcgtgctcggctacggcaccatgctgatgattcattcgccgatcctcgagcacgtcttccgcaagtacatcagcaagtaattaggcacgaaaaagggactgattcgcatcagtcccttaaatttttctgggtgaaaatcagcccttcaccgcgccgccttcggccctgcaattaaggaccgcgctacgcgcgggctcaacgttaccctcgcggcatagccgctcgggctggagcctgggaacagcgcactgcgctgttccctaagggctgatcgaagatcagcccttaacggctccagccataacacccttgacgatgtacttctggcagatgaggtagaagatgatgatcgggatgatggccataaccaggcatgccatcatggcgcccatatccacggaaccataaccgcccttcagatactgcaccgccacggaaatggtcttgtacttgctcaaatcgagcgtcaggtacggcagcaggtagtcgttccaaatccacatggcctgcagaatagccacggacacaatggacggcttcatgatcggcacaacgatctggaagaagatacgcggcacggaagcaccatcgatcatggcggattcttccagcgattccggaatgcccttaaccacaccggtgaagatgaacacggccagaccagcgccgaagcccagatacacgaagcacagaccccacggggtgttgagcttgagcatatcggccagcttggagagggtgaacatgaccatctggaacggtacaatcatgttgaacaggaacaacgtgtacagcagctttgcagcccagttgttcacgcggacgatccaccatgcgcacatcgaagtgcacaccagaatcagcgccacggaaccgacagtgatgagcagggtccagccgaaactggcaaagaagttcgtggtatcgaggccacgcgtatagttttcaagtccaacgaacgccttaccggtcggcagggagaacgcgttacgagaaatatacgccttctgcttgaaagagttgatgatcaccagcacgatcgggaagatccacgccagcgaaaccaccgcgaacagtacggaccacagtgcgccgtgcttgactttttctccggagttcatgcctccacctccttgctcgtggtgagcttgttctggatgagcgccacgatggccaccagaatgaagaacagcactgccttcgcttggccgacgccttcccagcccatacggccgtagaacgtgcgggtaatgttcattgccagaccttcagacatgttcgacggagcgccgttggtcaatgcaaggttctgatcgtacagcttgaagccgttggtgacgcacaggaacgagcatacggtgatagacggcatcatcagcggaatgatgatcttgaacatggtctgggtgccgtttgcgccgtccacggaagccgcttcgagcacgtcggtcggcagcgactgcataccagcgatgtagataatcatcatatagccgatctgctgccagcaaaccaagatgaccaagccccagaagccgtaggttgcgctatacgtcaacgcgcggccccagtgagcgagaatgccgttgagcagcagcatccagatgtagcccaggataatgccaccgatgaggttcggcatgaagaacaccgaacggaagatgttggatcccttgatggccttggtaagcatatatgcgatggcaaacgcaaccacattgatcacaaccgtagtgacaatggtcagcgccgtcgagaaacctaacgcatgcaggaattccttatccgcaagtgccttctgatagtttttaagtccaatgaatttcgagtcagtcacagttgtgaacttgcagaaactcaaatacacacccatgatgaacgggattacaaacccgatgataaatgcagcgaacgtcggtagcgcaaacagagcccaccactttcgtatcgctttgccggccatgctgatcatagcttgcctgctttctttcctctccattccaacaccgcagcaacgcggcatggaaaaccaactgccccaaatcggcgaatcactgcattgtttttcgcctttttagtttttacagttgttataataaacagcgcgacgcgaaatgtcaaacgttgtcatttttacatgtcataaatcatatattctgcatcgttgtcatagtattgacagcctgaaagcattgtaaatatcagccccgcaacaactgtggcacaaatgaaaacgtttgtaatccaacttttgcaagagtgtttcaatacagtatgctgaatattcagtagttctactatacaaggggtcaccatgaaaagcagcattcaagacgtggcacaacttgcgcacgtctccatttcaacggtttctcgctccttcacacgtcccgatcttgtgtcgaaagccacgcgtgacaaagtcatgaaagccgccgacgaattaaatttttccatctcgcgctccgctgcagcactcaaaaccggccgcgcgctacgaatcgcggtgctgatttccggccgactcaatctgtggttcagttcgtccatcatggaaggactgaacgaatccttccatgatgaaggctacgacatctcgatctatcagatgtccagcgccgaggaacgccgcgcgttcttcgacatgctgccggtacgccgcaatgtcgacgccgtaatcgtcatttccttcgacatcgacagcaacgaaatcaggcaactcaggtcagtcgatgtgccaatcatcggcatcaattcgagcttgccggaagagcgcggcttcaacgccgccgtgcgcatcgatgacaagcagggatccgaattggccgcacgccacttgataacgcttggccatcgcgatatcgcttacatccgtaccgaccgtgaagtgacgctgcacttcagcgtgcagggccgtttcgattcgttcatgacgtgctgcaagtccaatggcgtcgaaccgcgcgtgttcgttaccgacgaaggcaagaacaacatcagcaaagtcgtcacgcagctgctcagctcggaccacatgcccacggcgattgcctgtcaggaagacggcatcgcaattccgctactgttccagctggaacgcaacggtttcacaataccgaacgacatctccatcattggctacgacgacagcacctacgctcgcgatctcggtttgaccaccatccgtcagacaccggtcgagatggcacacgaggcggcccgtatgacgcttgccctgattgacaagcagccgcttgacgagccgttcaagacgtttcccgcacagctaatcgtccgatcgaccaccgccagactgcgtcactgacgtttgccgcacattgcgcacacggcaaacgtacgaaacacagaaaggccgtcatcgcagaacattgcgatgacggccttccgttgtctccacaaccggctggggcgaagagaggaaaggaaaaatcctcgaccgcagctagcttattcagttattgaattgcgatttgcaactcatggtgcaacacaatctcagtgagatgcgtcgtactcagtcttccaaccgtcaacaaacgcggtcttgacggcatcccagtcaccggtaccctgagcgtattcgaggagggcggaaccaagcttgttcttccactcttcggacggcatcatggtgaagttccaagagactgcggtcttgccggagttctgatcatcaacagcagcctggaccagcggattgtcggacttgacgtcgctgaaggacttgaacggggtagtgaagcccatgtcgctggacagagacttgatgccggtcttgctggtgacgacccacttcaggaagtccttggtggccttcttatccgcgtcggaagccttggagttgatgcaccagtagttctcggaaccggtggccagaccctggttcttctcgcccttgacgccggtgtagatcgggatcatgccgacggactcggccttcatgccagccttctgcagatcggtccatgcccaagtgccgttctgatagaacacagcctcgccgagggagaactcggaggtagaatcatcaccggtcttggagctcagctgggtcggctcggtggtggagtccttcagatacaaatcgaagatgttcttatattccggcaggtaggtgcccttgatggtctccggctgcttggtgacgttgtcatccttgaactcatagtaaagcggcaggttagccaaatgggtcttgaaacgccagtcggagctggagtcgaagccggcggaggtgaacgcgcccttgacaccaagctggtccttcttagcctggatgtcatcggccacggccttcaaggtatcgaagttgtcgatgtcatcgacgctcttgatcttggcgccgtcagtggcaatgtacttggccagcagatccttgttgtagatcaggccataagtctccatggcatacggaacaccgacgaccttatccccatccttgagggcgacatccttgttgataagctgcttgtacggctcagtatcggacatgtcttcggtgtaggacgaccagttctggtagccgacagggccgttgacctggaacaaggtcggagcctcggacttggcgatctcggacttcaaagtctgttcgtatgtaccggaagcagcggtctggaccttgacctcgacaccggtttccttggtgtaatccttggccagcttcttccattcgtcgctggattccggcttgaagttaaggaagtacaccttgcccttgccgttatcggaacttgagctagaaccaccgcaagcagccaacgtgccaacagacattgccgcgatagcgaccattccaactgctgccttaatagtacgattcatcatcgaacctttctcttccattcctgttcccagcttctcgttgggaaacaatttgcggtatcgcgtcatcacgattcctaacaaccactattatgccgcattcccccgatttttgcaaacgtaggcaaaatgaattcaaaagtcagacgtcataccatcgaaagaaatcccgaaaatcatttattttcaatacttttagagagcatacttttatgcaagcgtttgcgacacgccgcagcaaagtggcaagtcatgcatgcaataaagaggcggttccaaggagggaccgccataatattcagcgatatcaaacagttccgttcaataattcagcaattccaatgttcgatgacattgtcacctttatattggcttaatacacaataatgcgcagtgtccaatcgcagcaaccgcgcgaaatgcggatcaacaccgagccattgcgacgtcaagatacgaagaacgtgcgcatgcgccaccagcagcacatcgtttccagcgtcgagcaacggtttgaccgtggcgatcgcctcacgtgtgcgcgccgcagcttcctccaccgtctcacccggaccgttgtgcacgggcacctgctcgccgttcggcaaagtttcaatccaatcgccttccaacgattcgggaagtgcctgcggaccgtcgcgccacacatcccaagcgaaaccgcccaccgcactcacttcctggcgcgtacgcccttcggcacggccgtaatcccattccgcgatttcagggagcacatcgaaatcgccatatccggccagctgcgccgtctgctgggctctgcgcaacggactggcgaacatgcacccctgcgcgaaaccctggggaaacgcctcacgcaaccgttcgccggcggcacgagcctgatcgcagccaatgtcagtcaacggaatattggtgcggccggtgtgctgtccggattcgctccacacggtctgcccgtgacgcagcagcaccaagcggccaggggtgattgcggaagcggcattgcctcccagttgagtttcagtcatgtctctactctagccgacgcaagctgcgttttcatcccattccgccacgtgtcccgcacatattccggcatgttttccgacgcgttacactggtttcatgagtgaaatgccgaatatggaatccagtgcggaccgcgtggtggcggccctgcacaccgtcgacgagaaggtgaatgcgatgcgcgaccagagactgaacgatcccgattcatttggcgataagattttcaagtccgtcgtgcccacgttggccggactggtgctcggcaaggcgttcgagatggtgtggaagaaaagcgtcggccgcaaggccgtccgtgccgacggtaccaagaacgaggctgcggaagcggcgctcggcatcgtattcgccgtggtttccgccggtttcggcgcgctcgtatcgcaactgtccggccgcgggtcgaaggcgattgtggacaggcggcacgcacggcaggcgcatcgcaagtaaatacgtcgcaaatatcgcaaagcagtctcaagtagatatgttctcacagggagacggatttagcccgattcccttgcaaaatcgcgccgcgcggacaacaatggcggtatgagcaacattcttcataacgcaaccgtcgacactctgctggagcgtcgttccatccgcaaattcaagccgaagccgctgccggacgacgtcgtcgaaacgttggagaccgtggcgcagcatgcggcgagcagccagttcctgaacgactggtccgccatccgcgtcaccgagccagccaccaagaagcgtcttgccgaaatcggcgggcagccgtatatcgcgaccgcgccgctgctgtacgtgttcgtgctggacgagcatcgcaatgccgcgatcgccgcgcgcaagggcgtggaagtggcgtccgacgcgttcacgctcaatggcagctatcgtttcacgcaggcgcagaacgacgcggttctggcactgcatgcgatggagacggccgcgtactcgctcggcttgggttgcgtgattctcggctcgctgctcaacgatgttcccgcgctgatcgacctgctgaatctgcccgaatacacgtacccggtgctgggcattgcgatcggcaagcccgatcaggagccggccgtcaagccgcgtatgccgcgttccatgcagttcttcgagaacgagtatccaagtagcgatgagaagctgctgtccggcttggattcgttcgacgccgaagtgcacaagtattacgatttgcgcgatactgaacggccggtggacgcgttcagcgaccagattgcggcaaatgcgatcgacgagggcgtgaacgccaaggccgttgccgtgcaggcgaagcgacagggcttccgtttggagcggtagatacatggcagcgctcgtatcattgatacgaagctgatacaacacaaggcccggtggattgcaatgaatccgccgggccttggttttatatgttgccttgttctcggtattgtcctgttatgccctgctattgctctgctattaccttctgcggggcttgtagcccttcttgcgggaatgtggcttgagctgctggttaagcggaacatgcatgtagctggattgtggatcgcgatgcgtgagatgccaagtaccgcagaaatcgcaacggtatacccaaagctcagtgccgcgttcgcgccaactctggtcggcggcctgctgagccgttgccttgtcgtgatacatgatcttgttcgactcggtgcaacgtttgggtacgaagtaatgcatagttgcccagtctataaacccattgcgataaaacgcttgcgccctacttgtgttcagggataaaaaatggggttcccggagcaggatgctcgacgggaacccccaacgtttgaagcggcggcgtgctactctcccacaccctctcgagtgcagtaccatcgccgccgaaataagaaaattgacgatcgccttataaggaaaggcgcatcgcacaaaaacctcaccgtccttcaaggcctcccggccactcgcaaggagcggacgatgaactggcaatcattgactataaagaagtagtacaaatacgctcttgagttctcaaaccaccaccactcacccacctcgcggaccggaaccatccggaccactcgctgagcggcagcaagggattaacttacacgaacccgtccacttgcgcaaatcggcattccgcaaaccccgtaaaaacccttgcggcgcaacgcattcatcggcgtgtcgaaaaccgcctatcgcacgccacatcatcgcagaaatgcttcagacaagcctcaaaacggcctgaaattcatcagaaaaacctgtctacgggcgtgtcgtgagcctgcaacgatttccaaatacggtcggaaagccgaaaaagacgcatacggaggaaaccgcgcggtggtatgtatggaggtatgagcaaaaaaatcgcagtattgacgggcgcaggcatctccacgtccgcaggcatccctgacttccgcggcccggacggcgtctggaccaaacatcccgagcaaatgaacgtgtacgacatcgacgcgttcctagccaataaggaagaccgcgagtattcctggcgctggcaaaaggaatcgccagtatggaacgcgcagccgggcaccgcacacaaagcgctcgtcaagctggaacaggcagggctgctgacgctgctcgccacgcagaatttcgacgcgctgcacgagaaggcgggcaatagcagcaacgtcatcgtcaatctgcacggaaccatcggcacttcgcattgcatgaaatgccatgcgaaatacaacacggcggacattatggcgaatctcgacaacgagccggatccgcactgtcatcgcaagctgccgtacagcggcaatatgccgtgcgacgggctcatcaaaaccgacgtcgtctactttggcgaggcgctgccggatggtgcgatcgaaaaatcgtaccgtctggcggcgcaggccgacgaattgtgggtgatcggctccacgctggaagtgatgccggcggcgagcattgtgccggtcgcggcacaggcgggcgtgccgatcaccatcatgaacatgggacgcacgcaatacgatcgcttggccacacggcttatccgcgacgatattgcgaccgcgctgccgcagttggttgatgagacgatcgctgaagaacagggcaaataacaccgaatgaacaagcaaggctcctcaacctgattgggtttgaggagccttctttgatgcggaagatatgcgagaatccgcgcttatccaccgtgggaaatcagtagatgcgcttgggctggaaaccggccgcgcgcatcgcgtcaaggatgcggtcgatgtgctcaggaccgttggtctcaacggtgacgcccaaggaaaccgaatcagtgtaatggctggaagccttgaactggtcgtgatcgagtgcgatgacgttggcgcgctgctcggccagaatcgtggccaccttgaccagctggccaggggtatccggaagctcaacctcgaagttcatgatgcggccacgggcaatcatgcccttctgaatcaccgcgctgatggagacagtatcctcattgccaccggaaagaatcggcaccaccacatgcgggcccttcgcctcggcgaacttgcgcgagcgcagattcaggtgctcgagcgcggccagagacacggcaccggcagcctcgaccaccagcttgtgcttctccagcatgagcaggatcatctcgttgatgtcgcgctcggtgacggtgaccagatcgtcgaggaactcgttgagcagcgcgaaggtcaggtcgcccggacgcttcacggcaacgccttcggcggaggtacgcacctggtcggctgcgacgacgcgaccggcggccaacgaattcttccatgccgggctgccttccggaatggcgccgatcacgcgcacttccggcttgaacgtcttgatggcgagcgccacgccggcgcccagaccgccgccgcccaagggcacgaccacgtcggtgacgttcggcacgtcttcgaggatctcaagaccgatggtgccttggccgcacagcacctcataatcatcgaacgggggcacgtagatcatgccttcgttgtcgctcagttcctgcgcgtgcgctgcggattcgtcgaacacctcgccgcacagcaccacgtccgcgccgtacgctttggtggcatccaccttcagcggcggagtgatctgcggcatgcagatggtggccttcgcgccacgttcacgggccgcgtacgccacaccctgcgcatggttgcctgcggaagcggtgacgatgccatgcgcaagctgctcgtcggacaacgatgcgatcttgttatacgcgccacgaatcttgaatgacccagtgacctggagattctccggcttgagcagaatctcatgtccggtcatctcggacagcaccggggacggaataatctccgtgtggcgtgcggtgcccttcagtcgttcggcggccagtttcaattcagcggcatgatcacgccgcaatgctttgagcacctcgttttgttccatggacgttattgtaagcgcacgtctgccgaaaatgccgtgcgattgccgaatcgcaatcgaatcccggccgtgcctcagaatcgcacggaaaaagaaacgtccgacaggtttcgtgatgaacctgccggacgttccgcagagagtttatagggaaagatcgatcagagctgaatcacgactccctcccagcgagcgagctcgccacgagcgatcgatttaacactatgcatagcatcataggtgctgagcagtacttgcggatcggacacgccgtcggaaagcagctccgccacgtccgaaggcagcgccgcggacctgtcggtgaggttgaccacgacaagaatcgtgtcgtcgccattggtgcgcgtgaaagcatacacctgatcgctgtcggcggcgagcagatgccattcgccagtggagatggtggcgctgttgtgccgcatggcgatgagcttcttgtagaacgtgtacacggaatccggatcgtcgaattcctcggccgcgttgatttccacatgattcgggttgacgctgatccatggttcgacgggcgcgtctggcgcggtgaagccggcgtatttggaggcgtcccactgcatgggggtgcgcgcgttgtcgcggccgatgagggcgagggcggccatcatggattcggacgactggcacttggcttcctccacgcgctggcgatagccattgagggcctccaaatcgcggtactgttccagcttggtgaagtgggcgttggtcatacccagctcctcgccttcgtaaatgtacggagtgccacgatgcatgtgcagcaccatgccgaacgccttggcgctcagctcgcgcgaatcgcggtcggagtcgttgccccaacgggagaccacgcgcggctggtcatgattgcagaagaacaggctggcccaaccggccttcctcacggcctcctgctgctcggtcatacggtcgcgcaggtttttgacctcgaacggcacggtattccacttggagccttcctggtcgatgccgacatggtcgaacaggaatagcatgtcaagttccttgttggccggatcggtgacgtgctcgttacgggccggggtgatgcccggagcctcgcccacgttgatgtagccttcacggccttcgaatacctcacggcgcatttcggcgaggaactcgtcgatgcgcggaccgtcggagcagaacgggaacgggctggaatagccttcctcgccgaccggcagatcggcgatttcggaaccgtcctcgcccggcagcctgccgttcttgtcgacggtcttggagatctgggtgatcacgtccatgcggaagccgtcgatgccgcgatccatccaccaattcatcatcttgtagacggccttgcgcacctcgggattctcccagttgaggtcgggctgcttcttggagtactggtggaagaagtattcgccgcgcttcgggtcgtactcccatgcggagccgccgaagtaggagccccactggttcggctcggcgcccggagtgcccggctcatggcccggcttggcgggacgccaccaataccaatccgcatgaggatcgttcttgtcgcgggaagcctggaaccaggcgtgctcgtcggacgtgtggttcacgaccaggtccatgatgaccttcaggccgcgcttgtgcgcttcggcaagcagctcgtccatatcggccatcgtgccgaacagcggatcgatgtcctggtagtcggagatgtcgtagccgttgtcgtcctgcggggacttgaagaccggggacagccacagcacgtccacgccaaggtcggcaagatagtcgaggcggctggtgatgcccttcagatcgccgatgccgtcgccattggaatcctggaaggaacggggatagatctggtagaccaccgcgttggcccaccatggattcggggtggcgccattcgaacggacggtgtcaggaagagtggaacgattgaaattcgtcatcgcgattgagctcctttgcctaagtggaatggatgaactttgctatatcccatggtacgtaaagcgttttttctttcttgcctgcggcgcgttttgcaaagcaggaaatgaaagatatattgcaagcgggatgcgcccttcggaatcacatcaatgcatacgaaaagcaggaatcctcgaaaaaggggaaacgaggattcccgctcggcgctgtgaagttttacttcacaagcagacggcctacggccgcgttgttcctgccttcgctcgcctatcggctcgctcaggaggaacctatgaacagtccacaggactgttcacttaacggctcctctcatcacaccaccgacgacccacttttgggcgaagatgtagacgatgaggaccggggccatggccatcaggtaggaggcgaaggccatcgggtagttcgacgtgaactggctctggaacacgtactgcgccagcggaatcgtctgattgctctggtcggtcagcgtgatcagcggcagcaggaagtcgttccacgcccacagtgcggtcaggatggcgattgtggcgttgatcggtcccatcagcgggaagatgatcgtccagaagatgcgccaggtcgaagcgccgtcgatgcgcgccgcctcttccaacgaaatcggaatcgaacggatgaagccgatcgcgatgaacaggttcgtgccgatgccgagaatcgtgtacagaataatcagaccgagctggttgtccaggtgcagggtgcccatttccttggcgatcggcagcatgacgacggtgaacggcacgaacatcatggccaggaagaagtagtacaggaagcggaagaaccgcttatccatgttccttgccacggcgtacgcgacgaacgtgttcgtcagcagcgtcagcaccacagcgcacacggtgatgatcgcggaattgagcgcggccttcggatagttcaccttgttccacgcgtccgcgaaattatgccattcccacgtggtcggcaggctgaacgtgcccgcttcgcccggcgtcttcagcgcggtgacgacggcgaagtacagcggcacgagcaccgtcaggctcagcacggcgacgaccgccgtcagccaccagttgatgctgtggtccttgcggatcttctccggcttcgcttgcgattgtccgctttgcgcggcggccggcttggttgcaacagttgcgctagtcatgatttcttccccttactctcagaccttttccttgccgctgaagaacttcagctgcacgaatgcgaggattgccagcacgatgaagaacgtgaccgcgttcgccatctggtaggagtattcgccgttgcccaggccgttctggaagatcaggtaggagacggtttcggtcttggaatccggaccgcccttggtcaatgccatgacctggtcgaacgcgccgagcgagttcttgaggctcagcaccatgttgatggtgaagaacgggccaatcagcgggaacgtgatctgccagaagttctgccaggcgttcacgccgtcgatggacgcggcctcatagatttcgttgtcgatggtctgcagacccgccaagtacagcagcgtggagtaggccacaccctgccagatggacaggaacacgatcgggaaccatgccagatccggattggagatcatggatgtggacagccaatcgatgtgcagcgcctggccgagggccggcagcggggtcatgaagatgtacttgaacacgtagccgatgaccagcaccgacagggtgtacggaatgaagaagatggctcggaagccgttcttgaaggcgattttggagttcagcagcaccgccaggaacatgccgaggatgttcgtgccgagcgtgatcagaatcgcgatgaaaatcgtgaacagatacgcgtggccgacgcgtgcgtcctggaacatcgcgatgtagttcttgaagccgatgaacttgtaatcgccgtaaccctgcgaattggtgaacgagtacatcgcgccctgcaggaacggcaggtacaggaagatgcacacgagaatcatcgcgggaatggtcatccagtagaacgccggatcgaccttgcgcttggagtatttcgaaaccttcttcggcttctttgcggcggccttgtcggccttggccgagatattgccagtcattgtcgttcctcccctcacctaaagttcctggcttcgatcttgtcgtattccgactgcatgctgttcaggaatcgtttagtattgcccgactgcaccaacgtctgcaggaaaccggcgaggttgatgcttgccggcacgtagtggtcacagaaatcagccagcttgccggccttgtagaagtcgagcacgccattcaacgcttcatcgccgacgtacgtatccttgtacggggtgaacgcagactgctgcttggagtaatcctgcacgttctcctcgctcatcaggaagtcgacgaattcgcgagcctcggtgtaatgcttcgtatgcgcgccgatcgtcagcatcacgtcgtcgccggcggtcagctgctgttccttgacgttgtcggtggccggcatctgcgcgaaccgcagattggcgtccttgttgatcagacggatctgcggaatcgcgtacgtgccgagcggcagaatcgcggccttgccggaagcgatgtcctgcgtagcctgctggtaggtgacggccggattcttctgcgtgtagttctggtaaatttcaatcagcttgccgctgacgggcgtccacaagtcggagaaggtcttgctgccgtccttgagatacgcgtattccgattccggcaccagcgtcgaattcagcgatgcaagcggcgcctgcaacgtccacggatcggcggtgctcgcctcaaccggcgtgacgcccttggccttgagccgcttgagcagcgcgatgaattcgctccacgtctgcggcggattgtccggatcctcgccggcctgcttccacacatcggcgttgatgatgtagccgcttgcgttgcccgcgtacggaataccgtacagacgcttcttggacttgtcggtggtctgcacgaggctcttcgcgatgttcaccatgcccggattgagctcgtcgacgatctcgtcgtcggtgaaatcgtggaagacgcccgcttcggcgagcatgccgtaattgatgtcgccgttgatggtgatgacgtcgggttcgcggttcttcaccagtcgcgtgcgcagatcggtggtggcgtccgacgaattgttgacattgactttgatgttggaatgggttttctcgaattcacgcgccttggcggtgaaccaatccgccgcctcggacttgaattggaagaaatccaaggtgaccgtgccggcggtgctgttgccgcagcccgcgagcccaaccgtcagcacaatcgcgcatgcagccgtaatagcacggcccgcgatccgcctgaaggtgcctgtgttggcattggaatcaggtttcattctctcgactcctttgtattttcctttttcacggcaggccggcttcattaccagcctccgttgctttttaattgtagaatcggcttgttttcattcccagtttccgcgcgcccgcatcgaacggaaataaaaaacggttattttgttatgcttggaaagaaaatagacggtaaggacggtccgatatggcgatttccccgattccacactggtttgaaggctcggagtacacgcataaggttgcggcctgcattatgaagtacggtccgatttcgcgcatcacgctggcacagatccttggcctttcgcaaggcgcggtatcgcgcatcaccagtgatttgatttacgctggcgtgatcgaagagacgccaatggcagcggggcatggcggcaagttaccgaaagatttcttgcggaaatcggcacaaaagtcaatccagaaagaaaatacggaacgtcgcggccgtccgcagaccggactgcgcatcatcgccaatgcgcgcacgttcgtcggcatgaaaatcaacaccacccatatcactgccgtaacagtaaacgcgcttgggcagattgtgaccggctgccatgacctgccgattgaggacgattcggtggaaacggtggtcgacgttattcggcagctgaccatggactgcgccgacgaggcgataatggcgggattgccttcgccatgcgcggtcggcgtctcgttgggcggacacatcgtggatgattcgatggtgacgttcgcgccgttcctgcattggtcgaagcccgtggagttttcggcgttgatccaggaggcgaccggcctgccgaccggcatctacaacgacatcgactcattggtggtggacgcgtgcatgttcggctcgggcgtcggattgaacagtttcgccgtggtgacgatcggcatcggcgtaggatattcgctcaccgtcaacggcgagccgatcgacaatcccgacaaaagctatggcctggtcgggcatattctggtcgaccccgacgggccgcgctgcatttccggacataaaggttgcgcgacgtgcctaactgacaattcaatcgcaacagaatattcggaaataatcggacatccggcgacgttcgacgaattcgcagccgcagcgcgcgccagcaaaacgcaggccacgaatctggtgaaccgcacctgtttccgtttgggtacattgatcgcgaccatcgccaatcttgccatgcccgacaaaatcatgatcgctggcgaatcgtcgttcattgcgaaactcggcatagacaacctgcgtaacggcatcaatatgtatcggcatagtcaagccgcgccggtcgatttcgaaatcgccgagcacgactggtcgctgtggagcaaagcggccgcagcgcaagccattcgccagtatgtagggtaagtcgttcggaatcgctgtcgcagtgtgaggccggtacgcgaaagtaccagcctcaccatacaaaacagatactcagatgcggactactttgaaaaggacggcctgtgcgggatgcaatgccggcggacggatgccataggcggcgagcgcacggccggtcatcttcacaccatcggcggtccaccagccgagcgggctttggccgttgccgatgtcctgcttgactaggtcaaggcttacgtcaagcggggacaccacgtacacggcgtccgggtcgaggccaggcagacgtacgggggcggacggataggtctgcgatgtggtcagctgtgtgaagcggtagatcgcggcggccttgttcggcatgacgcaaccgtccacgcgcacggccggatcagccgcgtcggaatgcacgacggtgtcgacagcgaaccattcacgatgcttcttgaattcggcagtccattcggagagcttgtcgatatcctcctgcggttccttgagcagattccattcgatgcccatgtgtccgaagaaggccgtggccatgcgcatttcctgcgaagtggcgcgatgcgtggaatgcgccggggaagcgcccacgtgctcgccgatcatttccggcggcacaagcagcgacgtgtagcgctggatgtcggcacgttccaccgggtcgacgcagtcagacgcccaaacgcgatcggctacttcaagaatgcccaaatcgatacggccgccgccggaggagcagctttcgatttccaggccggggtgcgctgccttcagatcggtgaagatgcggtatacggcgagcgtctgcgcgtgcgctgccggacggccggtcagcggcgagacttcttcggtgacgagcttgttgtggtcccacttgatgtagtcgatgcccagctcgctgacgagcttgtccatcgcaccgtaaatgtagtcgtacgcgtccgggttggtcaggtcgacgacctgctgggtgcggccctgcatcggcagacgaccggcggtgggcttcagcacccagtccggatggttgcggaacatgtcggaatcggggttgaccatttccggctcgaaccacaggccgaattcgaggcccttgccgtgcacgtagtcggcgagcgccttcagggacttgtctccgtcgggccagacgtcctgcgaaatctgccagtcgccgaggccggcggtgtcgtcacggcgggcgccgaaccagccatcgtccacgacgaatcgttcgacgccgctttccacggctttgtcggcgagggcggtcagggtgtcgtaatcgtggttgaagtagacggcttcccacgtgttgaggatgaccggacgcggcttgggcgcgatgccatggtccacgagccagtcgcggtgcacacggcggatgtagccatggaagcgggaggcgacctcgttgagcccttcgccgtaggaaccgacgagccatggcgtcgtatagctttcaccgtgttccagaccgacttcgccgccgaagagcacttcgccgccaccgatcacgcctgtggtgtagggcagtcgttccgcggacagcacgctgttgccactccatgccacgtgcgcggagtagacgttgccgtgggtgaaaccgaagccgtgttcgccaacgctgagcagcagggtggcgtcgaagtcggggcggccgatcatggaggatttggcgaagcgcccgatggtgaagtcctggcgctgtggggaacgctcacgcagatggtgaccggtggtggtgaggatctcgttggcgtcggcgggcacgctgaatgcaagttcgatcttgccgatctcgagtcgtccctcgccggtgttcgtcacctccgcatgctggcggatgaggccggtttcatcgagctcacaggtccacgtaagtttcacgcattgttccacgtcctcggcagtgacggtgacggtaggcgtctgcttgggctcggaggccacgctccagctggggtagccgtctttttcggccatggtgtaggttttgccggcggccacggtttcggctttgatgtcggtgacctggaacttgcagaacagttccacgccgtcacggcgcacgtcgaaacggtcagagccggaccacgcttcggactgtgtcggcagcacgctcggccatgcggtgtagtcgagggctccggaaacacgctgcggagcgagcgcgtcgaacgtgttgatcacggtttccggtgcggtgagcgggcgaccccaatgcacgaatctcggcaaatcgctgccggggaacaccagagcaaaagctgcggcggcagccggctgctcggcatacacggcggtaaggggtgtgccgttggaagcggtgccgtggaaagtctgaatgagcgtcattgcagcatccttttcttgcgattcttggttggtatgacgctttgatgatactgcataccgcttttcttcccatcgccctgcgtgtttgtttctttcggaaagtaattagcgtcggcgcgcgaagaaatcggtcatcaatcgcccgcattctgcttcgcgcacaccgccaatcacttccggtacaagtccgacgtgcggatcgcggggaatatcccataccgaaccgcatgcacccaacttggcatcccacgcaccgaacacaatacgtccgatatgcgtctgcaggcaggcaccggcgcacatagggcacggctccaacgtaacgacaagcgtgcaatcagcgagattccaagtgccaagcgaggcggccgcttcagccatcgccttgacttcagcgtgggcaagcggatcggcatgcgtctcacgcaggttccgcccgcggccaatcacccggccgtcagcggcaagcacgacagcaccgaccggcacctcgccatccgcggcggcttcgcgggccagcgcgaccgccggttccatatcatcgtcccatcgcatacgccacagtgtagcggcggccatacgaccgctccgcacgactggtccgcacgtccgacctgcatgcccgacctgcgcgcccaaccgaagcggcacgaacgtcagcccatagcgaaacacgctcataaccgcctcttggtaggctggaaaaggttggaaatacgcgcaaaggaggcacgttggcggtattcgagttgattctatgcatcatcgctgccgtcgtactgtcctcgttcctgagccgattcatacccaaggtctccacgccgctcgtgcagatcgcgttgggcgcgctggcatcacaactgccgttctttccggacgtaacgctcagccctgaactgttcatggtgctgttcatcgcgccgctgctgtatttggaagcgcatgagattgacaaaaccgagctactgaaatccgtcaaactgtcattgtcgctggcgatcggcctggcgatcgcgaccatggtggcggtcggtttcgcattgcacaccgtctggccggcgattccgctcgctgcggcacttgcgctcggtgccgcgctcgggccgaccgatgcggtcgcagtgtcgtcgctcggcaaggaggcggcgctgaccgaacgccaaacgagcgtactgaagggtgaatcgttgttcaacgacgcttccggtatcgtcggcttccagttcgccatcgcggcggcggtcagcggcgtgttcgaagtgggcgaatcggccgcgcaattcgtgatctcgttctccggcggcgcgatcttcggccttgtggtgggcaccatggccgacctgctgttcgaatcactgcgctccctcggctgggaaacgactaccagccgcattctcatggagctattcctgccgttcatcctgtatctgggtgcagaggcggtccacgtctccggcattctgtcggtcgtggccgcgggcctgatcatccgattcgaccgcaccggcatcggaccgaatgtggcacgcacgaacatcgtatcgtcaagcgtgtggggcgtgctgtcgttctcgctcaacggcacagtgttcatcctgctcggcatgctgctgccgaacgcgatgtcggccagctgggatgatccgcacatcagcaacggcctgctgatgtgcgcgatcctcaccgtctccgccgtggtgatcgccatgcggttcctgtggatctcgctgatgctccggctcgcgcgcgacaccaccaccggcaagcggcgcaaaatgacggcgcagcgctggcgttccgccgcggtcatgacattcggcggaccgaagggcaccatcacgctgtcgttgatgttcacgatcccctacacgctggcggccggcgcgaacttcccgatgcgcgacgaactgatctttatagccgccggcgtgatcgtggtgacgctgctgctggcgaatttcctgctgccgctgctcgcgccgaatcgcgacaaggacacgtcgacggaaatgacggagatcaccatcgaagtgctgcggcggacggtcgaagagctgtcgggccgtgtcacgccggacaaccgtcgggcggtgcttatggtcatcgattcctatacgaaacgcatcacgcggttgaaacagcgcaccggcgaaatcgatccgcaggggtatatgcagctgcagatcgacgcgctcaactgggagaaggagtacgtcaagaaccgtctggcgggcgtgcgcgcggcaatcaaggcgaatcccgccgagaaccgcgccgcgaacgatctggaggccgaggcctgcgagcgcctgctcgaccagatcatgagctcgctgcgccacatcgaaaccgcacacaattcaggccgtatgatctggcgcgtcaaaggccggtacaaggcgctgcagcggcgcatgggcacgttggcgaaacgcgtgaacagccgtatccggcgcacgaccccgctgttcagcgacgatgagctgttcgcgcatacgcgtgtggtgcaggtggatgcgatcgaacatgtgatcgaccgactgtatgaggagatgggcggcgacacgtacaacaccgagcactgctccggcctgctgttagactaccgacgcagcgaatccgcgttgagggcgcgtccgaatatgggcatcagcgccgaagcgcaggaacaggccgaggaggtcaagcgcgaaagctacggcatcgagctgggcgtgatccaggacatgtatgaggccggcgacatcacgcgtgcgcaaagcaagcagctgcgacgcaacgtgtatgtgatgagcgtggatgcggacgcgcagatctgacccgggttgcgcgctcaggatacacgtttccctcgcacgttcatcgtgcttagcggccacggcatatacctgtattaccagcgcgaacagccaatcccatgtatccctcctaccgaggaaaaatacctcaaggaacggaagagcagggatcacgcgtccgcatccgaaaatcatcggaacagaacccaagagcgcttttaaaacttttgcatatgataacgcatgaatatttgagacaaagtaggtatcttggaataaagatgaggtttttcacttcatccggtcggaaataagccgaagtgaaaacaatgtggataactctgcaaagatgagaattatctgtttcatttagacacgaatgctcctttcgaaaagatgattgacaaatacccctaatagcctattgtttagtcatgcttcatcggcattgtaaagaaaggggattgaatgaaaatagtcaagagaatatctgcccttttcattggtctagcacttatggtggctctgcctgtcaccgctcatgcgtctacaaacgatgatcagcaagacatcgcatcattggatatgtccgtcatcgacgtgcacatacaatcacgcggcgctatgaccgcggaagatctgtacgacttcctccaatccgatgcagagaaaactgttgacatcgatgctgaaacagggaaaattaccgccgtgagcgaaggtataacgaagcctaggattgcggtcaacaatatttgcaatggccatgactcatgccttatccacaatcgtgttccttatgcggacttcggatttagcgggaccggaacgaagaccgggaattggccctaccgcatctcttgggagactggttctcatacggcaaaagcttggtacagacatggctatgacgttgttggatggggcactaagttcggacctcacaccaaggccaatatgaacgctcctgtcacggctgttcaagtcaccaattactcgtgatcctgcatgagtttctgacgcagaagataaagacggctcatcagaattctgatccgcctggacatatgccgccgaattctcaggaagttttcagaaaacaccagacatgtgctcagcatcaggtgtttatatatgaattgtcagcagaaacaagccgaccaggaaccttgaagttcccgacaattgaaccctttcttcttctctctcctttctctccccggtggccgatcccaccggggtcttcttttttcacgaccaccttctcacgctatcgacgcacgctatattgggaaggtatgagcgacgcaatcgaacatgaaattccgcaaaccgcagacaacagcaacaaaacggagctgatcggacgcgaatcggatgtggtgccgggccgtttcggcgaaccgctgcaggtgacgcacgtccagtattcgcgcggcggcggcaacgcggcaccgaaacggccgctgttcctatgcctgcatggctggggatcgaatgaggctgaccttgccgatatgatgcgatacatcgcaccatacaacgattacgcttcactgcgcgcgccgctgacgctgcaggaggccggcacgttcactccaggcgcgtactcctggttccatgattgcgtgccgtccggcgaagacctcgaccgcgacgcgttcgccgcatccatggctatcgacgattgggtgtcgcagaacgttcccgaagaccgtgccgtcgtgccgatcggcttttcccaaggtggcttgctggcgatccatctgctgcgcatgcatccggaacgctaccgtgcgtcgatttcattgtccggattccttgcgcctgggctcgtccgcggcaccgcgcctgccgacgaccgtatcgcgccgctcaatattcccacgttcttcggttacggcaacagcgatacggtgatcgccaagccggagcttttcgccatgagcgcctggctggacgagcacacgttcctcaccgcgaaaagctaccgtgggctcgaccattccgtaagtatggaggagttcagcgatttgcgcgattggcttgccgcgcacaacatcgcgccgggaatcctgtagatccgggtcagttagaacagtcggattagtcggtgatgtcggccttatagaagttcacgtaggaacggctcggggtcggaccgcgctggccctgatagtgcgacccggtggtggcggaaccgtacggatgctcggccggcgagctcagctggaagaagcacatctggccgattttcatgcccggccacagcttcaccggcagcgtcgacacattggacagctccagcgtgatgtgcccttcgaaacccgggtcgatgaatcccgcggtggagtgagtgaggatgccgagtcgtccaagcgaactcttgccttcgagtcgtgccgcaaccgtcgaatcaagcttcacatactcccacgtggagccgagcgcgaactcgcccggatgcaagatccacggctcatcagaccggacttcgaactgctcggtcagctcgccctggttctccgccggatccacatacgtatacgcatggttgttgaacaggcggaagaaacggtccaatcgcacgtcgatcgacgccggctgcaccatttccggggtccacggatcgagtgagatgtgaccgtcggcctgtgcggcgagaatgtcgcgatcggacagcagcatcgaaattcctccaaacatcaccggaacaatcgtcatatgagcgggcgcgcagccaacgcgcgcccaccaactgtcgtccagtctagcccgtcgacgctataagccagcatcaccgccgatgcatcgcacgcagcacgcacttgcgcagctcggaggcgacgagcacaatcatcgccaggccgaggcattcgacccacgcacccgcggacagcggcacggtaccgaacgcggtgttgaggaacggcacgtagaccaccgcaagctgcagcagcgtggacagtgcgatcgcaccccacagccacttgttggcgaacagtccgacgaacacggactggtcgtgcgaacgcgagcacagcgcgttgagcatctgcgcgaagaccaggatggtgaagcccatcgtgcgcgcctcagtcatttgcgcatcatgtccgacagcatccacggaacggtccgtgaacagacctccggcgaggtgcatgtccatgccaatcagcgtgacggcagccataatcaaaccgatgaaaatgatgtcgccccacatctgtccgtcgatcacgcgatcggtgagtttgcgcggtttgcgtgccatcacgtcgtcggtggacgggtcgacacccatggcgagcgccggagctgcgtcggtaagcaggttgatccacagcagctgcgtggcgagcagcggcacggtgacaccttggctgccaggctgggtgatgccgaggaatccggcgagcatcacaccgccgaagacggtgaacacctcgccgacgttggagctcagcagatagcgcaggaacttacggatgttgtcgaaaatgccacggccttcgcgtaccgcctcgacgatggtgctgaagttgtcgtcggcgaggatcatcttggcactctgcttggtaacttcggtaccggtgatgcccatcgcgacgccgatgtccgcggttttgacggcgggagcatcgtttacgccgtcgccggtcatagccacgatattgccttgccgttgcagcgattcgacgattttcagcttgtgttccggcgcaacgcgcgcgtacacggagatttcgcgggtggccttgtcgaacgcttgctcgtccggcagctcgtcgagttgaacgccggtgagcactttgctactaaggtcggcgctgccgaccgagctgccgtctccgtccgtttcaataatgcccagatcgctggcgatgcgtgccgcggtaagcggatggtcaccggtaatcatgacggtgcggatgctggcacgatgcgcttcggcgacggaatcgcgcacttcggtacgcggcggatcgatgatgccgaccataccgacccagatcaagtcgctttccagcacatcgctttggtcggcgatgtcggcgacgtgaccggcggcgttgatgcgcacgcccggcactgcggcgagcgacgcggtgccgagtggccggtacgcctggcccagcgtacgatacgcttcggcggacaggcgttccacggcggcgaggatctgctggcgatcgccttgcgtcatcggtcgtacggcaccgttgaccgcgatgcggctgcagtagccgagcagcacgtcgggggcgcctttagcaaagacggtgagacgcccggcatcagtgttatcctgcgcgacgacggtcatgcgtttgcgatcggaagtgaagggaatctcgcccacgcgcgtgtagttggcgtatttgcgatcggccttcaccttgcgtgcggcgacgataagcgacacttcggtcgggtcgccgacggcttcccacgttatgtcggaagcagcggaaccatcgccggcatctgtgttttcgcgcagttcgccgtcgttggccagcgtgcccactgcgagcgtggcgacggcttcgacctgtgcggcggaagcggcggaaccagacagagcagcgtcgggaatcgcaatcattctgccttctggcgcatagccggtgccggtcagctgcacctcgccgctcggcgtgaccacgcgttccaccgtcatctcgttgcgggtgagcgtgccggttttgtcggagcagatcacggacgcggaaccgagcgtttccacggaatgcagtttcttgacgatcgcatgatgttcggccatgcggcgcacgccgagcgcgagcacgactgtcagaatcgcggcgagcccttccggcacggccgcgacggccagcgaaacggatagcagcagcgaatcgattacgtcgtggatgtcgttgaagccttcggtcagtgcaagcgccaccagcacgaccgccgcgataatgcacaccgcgatgccgagaatcttggaaacgtagttcatttccttctgcagcggactgtcatcatcatccgtggcctgcagaaggtccgcgattttaccgacctgcgtgcgcatgccagtgctcgtcacgattgcgcggccggtgccttgcgtcacggacgtgccgttgaacaccatattggcgcgatcacccaaggccttggcttcggcaagtgtgtcgacgtttttgccgaccggtacgctttcgccggtcaggctcgcttccgccacgcgcaggctggcggcggcgagcagacgtccgtcggcgggaatggagtcgccttcaccgagcacgaccatgtctcccggcaccacgtcgacggtgttgatgcgtgcgattttgccgtcgcgcagcacgttggtttgcggcgcggtcatttgggagagcgcttcgacggcttcttccgctttcgattcctgaatgtagccgagtaccgcgttgacgataaggataagcacaatgacgatggcgtcgaacggcagtatttcgccgccttccgcgcctggcgcagcgttggctttttcgatgaaccatgcgatgagcgagatgccggtggcagcgagcagcaggtagacgagggggtctttgaactgcgccaggaacttcttccattttggcacgggtggtgcggatgcgagctcgttcggcccgtattgcgcgagtcggcgttcagcttcggcttggctcagaccggtgttcggatcgacgccgagcgatgcggccacggcttgcgcgtcggcaagcgacgggtcgatttgtggcggctgctggttttgctgatcctgccgaatctgcgtgcgatcgcccgtagcggaatcgccgtcaaaattggcatgggactggatggactgatctttcttgcgatcatccatagtgatctccttgggagcgccgcggagtagtcagctctcccccgtcttacgtatgcctcgaatcgcggaaatcgaaaatccgcggaatcgcaagcattttgcaaaggcgaggcaacgctgcgcggttgtgggcaccgggcggacgccatcggcgcatcctgttattatcgcacatcttcggcgtgtgaaaaatggacatgtggcggaacgatgcatgacacgcgacgggtgcacgataccatgaagtgtgatatattatcggtagttagtaaaattcattactaaacggtcgtgcaacatcgcacggcgcaaccgcaacgatgcagtgacaccaagtaatacagggggatgcaagatggcagatacagccgaactcgcaatcgtacatgcaaccacggcaagtgcaagctggctcaccgatccgacggtgttcgcagcgaaccgcaagccggcacattccagccaccgatatgtcatcggcgagacgagcgagccgaagcagagcctcgacggcgaatggaaggttcgtatcgaacaagcgcgcaacgtggacgtggaaagcgctccgttcgcggccgtcgatttcgaggatggcgatttcggcgcgatcgaggtgccgggccacttgcagatggccggctatctcaagaacaagtacgtcaacatccaatatccgtgggacggtcacgaggatccgcaggcgccaaatattccggaaaacaaccatgtggcaatctaccgccgtcgattcgcgctcgacgcgcagcttgcgcgcacgctggaaaacgacggcacggtcagcctcaccttccacggtgccgccaccgcgatctacgtatggcttgacggcacgttcgtgggttacggcgaggacggattcacgccgagcgaattcgatgtgacggaagcgctgcgaaacggcaatggcaacgccgccgattcccccgaagccgagcatacgctcaccgtcgcctgctacgaatattcgagcgcctcttggctggaagaccaggatttctggcgactgcacggcctgttccgcaccgtcgagctcgccgcccagccgcatacgcacgtcgaaaccgtgcagcttgaagccgactacaccgcagccgacaccgccggtacggccgacaccgccgaactcaacgcggcactcaccttgcgcaaccccgccgacgcgatgactatcgaaagcacgctgcgcgacggcgacggaaatgtcgtatgggaatcaacgcaggcctgcaacggcgaaatcgcccttaattccggcaaaatgacgaacatcgcgccgtggagcgcggaatcgccgacgctgtacacgctgaccgtacgcgtcgtcggacatgacggcgccatcatcgaaaccgtaacgcagaagatcggcttccgcacgttccgcatcgaaaacggcatcatgacgctcaatggcaagcgcatcgtgttcaagggcgcggaccgccacgaattcgacgcgaagcgcggccgcgcgatcacccgcgaggacatgctttccgacgtggtcttctgcaagcggcacaacatcaacgccatccgcacctcccactaccccaaccaggagtattggtacgatttgtgcgacgagtacggtctgtatctgatcgacgagacgaatatggagacgcacggcacgtgggtggcaaacaatgtcgagcgtcctgaagacggcatccccggcagccgccccgaatgggagggcgcgtgcgtggaccgcatcaacagcatgatgcgccgcgattacaaccatccgagcgtgctgatctggtcgcttggcaacgagtcgagcgcgggcgaggtttttcgtgcgatgtatcgccacgcgcacacgattgatccgaatcgtccggtacattacgagggttccgtgcacatgcgcgaattcgaggatgtgacggacatcgaaagccgtatgtacgcgcatgctgacgaaatcgaacgctatctgaacgacggcagcccggcacatacggacggtccaaagaagccgtacatttcctgcgaatacatgcacgcaatgggcaattcgtgcggcaatatggacgaatacacggcgttggaacgctacccgatgtaccagggcggtttcatttgggatttcatcgaccaggcaatcgaagccaaactgcccgacggcacgacacgcatgtgctacggcggcgatttcggcgatcgtccaagcgattacgaattctccggcgacggcctgctgttcgccgaccgcaccccctcgccgaaagcgcaggaagtcaagcagctgtatgcgaacgtgaaaatcgcggtcacgcaggacggcgtgcgcgtcacgaacgataacctgttcgtgtcgacgggcgcatacgccttcgtcttgcgcgtgctggccgatggcaggccggtgtggagcgccacgcgtcgcttcgatgtgccggccggcgaaagcgctctgttcgatgtcgattggccgatcgacgactacctcggcaacgccaaggagctggttctggaggtctcgcagcagttgggcgaggcgtgcgattgggctccggccggctatgagctggcgttcggccagtgcgtggtggagggcgcgaagggcaccgatgcgactgttggcacggccagcgcggctagcgcggccgacggcgccatcaccttcggccgctggaacgtgggcgtgcgcggacagggccgcgaggtgcttttctcccgagcgcagggaggcatagtctcatacacgctcggcgaacgcgaattcgtgctgcgtcgtccttccatcaccacgttccgtccgctgacggacaacgaccgcggagccgggcacgccttcgaacgcgccgcctgggcggtcgcgggaaagtacgcccgctgcgtcggctgcgaaatcgcgccccgcggagagaacaccgtggaagccacgtatacatatgaattggcgattccgcagcacacaaaagtaacggtccgctacgttgccgatacggacggccgcgttgagctcgacgtcgagtatccgggcgagaagaacggcggcctgcctacgattccggcgttcggcatcgaatgggcgctgcccgtggaatattcgaatctgcgattctatggtgtcggcccggaggaaacgtacgccgatcgcaagcacgcgaagctgggcgtgtggagcaccgatgcgtaccgcgaccgtgcgccgtatctgctgccgcaggagaccggcaaccatgaggacgtgcgctgggcggaaatcacggacgattcaggccacggcctgcgcgtgaaacatgctgtgaaacctttcgcgatgagtctgctgccttattcgagcgcgatgctggaggaggcgctacatcaggatgagctgccgaagccgaggcacatgttcctgcgtctgctggccgcgcagatgggcgtcggcggcgacgattcgtggatgtcgccggtgcacgcgcagtaccagctgcccgccgaccagccgctcagcctcaacgttcagctcaagctgttctaagctaagccagcttcagcctcaagcataaccgccgattcgcggcataattccggccgacttgccaataggcaggccggccgattctgttgatggctgaaaacaggcagggtgcctaaaatgaaagcacgtctttgaagcaaacgacgcctcaaagcatgtttttctgaaggagggcatcatgagctatccaaatatgaatcccggcaatcccaacgaccccagtcaaccaccgcagccgggatacggcgcctatgcaccgaaccagcaagcgcagcaatcgcaacagcaggacggtccacaaagcggcggaccagatgccgagcagacccctcgctattccggcaatccatatggcaacccctacggcaatccgtatggatatccgtacggtaatccgtatggttacgacccgaatagccatagcaacgacagtggcgagtgggagccggtaagcccgttcaagttggtggaatcgtggctgccgcaacgcgcgaagaatgccattcgcggtgtatacggcgtgctcggcgtgatggcgattgtgctcggcattgcgctactcatctggccgggggtgacgctgaagatcgccgcggttgcgttgggcgcgtatttcgtgatttccggggtgatccgtatcgtcaccgcaattgtggagctcggtctgccgggaggctggcgcgtgcttgacattctggtcggcctgttgctgacagtcggtggcgtggtcatgctgaagaatgcgaccctgtccggcgccatgctggcagtgctcgtcactatggtggtgggcctcggctggatgatggaaggcgtgatggcgctggttgagtcgtggcatatgccaagttccgcatgggctgtgatttacgcgctgatttcgattgtggccggctgcatcatgctgttcagcccgctggcctccaccggttggctgattctgtttggcggatgcgcgttggttgcacttggcattgtggcgatcgtccgcgcgttcacgtttggcaaggtcggcaagtccggcaagaagcgctaactacgcgtagttctcccgtataggcgataaacccatacgggagaacgcgacgtgccgtacgattgacatgattttatagtcgcgctatgctaagtgaaacgtttcgacgaaacgattcgataaatagcggatagaacggcacaagagggaggcgagacgcatggcaggcatcaaagacgtggcccgcgaagcgggagtttccgccagcaccgtctcctatgtactatccggcaagcgttcaatctctgcgaaaaccaccggcaaagtcatggccgccgtagaaaagctcggttacactccggacgccagcgcccgtaagatgcgcggcatgcgcaaccagatcatcgcgttgagcgccccgattcgaggcgacatcaaccaggccaggtacaacgcctacttcctgcgcaccgcatgggccgcaaggaatgcagggcatgacgtgatgttgctgaccggtccggatgcagtgaaggatatccgccgcgtgacgcaaagcaatcttgcggatggcatcgtgctgctcgacgtggagcaggatgacgagcgcgccgctcaatccggcactttttccaagccgtgcgtggctatcggctatccgtcgtcgcacgccggctgcgcctgcgtggacatcgatttcgcgctgatgggccgcaaggccgtcgacttcctgtacgagaagggacaccgcaccgtcgtgttcctgcgcaacaacgaatccgactacaaccgccattccggttacgtcgtcatcttccgcgaaagcctgctggcgcacgcgaaggagctcggcatgacggtcatcgaatccgagcattacgaagcggacagcttcgacgcgcagcacttcgtcagcaccgtcttcgcgcaccccgaccgcccgaccgccatcatcaaccaggcgaacgcaagcgtcctcagccaggtgctgatggcgttgcacgacgcgggcatgtcgattccgcaggacgtttcggtcctgtcgtgcggcacgtatttcgaaggcgagccgacgcgcttccccatcaccgaaatgccggtcatgccggaggagctgtgcgccgaagccatgaacctgttggtctccgccatcgaggagcacaccgacatcaaaggttccgtggaactcatcgaacccgcgctgaagcgacgcggatccgttgcggaagcggggtccggcggaacaatatagattttcctgcgattaccggaaggcagagcggccggacggaatcgcaaggcaacataatttcatacggataatcgaaacgtttcaatgacgatacaacggtctccgaagaaaccgaacaaacgaacaagccgggcgaaatccggcgaatccaaacggaccgcggaatcgcacgcacgtcatcgaaacgtttcaatacaaccagatgtgagccgtgccgcagggcgcgcctcaagaaggaaacaaggagaatagcaatgaacatcaaacgaggactggccacgctggccatcgcagcactgtcgctgacctccctcgccgcatgcggcagcgataccgcacaggacgaggaaaagccggacagcctgtcgttctggtactacgaagaggacgacgcaggccagacccaggcatggcgtcgcgcggccaaggccttcgaaaaagagaccggcgtcaagatcaacttcgagcgcaagtccttcacccagatcgcgcagaacggcagccaattcctgaactccgacgaagcgccagacctcatggaatccaaccgcggcaacggctccgccggcgtgctctccaccatgggcctgctcaccgacctcggcgactatgtcaagcagtacggctgggacaagaaggtgaccggcgcaaacgcagcagtcgccaagtacgacgagaacggcatcatggacggcgatacctgatacggtatgaccagctacgctgaattccagcgcgtctactacaacaaggacctgttcgccaagtacaacatcaagattccgaccacctacgacgagttcgtggacgcctgccagaagttcgtggacgccggcgtgaccccgattgcagccgacgcgcaggaatacggcgtgatgtggctgtggtggcagctcgtttccaagaatgccgactccaagttcatcgacagctggcagctgtacaggggtgacgtcgactggaattccaaagtgctgaccaactccgtcaagaccatcaacgagtggcttgacaagggcttcatctcccgcaacgccactggcatgaaggccgaggacaccacgcaggccttcatcaagggcgaatatccgatctaccagactggtacttggaaccagggccgtttcgtcaagcagatcaagtcgttcgattgggacgcggccgtcatgccggaatccaactacgcagtcggctgcgcaggcaacctgctggtgattcctgagaagtcgcaccacaaggatctgtccgccaagttcatcgactacgtcctctccgatgatgtgcagaacttcctcggcaacgcaggcggcattccggtagcggcagacaccagcaagatcaccgacgcgaagagcaaggccatgatcgaggaatacgattcctacgccaaggacggcaagctcagctactacccggattacgcggcctccaacctcaccgacgcggttccagcggagttccaggagctggtcaacggcaccaagaagccggcagacgtgctcaagaacatccacgagaagtacgacaccggcgtcgaggacatgggcgtcaagaacaactaaaaacaaccgatccttcctttccattccaactccaataatggtgcggcccgtcttcgggcggaccgcaccaaccctttcctcccccatacattccgcacgtcgcatcgcgccaaatcgtgcgtcatcacagaacaatccatcggaaatccctcggatcatcaatatttcaaaggacttgcaatgtctcaaaagaccaagcacgaagcctccatgtcgagacttcccggcaaccgctccgcgaaattcgttccatacctcatccccggcctcatcggtctgttcgcggtagttgttgttccgttcatctggaacatctacctgagcttcacccgctggcgtggcgtcggtcccgtcaagtgggtcggcctgaaaaactggaaacgcctgttctccgattcgacgttctggatttccttcgctaactcgttctggatcatcgtggctatcgtggtcatccctaccatcctcggcctgttcatctcgtctctgctcaccgacgtgatccaaaagaagttcggcggcaaaaccgcttccttcctgcgcgcgctgttctatttgccgcagctgcttccggtggccgtcgccgcaatcatcatgggctggatcttccgcccggaggacggtgccgtcaacgcactgctcgccaagatcggcttgggtgcattgcagcacaactggctgggcagccctgacagcgcactgccgatcctcatgttcatcctggtgtggatccagctcggctacccgatcgtcatcttcatgtcgggcctgcagcgcgtcgatccggaactctacgaggccgcaggtcttgacggcgccaactggtggcagaagttccgcgtggtcaccctgccgtccatcatccctgaactgctggtggtcatcctcaccgcaaccatcggcgcactgaagaccttcgctccggtctacctgctcaccaagggcggtccgggcacctccaccacggttccgtcgtactactcctacaaccagttcttccaggtgcagcaggtgggctacggtgccgcaatctccacagcgctgactgtggtaatcatcgtcttctccatcgtgttcaccctcgtgcagaagcacgtcgagaaggaactcgtctgagagaaaacccgaaaaacaatcgcaagaacatactaaaaatccgaaaagcaaaggtgccatcatgacttattccatgtccacggccgccgcgcgcaaggcctcgaagaaaacgcagcacgtgcgttccgcaggtgactggatcaccctgatcctgctcgtcgccggagctctgctcgtcctgttcccgctgctcgtcctgaccgtcaacgcgttcaagacctccgccgattacaacgccaccggcccgctctccctgccgaagcacttcaccatggagggcatcatctccttctggactaccaccaacttcccgctgaagttctggaacagcttcatcatctccctagtggtggctgtcgcggcggtcgtgctgtcggtgctcaactccttcgcgctcggcatcggcaaggtcaagggcaacacctggatcgtgctcggcatcatgctcgccaacatgatgccgcaggaagcgctgctctacccgctgtacaccatgttcaagcaggtcggtctgtacaacaccaaactcgcgatcatcatcatcttcaccatcatccaaagcgcctacggcacctatctgctgtcctccgtatacggcacgttcccgcaggccatccttgaggccgcggccatcgacggcgcctctcgctggcaaatcctgcgcaaggtggtgctgccaatttcttggccgaccatcagcgtgctgttcgtgttcttcttcgtgtggacgtggaacgaatacatgattccgatggcgttcctcatgagcgatgacgtacagaccattccgctggcactcgccaccctgcagggccagcgcaccatggaagcgaccacgctggcatcggcttcgctgctgagcatcatcccgaccatcatcttcttcatcatcttccagcgcaagctgtcgcagggtatcaccgccggtgcagtgaagtaacgcgacccaacaacgctgggatgttgtgaaataacgcaaaaacagatacaaccggccgcggcggctttcagcaccgtagccggcattatcgacgcgcccactgcaagggggatctacgatagtcggtagtggtaggcggcgcacccatttccgcgtttcccaagctgtttaacaaaggagagaacaatgaatactatggcgacttccggtttcggcaacggtgccctcgattcgctagcaatcgcgacggaccacggccgtacacgttgcgtcaacgccgaaaacccgaccggcggcaagggcactgcagccaccgctgccagcgcgctcggcccgtcacgtaagggcagcccttgcatccagacgatcaaggcgggcgattcggtcacgctgatggacgtcgatggcccgggcgtgattcgccacatttggatgacggtcaccgaccgcacttccccgaccggtccgaacgtactgcgcaatctcatcctcgaattctattgggatggcgaggagacgccgtccgtgcagtgcccgatcggcgatttcttctgctgcggtcacgcacaggcctgccgtatcaattccatcccgatcatggtggtgccaaatcgaggtttcaactgctatttcgccatgccgttcgagcacgcgcgcattgtgctgcgcaacgatcacaacgaggacgtgccggccttcttctaccaaatcgactacacggaatacgacgcgctgccagccgatgcgatgcgcttccatgcgcagtggcgccgcgaacgcgtcaccgaaattgcccgtgactacacgattctcgacaatgtgcacggccatggcgcgtacatcggcacctaccttgcgctgaccgcgctggaaagccgctggtggggcgaaggcgaagtcaagatgtacatcgacggcgatgaacagtacccgacgtggtgcagcaccggagcggaggactacttcggcggcgcgtggagcttcgccgacttcgacgagcacggccgcatgcgcgagaacacgttcaccggaccgtacctgggattcccgttctattcgcagcgcctcgccgcgcaccgcgaaagcgactactgggatgtggccacacccgtcatgcgcggcctgtaccgctggcacattccggatccgatttatttcgattctgacctgcgcgtcacctggcagcagatcggcaccgaggaagccggcaatttcgagcggcaggatgacgtcgcgtcggtggcatactggtaccagcttgaaccgcacacgccgttcgatccaatcggtgaccgtcacttccgtcagccccgctgatttacgattattccgctgatttacgattattccgctgatttacgccgatatcgccgtatcgtgcgttgacatgggaatggatatgttccgtctcgtgtcagcgtacgatacggcgattgtgttgttatgcgggcacagtaatcacattttcttcaagataacccgatgattttacaatagaaatgacgattgcggcatgccagacgcataccgacgtgcgtatagtaaaggcacaacagaaaaacaacagaagaacgaagaacaagaaaaacaacacaatagcgacgcaccgcacgatgtagagaagaaaaaaagaagcaagaaaccaggcggtcgtccgaaaggaaacatcatgaagaacaacgacactttcaaccagatcctcaactccaacctcgcttccatcgatccgggcttcggccagttcgcacttgccaaggcttccgctgatctgatgaagaaggtcctcaacaagtaagaccttcaagcaggaaggcaagccgaaccgcgtcaggccatctctttgaaacagaccgcgtgaggcaaggcaccgccgcagcgaacgctgcggcaccgattctcttctttccgattttttaaatcgcatagcgggaggccgcgattccaaccgaatcgcggcctcccgctttttcatacgcgcacatgcacccctgtcttgccggcaatgtccattatttgtgccacacaatcacgccaatacatcgctttccgtcaacttcgcacgaacttaacagcaacttaccagcgaacttaacagatgcgaagttgccgttaagttatgttaagttgtctggcaagttcggtggcgtatctaccgcacgccacctgcgcagcgcaaccgctacagttcctccatcgcaagattgcgggctgcggcgcgttcgcgggggccgcgcgtcacgtagaagccgatcgccacaattacgaacatcaccgtgcagcaggtccacagcacgtgactgccgaacgcgttcaaaatccagcctccgacaagcggcgaaaacgcgttggatagcgaccacaccaggttgtacaagccctgatacgtgccgcgtacatccttcggcgcgatattcgccaccgtcgtagcggcaatcgggaatgtgccaagctcgccgagcgtccacagcacggtcgcaatcgcgaacgtcacccacgaatcggcgccgatttggaacgcatagccaaccgcggtaatggacatgcccagcaccagcacacgggtgttgctcatccgctggaacagcgcgatcgcaggaatctgcagcaaacacagaatgcctccgttgatggtcagcaggctggaatattcgtccgtaccaagcccaatctgcgtcatcgaaatcggaagtccgctgacgatctggtaatacgccagcgtgtacaggaacatcagcaccaccatcgacatgagcgctttgtcggtgcaggcacgacgatagctgcgccaaatggagaatttcgattgctgcgattgagccgtttgcgcagtgccagaacgttccacaggttgttccacggaacgttccacggagcgtttcacagaccgtccgacaccgtgcacgcccagcccggcctctttgaagaatgccatcatcagcaacgtagcgaataccaacacagccgcttccgcatagaacatcagcgaataggagattttgacaagctggttggcgatgatcgggccgatagcgaagccgaaattcgcagcccatgtttgcagcgaatacgcacgcttctgcttgcgaaacggcaccacgtcggaaacgtaagccgcgaccgcaggcgtcggcatagatgaaatcgcaccgtatatcagcaacgtaatcgccataatccaaggattgccgatacaagccaacaaaaccagcatcaccgcggaaccgagattgccgataacaatcatcgcggggcgcccgaatcggtcagacagcgcaccaccgtacaggcagccgaaaataccgccgaaaccgtacatggagacgatggtgccggccacgcccgcgctcacatgcatgtcggagacgaggtacatggaaagaaacgacgtgacgaaacggcccatccacaggatgagcagcgtgacccacaagccccagaacatgacgggcaaaccgaaaatctctttgttcttctccattcttgccatcatatcgagcaatatcgagcagacgcgaagccgccgccttttcccggggtgctgggacaatggacaactatggcaatgaaaaaaggaccgaccaaggggtcgggcggaaagcatcgtaacgcgctgaagggcaaggggccgacccccaaggccgaagatcgcgtatatcacaaggcttacaaggcgaagaaggcggcggatcgccgcaagatggccgatccacgactggccgcacgccgtcgagcggcgaagttcacgtcggaatccgacgatctggtcatcggtcgtaacgcggtgcttgaggcgctgcgttgtggcgtgccggcaaccacgctgtatgtggcggcacgtatcgagcatgacgatcgcacgcgcgaaatcgtgcgtctcgccggcatccacggactgcatctgctggaagccgacaggcttgaaatggaccgtatcgcacgctcgtcgaaccatcagggcgtggtgctgaaagcccagccattccagtattcctcgctggcggaacttgtggatcgtgcggacaagaaggcgcgcgccatggaagcagccgattcggaaagcgcgcgcatcgcggcacgtccgctgttcatcgcgctcgacggcgtcaccgatccgcagaacctcggcgcggtcatccgttccgcggccgcattcggcgcgaacggcgtgattctgccggaacgtcgttccgcttcggtcaccgccgccgcatggaaggtgtccgcgggcgccgcagcgcatatgccggtggctcgcgtggtgaacctgaccaaggcgatcgaaagcctgaaggaacgcggctactacagcgtcggtcttgacggcggcggcgacgcgctcgtcggcgaaaccggcttcgaaaccgatccgctggtggttgtgctcggctcggaaggcaacggcctgagccgtctggtacgcgaggcgtgcgattcgatcgccggcattccgatgtcgaatatggtcgagtcgctgaacgcgtccgtcgcggccggcatcacgttgtatgccgtggcacgcgcccgtcgcgaggccgcagcagccaagtaatcgtttattacgatatttatgaaaaagctcaagccttatggcttgagctttttcatatgccattaacggctaatggctccacaccgcagcgtccggatcatcgtccgggttgtagccgtcctcgtcggtgccgtaagtgtattcgtcatcgatcacgccggaatcggcctcggcgttcagcgcgtcgacatccttcgaatcgagcttgtactgcggcagcacgttctccacatagctcttcacggcttcggtcatggacacgtcgtggccggccttctccgcaaggaaccaacgatggtcgagtacctcatggaagaactgcgccggctcgatctgggagcggtattcgcgcggaatcatgcgcacggtcggctcgaacacctcgcgcatccagtcggtggccacgatttcgagatcctcgccatcacgccacgtggaggtgcggtaggcgtccagatcgttgagcagacggcgggcctggttctcctgcacgtcaagaccggtcagtcgcagcagcttgcggttggcgtagccggcgtccaccacgcgcggacgcaccagcacgcgcttgccgtcctcggcggtcttcatttccagctcgtccacgtcgaagcccagttcgttgagcttattgacgcgcttttcgatcttccacatctcgtccgggctgaacttgtcggtgtcggtcagcgcgctccacagcgaatggtagcggtccaccaggcggtttccgatttcgatttcgtccacgttgctcggcagcaatgcgccggaagacagatccatcagttcgccgatgatgttcgtacgggccaaatccacatcgtattcacgctggccttcggtgaggttcacctgcagatcgccggtttcggcgtccaccaggaacgcggagaaagcgtcggcgtcacgcaggaacagcacgttagacagggacacatcgccccaatagaagccggccaggtgcagacgcaccatcagcacggcaagcgcgtcgatgagtcgttcggcggtgtcgggacgcaggttgcgggcgaacagcgcgcggtacggcagcgagaatttcagatgcttggtgaccaggatggcttccagcggctcaccttgcgcattatggcggccggtgaccacggcgatcggctgcacggtaggcagttccagcttctgcagtcggcgcagcagctcgtattcgcgttccgccacgttgcgtgtgatttccttcatggcgtagacttcgtcgcccacgtgcacgaaacgcaccacgtgcctggagatgcctcgcggcaggttgaccagcaggtcctcaggccatgttgccagcggcttctcccacggcagcgtgaacatcttcggattcgaactcgcggcggtgatcttcaacgcctgcggctccgggctctgcgctgcggggtcctcggccttcacggaagtggccttaagcacacggggatccatctgtggcaattcatgtgattccatagctcttcaatttacccgctgacctacccacggcaggcggcaaagggactacgagtgtcacgatgagaacagcgggaaaagaaaagccccgcaccaacgcggggcttttccaacgagacaataagagaggaaagagaatgtctcgtttaatggttgacggacgtttgcacatccgccaagtattggttcaaccacccgccaagcgttccataaggaacgcccgacggttggttactcgttatcgtctcagttcagacgcagctcggtggacggagcgaacaggtgcatcttggacgggtcgatcttgatcttgacggtatcgccgaccttcggaagagcacgcgggttcacgcggatcgtggtgagcttgttctgatcggacatcatggtggacgcctcagcagcggagccatcggtgatgatgttgccgtagatgtagccgtcggagcccagatcctcaacgttcatgaccttgagggagaaggcgttggcctcatccggggcagccaaggaggcgtcttccggacggaagccgaccacaatctggccgttgtcttcggcggtgagcttgttgacggcctcagtcggcagatccacggtgtcctcgccgatctttgccttgccgttgaccaccgggtgggtgttgatgttcatcgacggggagccgatgaagccagcgacgaagacgttggccggacgatcgtacagctcagtcggagcgccgacctgctgcagaatgccgagcttgatgacggcgatacgatcacccatggtcagagcctcggtctgatcgtgggtcacgtacagggtggtgacacccagctgacgctgcagagcggcgatctgggtacgggtctgcacacggagcttggcgtcgaggttggacagcggctcatccatgaggaagaccttcggctcacggacgattgcacggcccatagccacgcgctgacgctgaccgccagacagagccttcggcttacgatcgaggtactcggtcaggtcgaggatctcagcggccttctcgacgcgcttgcggatctcttccttcggggtgccggcgatcttcagggcgaagcccatgttgtcggcgacggtcatgtgcggatacagagcgtagttctggaacaccattgcgatgtcgcggtccttcggctgcatcgtggtgacgtccttgccaccgatgaggatgcgtcccttgttgacctcttcgaggcctgcgagcatacgcagggtcgtagacttaccgcaaccagacgggccgaccagcaccaggaattcgccatccttgatgtcgaggttcagatcatccacagacggcttgtcattgcccgggtagatacgagtaacatggtcgaatacgacttctgccatgatttgtcatcctttcagaggcaggtacgtgcctcacgatccgttgtaaagggatttttgttcggtgcccatcctcgcggcttactactttgacaaagccacaattcaaagcgtttacttattggttggtttagcgaagatctcttcgttgagccatgacctactatacacacccaaaccgaatcgtcaatgcgtgtcgcgggttttcaccgctcaaaacagtctattagggggttatcatcccctcaaatcgatggtttttcatcacaatatcctcattccgcgagagaatggacggtagtctgaacggtgagacgtggaggttcatcgtgcgcaatatccgaatcggagtcgtcgaggacgaccctgcaagctgccaattggtactcgattacctcaatcgctaccaaagcgagaccggcgagcaattcaccgtctccgtattcgacgacggcgcgcgcatcgtggagaaatatgcccccgtttacgacattctgctgctcgatattgaaatgaaggagatggacggcatggccgccgcccgccgcatccgcgaacgcgacgacaacgtcgtgatcatcttcatcaccgcggccccgcaatacgccatcagcggctacgaagtgcgcgccctgtcctacctgctcaaaccgctgccatggttcgcgttctcgcaggagctcaagaaatcgatcgacatggtgcgccgcaacggcgacgattccatgctcatcgaaaccggcaaggggcagatgaggatgaatctcacggacatcctttatctcgagtcgatccggcacaccatcgtcatccacacgcttgacggcaaatactctatcaacggcacactcaaagacatggaagccaagctcgccgaccggcacttcttccgctcgaactcctgctatctggtcaatctcaagcatgtgacgggcgttgccgaccaggattgcatcatgtccgacgacgagcggctgcgcgtgagcagaccacggaagaaagcgttcctcgccgccttggccgactacatgggcggcggccgatgatcaccaacgcgctgcccgacatcccccgttcgtacaccgccatctgcgaatgggcggcatgcgtggtgtatatcgcggtactgttccgccgcgtgccgccgcgccgctccgtcgttgtgagcgcaatcggactggcggcgctcatcgccgtgcagtatttcgacggcagtatgccgatctggttttggatcgtcggcatgctgctcgccttcggctgcatgtacctgacgattctgttcggtgccggcaccggcaagcgcgaagggctgtacatcacggcacgcgcgttcgtgctggcggaactggtggcgtcgctgcattggcagatcgtcgcgttcatcggcacacatgacgctcaagccacttcatacggtgtgcaggccatcgtcatgctcatcgtcatctacgcgctgtgtttcggcctggcatggctggtggaacgcggcaatttcagccaaaccacacccacgctaccgaccgcctccgcggcaaccgcgacggtggccatcaccatcgtcaccttcgccatgagcaatctgagcttcgtttcgaccaatacgccattctccggttcgatgggccaggaaatcttctatatccgcacactggtggatttctgcggattcgcgattctatacgcgcaacaggagcaggctcggcgcattgaagcgagcgcggaaatcgcgtcaatcaacgcgcagctggaaagccagcatcaggagtacctgcagtcgaaggagaacatcgaatcgcttggtcggcttgcgcacgatctgaagcatcagatcgcggcattgcgtgccgaagtcgatcctgagcatgcggcggcaggattcgagcagttggagaagtcggtgcagcgctacagcgcccagcagcataccggcaatcccgtgcttgacgtcatcctcaccacaaaagagcgcacttgcgccgatcgcggcatcagcttcaccgccgtggcggatgggtcgctcttgtccaacatgtcgtcgatggatatcgcttcgctgttcggcaatgcgatcgacaatgcgatcgaagccacgtcgaagctggccgatccggaacagcggctcatcaaactagcgttgttcgagcagaattccttcaccgtggtccgcatcgagaattattacgattcgcggctgaagaaagatgccgagggcaatctgcgcaccacgaagcgcgatgaccagcatcggcatggcttcggcgtgaagtcgattcagcacatcgcgcaacagtacggcggcgaggtgacgatccgcaccgacgaccactggttcgtactcaccgtgctgcttccccgccagacaggcctgatggccatgtgaggatggcgtccatgtgaggattgcgagccggcaatgcgaaggctaacgatctgcagctttcgcccgcggtagatgccaagcggcaagcggcttggccagacgggaggcggtgaacgcgctgacggccaccgcaaggccgattggcacgaacaggttgatcggagcgtcggccaactccatcaccaggcaaatcgccatcaacggcgcctgctgcgaggcggcaagcagcgcgcatgcacccagcagcgcatacatgccgatcgaattcgtgtggaacacctgcatccaaagaatgcccagaatcgcgcctccggaagcgcccaatgcgatgcccggctgcaacacgccaccggaagcgccggaacgaatcgtcagcaaggtgacaatcgccttcgccacgaaactcaacagcagaatcggcagcacggccaaatcggccttcgaggagaaactcagctgcgcggtggcgcggccattgcccatcacctgcggcacgacaatcgccacaacgcccgtcagcaggccggcgagcggcatcatccacagaatgcccgctccggatggcttgtttttctccgcccactgggagccgcggcggaacagcgcgccggcggcgccaagcatcagtccggcaaccagtgcgaacaccatgtagtcgggggtaaacaggccgtccgcctcgccaatcaaatagaacgtgtgcgtgcccttgaccaggctcgccacccatgaggcgagcgccgagcaggcgaacgcgagtgagaccgtttcgagcgtcacgtcggcgagcaggatctccaccgcgaagaacgtgcccgcaagcggcgcgttgtagacgcccgcgagaccggccgcggcggtaatggccaccagcatacgcgtgtctttcacgtcgagacgcacccagcgggcgaatcgttggccgaacatcgcgccaagctcgcgcggagccacctcgcggccgatcgacatgccggtaccgacgataaaaatctgcagcagcacatgtacgatggtctgccagaccggcatcagcgcaccaccgacggctttcttgacggatggcactgttgtggtacgcgtgcgcagcagccaccagatcacggccgcgatggcggcaccgaccgtcacggaaatcgcacgacggatggcaggcacgttgaacgggccggattcatgcgcgttctcgatgtatccaagcgcgaaacgttcgacctggtacagcatgagcgtcagcaaacctgcggccgcgccgatcgcgatgccgacgacggccaccgccgcgatcagcgccgggatacggccgatgttcggccgctgttccgtctcgtcctgcgattgcttcgacaccattgcctctcccacgttgcatgcacctcgtcttcagtccatctcgtcattcgtgttgccgcatcaccatcgttccatccacggcggatttatgcgccgatatccttcagcatgaatcgcagtatcggtcacacaacttgcgtctgcatagtgaacggccgatcaggctcgtcgtcctcggcaacaaggccggccacatccgccaaacaccataaggcgtacagcggcagattcatcggcggcaaatatattggaatatatagcattcaagacacaagatgcacaaaatagacaatttcaaaggcttgtttttgcacaaaacagacgatttctgccacagccaaaagcaaggaaccggacctccaccatacctttcaccacccactgccagtaccgccgtggtgcccggcgaggcattcggcgaggaagggcagggattcgtgcgattgtcgtacgccggcgatgcggatgagttgcgtaagggactgcgtcgtatgtgcgattttgcggagaggaatcgctgacgccgtcaggtgcatgcccgtccttcgtcgcgttcacccactttgttgtgtatgtttacgatttgtataatcgtaaacatacacaacaaaatcatacgatgaaacggcggcacgttggacgggggatggactcctagctattcgaatgactagccgtgcacaatagcgcgtgaagtcggagcccatgacaacatctacactgtcatgagcgcataggcaatccgccgttcgacgtactgacgaaatagttgggatacttgtctgaatcgtaggttgcacatatgtgcaactcctagactgttcgcgctagatacaggcatacagtattcgtatcatacgcaaccaaggtggtgacatatgctcagcgaaccggtgaaagcattatttgagtccaacaccaacgcccgtcatgccggcgacgcagacagactcgccaaagagcataagccgaacggagtgcatgtactgacggatctcccatatggcattccggaccaactgcgcaaattggacctgtatcgtccggaaacacaacatgaacctcttccggtcatcatcgacttccatggcgggggtctctaccatggcgacaaacaaaataccatgtgtcgcgatatgtatttagcgaagtatgggttcgccgtggtcaatgccaactatcggctggtcccgcaaattggattccaaggccaactacacgatgcgcttgacgcaattatctggacgaatgagcacgcgcatgactatggcatggatacgaatgctctgtttctgattggagattccgcggccaccctgcttatcttgtacctcaccgccgtactccattcaccggtcgtcgcgtcacagcttggcatgaaggaagcctgcggaaccgcccgcatcctcgccattgcaggatgcagcggcatgtatcgcttcgagggaggcgtgcatggaactgcaatgggatactatgcggaaggctactttccaacgctgaaggaacgaattcgcatctccccctatcttgatgtcgatcgccttgtagttgatggcaatcttccgcccttctatctgcagaccagcaccgaggattatctcgcggacaacactctggaattcgcaagaatcctgcaataccgccatcatgattatgaactgcgattactcccgaaaggtcttgaccacgctctcgtacacgacttcgcagtcaaggaggtcggcctggagcataatgaggaatcacagcaaatcgtaaaagaggcggcgacgttcttcaaacggtaccgcccaacgaccagctaggaaaggacgctatggaagaacggattcgctccacccgctcctcactggcagtattcgtaggctgctgcgccatgtccttcatcggcttcgctctcatcaccaacacttcagggctgtatttcgacgccatcagccgtgatttacatgtgggtcgagccaaggtcagcctaaccgtatcgattcgattgatttgcagtgccatctccatggccgcgttcagtcgcttttcacatcgcattcgcttgcgccccacacttatcggctgcattggtatctgcgccgtgggattcctgctttgcagtcgggcgtatgccctctggcagttctatctcgcattcgctgtgatgggactcgcctatgttattccgataacgctgatgccacccattctgcttgcggcatggtttcccactcatttcggcacggtccttggcataaccggctgtttgtcaggattgggaggagccatattcaatcctctgatttcgcacgtcatcgcgtcatatggatggcgatcggcatatctactgaccggtgcgatgctgatggtgctgctactcccctgctcctacctgcttaaaccatatccacatggcaagctcgacactgcgtctgccccaaacgccaaacctgcgcatgatacacggacgaaaagcgggcatctcatcggcatgcttcgttcaccggcgtttctgctgctgtcagccgccatgattttgttgcaaatcgtatccggcatcaatcagcatattcccgcgtacgggatttccatcggactcacgcttacacaggccgcttgggtggtcacggcccgcatgattggagccagcgtcggcaaacttgccataggttcgacgctggaccgtgtcagaccgcaattcgcaatcacgctgtttgccgccatcggaaccacaggatggttcagtctgcttttcggagccaatatggaagttgcgatcactgcaagttttctggcgggaatcggccaatgcctgctcatgattgcacttccctggagcatacgccgcgtattcccgggagatgattatgcccgcgcgctgtccgtcatcaacgccaccggccagctgaccgtagccatcgctaccacagttcatggattgattttcgacatgaccggcggatatggagcgtcattgacgctcaacgtgctgttgtacgtgctggcagcaattgcaatcatcacggtggcgcacgggcatacccaatccttccagcatcctaacggtgattagtccatatccaataacaactcagccattccctgattggtagcgagtgccgacatcagtccaccgaccaagcatgcgtgcagtgcccgcgcacgccacgtctcccaagcgactccaatgaccaatggaatgtcacgaaaccgttcgaaatcgatgctgatggtgcgctcacacagactggttcgcacatgattgccatgcatatcgatatgatgtccgcaaatatgcccgaccactcccttttcctgcaactcccgtgctactgcagcgtcttcgaacgaatggaaaatcctcccagaatgcccctgccgaatcgctcctacaccgacaatggcgatatcggctcggttacccaaagccaaagtcatggcaatcagtttctccgaacgcacagcctgcgcaacttccgcggatcccataatcaacggtgcaggaagcaacgagtaagcgcatcccagacgttctgccatcattcggcagatttccggagaatcagtcaacgagttggcggaagacaacgaacccagcatctgagtcacatgcgcacgagggtagtcaaggggaggcaaagctctgattgtcgccgccatcggcgtcccggtcgatgtaacgatcaacgaatccggtttgaggttttccaccagcagctgcgccgcacattgaggcactagcgtcgatgcgatgctgtcatcgtatgaatatgtgacgcgtaccgttttcaacccgtatttgttccgaagattctcctcaagggattgcaatcgttgcaatgggtgcccgatggtaatctgtacgattccggtttcccgtgcttcggtgagcatgcgtgacaccgatgaccgcgaatagccgacctctccggcaatctgcgattgattgagtccctcgtcataatacatctgtgatacacgaatcagcttttcgatatgctgtctggtctgcatcgacgaaagcgcggaatctttgaacatatgtgcatgttatctccagtgtccatacgaacacgcgcgataagcatacgttttaagcccatcatcaaccgatactccggtaaaccagcagtgtggcgatgcacatattctcattcacatcccaatgtcatttcatcctcaaattagtctataaccggctccaggaagaaccgggccccgcgttaccgaaggatgatcttcgggtgacgcggaaggaacagagggagaaaaataccatgtcgaaagtatggcaatacttgaagcagcatgcgtatggcgcactcaccatcgttacggtgttgttgtgcattctgggcagctgcatcgcgaatctggcacagacggatttcggcaacgtcaccaaagagaatctgaccatcgaaacatcatccggacataggctcggcatcaacatgctcaagcccaagaccgccaccaacgacaagccggcacccaccatcgtgttcgcacatggcggcaacggtctcaaggaaaagtgggatctataccagatcgaatgggcacgtcgaggcttcgtcgtgttctccttcgatctttacggacacggcgactccgagattctgaacaacaccgaatggctggtcaacggccgtggcctgtatgacacggtaaagtacgcgaccacacttccattcgtggacaaggaccagatcgccgtatccggccagtcccgcggaggcaacaccattcacgagacgatccttcttgacaacaaggccaagaagcagctgatcaaggccgtgctgtacgtcagccgcgacgccgtctacaaagacaacgaaactcagtcgttcggctatgtgccaggcaagaccacttcagcccaggccgcctccaagaataacggcgagtactttaattattacggcaatcgcaatgtaggcatcatcgccggcaaattcgaccagtactccttcaaggagaccgacaagacgaccggcaagatgctgccgaatccggactatctcaagcacaataacgccaaatcgttcctgaacttcggcatcacgcctgactcttcgactgcggacggcgtcagcggcaagtactatacgaagaaggtcgatggcaaggaagcattccgtgtcatctatctggaaaacggcttccacacttcgcagctcttccagtcgtcttctaccgcagctgccatggagttcatggtcaaagccttcaatatgaacacctcgttgcagtcgggcgaccagatctaccagtggcgtatgatcggcagcaccatcggtttcatcggcatgttcatgttcgccgtgttcttcgctctgtggctctcccagatgccgctcttcaggggaacttctcgtggcaatgccgtcatgcgtatcgcggaatcgcatccgggaaccaaggcttgggcatggggctgccttatcgtcaacaccctgttcgccaccgtcagcacgttgttcctgtactacaacggcgtcgacacccatatcggcacattcttcaggcaggggcaggcactgttcgcaggctccatgctggcgatttcctctgtgttcaccgccattgtcacctacatctggtaccgctgcttcgctaagaagaatggtatgaacatcgatgaaatcgatttgaagacatctgctttcagcgtgttcaagaccatcatgctggctctcaccgtcaccggcggcactctgctgttggtctggggagcgcagtacttcttcaagacgaacttctcgttcctgtactggggcatcatgccattcggctccttcaagatcgtggacatgcttaaggtactcccgatcttcctgattggctacgtgatttcctccatcttcatcaactgcatgaactacaacacttcctatggcaagaacaagatcgtgaacatcctggtactcgctctcgtcaccgccgccgtgccggcactggtgtccggcgcaggctgggccaagttcatgctcaccggtgtcaatgacctgttcggtgcggcctacacccgcattccggacagcatgttcctcaccgtattcctgctgtttatcactccgctgacggctcgcggcatctattccaagacccgcaatccgtacctcggtggcatcatcaacgcgattttggccatggtaatcacctgcgtgaattgccaggtcgttttcccggcctgatcgctagatagcacggcatgacaaagggtggtggctcatcgactgagtcaccacccttcttatttgcaaggtacgttacgccttccaacgacatcagacgcgaagcaggcatggaaaacccgcccggaaaatccgggcgggcaggaagaaaggaattcagaatagggctacttggcggcctcctcgctcttggccgtctccttggacccgctcttcggcatgacccagaacttaagcagcggatagctgacgatcacggcgagcaaggtgttgaccacggatgcgatcgtgcctgcgatgccggcgttcatgccccatccctggcacagaccggtcacgtagcccggcagcacaaggttcactaccacgatgatcacggcgaggatcacatacttccaagcggcgtccttgaagctggagtcggacttgaagacccacttcatctgcacgaagaagttcaccacctgcgcaagcacctcggcaagcaggaaggtgaggaatccgcccaggccgttgcccttggtgtcatagttgaagatcaggaagtggaacggctgcgtgagccccaggccggagatgaaaatggcggtgccgatccacgtcaccacgaaacgggtaatggtggagatgttcgacagcacattgaacaggatgaattcccagatattgggatgatccttgatccactggcgaatcggtccggccttcttatcgccggcagcggtttcggccggcttcgcagcattgttctcagtcatggttcagctcctttgcggtgcgcttgttggcggattggttgcggaagaagccggcgatcacgccgcccaatccgcggaaggtatgcccgttggcgatgttcacgatggcgtcgaccatcgccgagtcgaccatgccttgggtcatcttgctcatggcgcgaggcggcatgttcaggatgaacagggtgttcagatccggcgaaccggtcttctggcgaatcttcgcttcgcgcttggtcagcgtcctggcaacagtgcgcgccgcgaatcccttggaatccacccacgacatgatcggatcgttgacaccgaacgtcgtcggtttgccgggagcaagcacctcatggccgaacagcacggccatttcggcatcggtcacgtccttgacctgtccggtcagatagtggccgagcgcggggtctgcggcgcattcagcgggcgtgcaatcgccggccacggtgtgaggaatcgcaagcggcagatgctccgcattgtcgccgatcatcagcgtccattcgccgctttccgtcttccatgcattggcggcaacatcgaaatggcggaacgtgtagcggtcgaaatcgatgtgcacgctcttgctttcatgcgctgccagctcgaccttgatgaagcccttcagctcacggtcgggatggagcacgccaccctgcggcgcacgcacatacaactgggccacggtggagccggcgacatcggaatcattggtgacgacgaaatccacaccggtcgcggtggcggtgatcgcgctgtacgtgaacgtggagtagctcagtccgtagccgaacgggaagcgtacgggcacgcccacggtctcgtaataacggtagccgacgaacaggccctcgcgatagatcgcgtcacgcccgatggccggataccagccggagctcgggcaatcctcgtattgcatcggccaggtttcggccaaatgtccggatgggttgacttcgccggtcagcgcgcgcacggtggcggaggcgccggcctggccggacaatcctacgtacagcatggcggcaacatcgttgaaccacggcaattccaccggggaaccggcgacgagcacgatcaccaccggtttgccggtcttcgccaacgccgttacgagatcgttctgcgcctgcggaatcgccatggtggagcggtcgaggccttcggattcgctgcgttcgtcgaggccaacgacggccaacaccacatccacggcgtccttcttggcgagcgcgacggcgtcgttcagcagcacctcatccggcttgccttggcggtcgtaaccctgctcgtagccggccagcacgagcccttcggtgtgcttgacctcgtcgaggatgttttcctccttggtggcgctcaccttggacgagccggagccctggtagcgcgcggtcgctgccatgtcgccgatgacggccacgcgggtgccctgcttgagcggcagcgtggcagcgtcgttcttcaacagcacgctggaatgttcggcgaccgttctggcgatattgtggtgcgctttcgcgatgtcgtccttgagcaggtcgttgcgtccgacgccgacgagtttggtcgcggcggcgattttggcgacttcggcggcgcgcttgttgatgtccgcttcggacagcgttcccgccttgaccgcgccttccagctcgcgcacggaagtgaagcccggcgacggcatttccagcgagccgccggccttgacggcggcgacggcggagttggagccgccccaatcggagacgaccatgccgtcgaagccccattcgtcgcgcaggatctcctgcagcagatgcttgttttcgtgggcgtagacgccgttgacctcgttgtaggaggtcatgatgctcatcggcttggcctcgcgcacggcgatttcaaaaccggtcagatacaattcgcgcatggtacgttcgtccaccacggagttgctggcctggcggcgcagctcctggctgttgaccgcgaaatgcttcgggcatgcggagacgccgttgctctggatgccgcgaatgaggccggcggccatacggccggcgacgatcggatcttccgaatagtactcgaagttgcgtccgcacagcgggttgcgtttgatgttcatgcccggtccaagcaacacgttcacgtcgagatcgtgagcttccttgccgagcgcctcgcccatctcttcggcgagcgccggatcccaggtgttggccacggtgcaggcggtcgggaagcaggtggccggcttggatgcgccgatgccgaggtggtcgccctcgccaagctgcctgcgcacgccgtgtgggccgtcgctcatgacgaagccgggaatgtcggcgcgatcgttgccgcgcgaatcccattcggatccgccggacagcatcgccgccttttcaacgatcgaaagatcttcaagttccatgggttctccctcgcactaggtgttgccaaaacctgctttgccgagcctgccctgtccgctccgcccggctgcgctgttttcttgcgatttcccgctgccgtaccgcgctgcatcgcaccgtgccgcacgcgggatttcgccgctagtttgattgaaccagcttttgcgatgccgtcaccgccgtattacacaacctgtcgttttactcgcacaatcggcatatgggcgcggtgaagagggtatgcggtggcgcagaacgcgcataaaatcgcatcgttccattttgcaatcgatggcaagcgtttcgatatgcgcatatcgttgcaatttcaagcgactcgccgatattgatacctttttgcgcaagcgctatcatacttaacgaaagtaagttttgctaacttttcttcaatgcggaaacatgctttgatcactcaacgcggagagcgatgtttcgcagcgcacagaaaggataatgagatgcgcgaccagcaaagcagcgacacgagcatcgccctggacgccaatacggacgtccagcatcgtcacgatgacccacaactacaatctcgtgttccccaccgccatcgtcatcgcactgtgcgctggcgcgtcggtcttgaccatcaagcgcatcaagtaattcaaacgggaccgtgccgccgcatatgatggcacggttccaatccagttatcccgattttttccacactcaaaggagccccacatggtagacagcacactgttctcgctggccacgctcaacgcccatccggcaatgaatccggattcagtgatccagggcgatcattggcgcatcggcctcatcacggacgcgctcgtccgtttcgaatggtccgacagcggccgtttcgtggatgacgccacgcagatggcgatggtccgtgatttcggcgaaaagcctgaattcaccgtcgccgaacgtaatggctggctggagatcgacaccccgtcgctgcatatctcctacaaccagcgcaagttctctccggaaggcctgtacgcaaccgtcaagcacgtcaacgccatcgaaaacacttggcattacggcgacgtgcagcgcaggaacctcggcggcacctaccgtacgctcgacgaggcgaacggccgcatccccgtcgatccgggcgtcaacagcaccgacggttgggcgatcatcgacgattccaagtcgaacgtcatccgcgaaaccgccgaagtgaacggcaaccacaacgatttcggcacgtgggtgaccccgaaggaagagccgaccaccgacctgtacctgttcggctacggccaccgctaccgtgaggccgtgcacgccctgtaccgcctgaccggcccgaccccgctgctgccgcgcttcgtgctgggcaactggtggagccgctaccaccgctataccgaaaccgagtaccgtcagctcgtcgaacgtttcgaaaaggaaggcatcccgttcaccacggccgtcatcgatatggactggcacctggttgacgacgtcgacccgaagtacggctccggctggaccggctacacgtggaacaaggacttcttcccggatccgaagcgctttctcaactggctgcacgagcatggcatgaaggccacgctcaacgtccacccgagggacggcgtgcgcgcgttcgaagagctgtatccgcaggtcgccaaggccatgaacatcgatccggaaagcggcgaggccgtgcagttcgacctgaccgatccgaagttcatggaggtctacttcgaccagctccaccacccgatggaggaagatggcgtcgacttctggtggattgactggcagcagggcggcctgacgcggcagccgggcctcgacccgctgtggggcctgaaccacctgcattacctcgattccgcccgcaacgacggcagcgactacagcgaacgcaacccgcgcccgctcaccttctcgcgttacgccggcccgggctcgcaccgctacccgatcggcttctccggcgacaccgtcgtgacgtgggagtcgctgaagttccagccggaattcaccgcctgcgcttccaacatcggctacggctggtggagccacgacatcggcggccacatgttcggctaccgtgacgaggagctggaggtccgctggtaccagctgggcgcgttcagcccgatcaaccgtctgcattccaccgattcgccgttcaacggcaaggagccgtggaacttccacggcgatgcggaacgtgcgatgacgtccgcgctgcgcctgcgccatgcgatgatcccgtacctgtacacgatgaaccgtcgcgccgcattcgacaacgagccgctcgtgcagccgctgtactgggactatccggaaatcgaagccgcatacaagctcaccgacgaattccgtttcggcaccgagctgctggtcgcgccgatcgtcgatccagccgagcgttccgtgcagcgtgcgaaggccgacgtgtggctgccgcagggcgaatggttcgatttcttcgacggtcgccattacacgtctcgtccggccgaaggccgccgtctggaggcttggcgcgatctcgaccgcatgccggtgttcgctaagcccggcgcaatcgtgccgctgcagatgcccgccgagggcgaggcgctcaactccgtggccaacccgcgcgcactgcaggtagtggtgttcccgggtgccgaaaacagcttcacgctgtgggaggatgacggcgcagcacagagcaaggatcgttgggcatccaccgaaatggcgctgcgttttgagggcgattccgcacagttctcgatcgcccctgcggaaggtgcgacggacgtcattccggcttcccgcgattggacggtcacgttccgtggcatcgctccggaagcgatgcacgccgtccgcgcgaccgtcgacggctctgccgccgctccggaagtcgcgtacgatgcggaaacgctgagcctgaccgtcacgctgcgtgacgtgccgacgagcgccgcaatcgccatcgatttcgccgacggtcttgccgttgcggacgatccggttgaagccgacgcgttcgccgtgatgaaggatgcgcagatgctgtacatgaccaaggagcacgcataccgcgcgatccgcgagctgggcaaggatgcgctgccggcactgagcacgctggaggatctgcacggcgttggcgcgcagaccaaataccagtcccacatgccgcagccggtcatccaggccctggccgaagtgctgacccgcaactgacctcatcgcaataattcaaaataaaacgcgtgtgcgtccggatggtttccgcccggacgcacacgcgttttgttttatgtacgaaattagtatgactcgacattccgcatagattggattggctacaatgtattagacattccgatgagggacgaatggcatgggattggaggccgacgatggccggcccgaaacatccccgccactacgacgaggcgttcaaacggcagatcgtgcagtcgtgcgagagcggcaagccatcccgggagatcagggccgggtacgacatcgcgcgatcgaccccgcggcgctgggttcggggcatccgcgacagcggctccacccgggccgcggacaaccgcacgcccgggcggaacgagccggtcgagccggggaggcgcaacaggcggttggagatggaggtggacgtttcagaacaagcggcgccggtattcgcacgaaggcaggcgtgatacgggccaacgcctcccgctacccgatatcggcgcgatgcgggataccgggcgttccccgctccacctgctactggatgaccgggcatcccgggacggagcgtgcggatccgatcgccggcgacgtgcgcgcggtccggcgcgacggccgcgaacgccacggcgccaggaagatcaaggccgtcctggaaaggaagggcgtcaccgcgtccaggagacgcatcggcaacatcatgtgcgaacagggcatgacgggcgcatacgcgcgcggacggtccgaaccgcacaggacgcgggccgacgaggccgggctcgcgaacctgccggaccgcgggtccgacggctacgccccgcacacgcatccggcgggcgatcttacctatgtccgcgtcggcggagaccgggcgtacgtgtgtccgctggccggcctggcggacaggggcatcgccggccattccgtcggacggagccgggacgcgggcctggtgctgggcgcgttcgccaccctcgacttcccgccggcggacgtccaggaaacaggggtttgccggccggaagggtccacaggcccctcttcccgtattctgacgttaggagacaacagcatgcaggcggatcgtgtgagagagacggaacgaatcaacgacgcgttcctcgaggaggtcgtgccattcgcggtgcacggcgccacaatcgtcgacgcgcgtggaatgacgaaaaacggttggctcgtttccgacggacggtcgatagtcgaaacgggatgcgccgaaacggacttcgaaacggcctgccggctgatccacgtcgagcaagatcatattgttaacgctaacggaatggtgatgacgcccggatacgtcgacatccactcgcacggcgcatggggaagctcgttcgatgacggcgagaaggggatcacgaccgcccgagccggacacatggcgcacggaacgacgagacaggtcctgagcctcatcaccaatcccatcgacgtcatctgcggtaacttgaagacggtccacgacatgatgccggaccgcccggatattctgggcgcgcacctcgaaggaccgttcctcgccatgtcccggaaaggcgcccatgatcccaattgcctagtcgatcccactccggatctcgtatccagaatgctggacgccgccgatgggtgtctcagacagatcaccatcgcgccggaacttccgcatggaatcgacgcaatccgccgtttcttcctggccggagtggttccggcggtcggccactgcgatgccgactaccagactgccagaaaaggattcgacgccggagccggaatcatgacccatatgttcaatgccatgaacgggctgcaccaccgcgaccccggcccgattccggcggcagtggaggatccgagggtcaccatcgagcttatcaacgacggattccacgtgcaggatcccatggtcaagctcggattcgggcttgcgccccatagaatcgccttcgtcaccgacgccatggccgcgaccgactgtccggacgggcattacctcctcggggctctggatgtagatgtgcgggacggtcatgccagactcgcctccaatggagccatcgccggttctacactgctattggaaaaggccgtgtctcgcgcggtgctggagctcggcatcagtccggtcgacgcggtggaagcggcgacgctgacccctgcgcgggcatttggcttcgaccgtcgaaatgacgtgacaggcttcccgatcggtctgctcgctccgggattcgcggccgacgtgctgctccttgatcaggaaacctggacggtgcgacgcgtctggtgcaacgggcatccggtgagataattgatttcaaggttcaatgacgaacgaaaggaacaatgacaatgaaccaacgtagagaacatcgttggcctcggccgttggagggccggcgggcccgtatctggtacggcggcgactacaatcccgaccagtggcccgaggaggtctgggacgaggacgtgcgcctcatggtcaaggcgggagtgaacctcgtatccgtgggcatcttctcctgggcgaaaatcgaaccccgcgaggacgtgtacgatttcggctggctcgaccgaatcatcgacaatctcggcaaggccggcatcgccgtagatctcgcttccgcgaccgcatccccgccgatgtggctgacccaggcgcatcccgaggtgctgtggaaggactaccgcggtgacgtgtgccagccgggcgcgcgccagcactggcgtcccaccagtcctgtgttctgtgagtacgcattgaagctctgccgggcgatggcggagcattacaaggacaatccctatgtggtcgcttggcacgttggtaacgagtacggatgccacaaccgcttcgactattccgaggacgccgaacgcgcgttccaagactggtgcgaggaacggtacggcacgatcgaagcggtgaacgacgcatggggtactgcgttctgggcccagcatctgaacgatttcagcgaaatcgttccgcctcgattcatcggcgacggcaatttcatgaaccccggcaagctgctcgacttcaaacgcttcagctccgacgcgctgaagtcattctatgtggccgaacgtgacgcattggccgaaatcacaccagaaaagccgttgaccacgaatttcatggtctccgccggcggttccgtactggattacgacgattggggcggcgaggtcgatttcgtgtcgaacgaccattacttcattccgggcgaggcgcatctggacgagctcgcgttctcggcttcgttggtggacggcatctcccgcaaggatccgtggttcctgatggagcattccacctcggccgtgaactggagaccgatcaactatcgcaaggaacccggccagctggtgcgcgattccttggcgcacgtggccatgggagccgatgccgtgtgctacttccagtggcgccaatccaggtccggcgcggagaagttccattccgcgatgctgccgcatgcgggggaggattcccagacgttccgggacgtgtgcgaactgggccgtgatctgggcacgcttgcggatgagggactgctcggcaccaagctggcgaaatccagcgtggccatcgtgttcgattacgagtccgaatgggcgagcgagcacaccgcgaccccgacgcagaacgtccatcatgtcgacgagccgctcgcatggttccgcgctctggcggacgtcggcgtgaccgcggacgtcgttccaatccgttcgaactgggacgagtacgatgtcgcgatactgccgagcgtgtacatcctctccgaggagaacacccgtagggtgagggactacgtcgcgaacggcggcaagctcatcgccacgtactatacaggcatcagcgacgaacgggaccatgtgtggctcggcggttacccaggttccatccgggacgtcgtcggtgtgaggattgaggagttcgcccctatgggatccgattggcccggagttccggaccacctcgatctcgacaacggagccgtcgcacacgacatcgtcgacgtgatcggctcaatcgggaaggacgcgaaggtgctcgcctcgttcaaggatgacccatggaccggcatggacggacgcccggccatcgtgtccaatccatatggcgaagggcgtagcgtctacgtcggagcccggctgggacgtgacggcatcgccagaagcctgccgatgatcctcgagacccttggtgtggaagtcaaagactcctcggatccggacttgcttcgcatcgagcgcgtcgatgagtcgacgggggctcggttcacgttcctgttcaaccggaccaaagaacctgtcagcatgctggtggagggacgcccggtcgtcatgtcactggccgactgtgctggcgcgacggttaccatcaatcccaatggcgtactcgtcgtcaaacaataatggctcattaatgaggcgatatgccatgtgaacgttcacatggcatatcgcctttcttacgacagatggcatcgtcgtttttgatgatatgttcacaatatgttgtgttatatcgtatgacaacacttaagttaagtcaggcatgtcttttgccctaccagcttctctgcgtgtggcattctcctcgcctctacagacgtggagaatgccacaaaaggataatatccagtagaccgctaacgataaatatggccgagctgttcttcgttgtcgaataacggttgtgattgttgcttaatgttcggctgtgggattggcggttcgtgctctatggcttttttcttgcgtggctttggttgtttgtcatcatcataacgatcatcactccccagcacgttcgcttctcgtcaatgtatttgtatgcgattgcatggaatttagatgggattccatcgatagtgatagtgcgagaccttttttttggcggttgcctttgccttgatttggccaatgttgccgactgggacgatccaccacgtattatgcatttcggatttcgatttgatgaggcgtgtcattctttcaagattttttaggcgaggattccccgcctaaaaaatcttgaaatcgcaggagatctgcatgtaggtgccaggaaaacgctcatcctcgcgcagatgctatgcgaacagctgattcccacgttcataggactcgtcatggcatattcggcactgttcattctcatcggcacgatgaatccaaccccgtccgactcacttgccattttcctcctggagctgcatgacggtctgccgttgccgtgcgccacggccatgggaacggcgatcgcagtcatactgattcgtgaaaaagacctgttccgcttgttcaagaccagatgaatcggacatataccggtggaacgaatcaccattggaggatcaagttcgtgtgatgtcgtagaccataagtcatcagttaagcgttgtgtgacaattccatacaacgctttcttcatcgccgtacaccctttatggcgaagtcgaaggatagccacgggaagacgaggacacgtgaaccggtccgcataagcaaagcccagaggcaaagcatccgcccatctgtcccatcgaaaccggctagtttgattctgtcgtgtccgccgacgaatcatcggcgcaatgcgcatcgaaacatatcccgtcaggaccttctgccgtgagggacacgaaggtctgacgggatatgccggatccgttaaggttggatccgacggagcaatcgctggcgttcattccggtcgcttcatccgggatacgcctggcgtcctccatcttgcgatgcaccattcgatgcgttttggctccaatcaggaacgaatcgagatctgccctacagacaatttccgtggattgactccacctaatgtgacgacgcacgcgttcgacttcgaaccgatgggaaacgtgcgatgcggacatcgcgcactttcccgatctcgtccggaacccgaaggcgcacagctttcttaagtgaaaatcgctcctgaaatggagccaaaggagttcccctttaaactgccttgaccattatctctcttttgattgtttgtaaaactcgtattgtggaagtggcgaaggccatgcttccttgcccgtctccattgcgggagaagatataagatcccgataaggtccttttatagacaaaaaccggttctttcgtcaatcccgaagcgcatccattggaatgccgttgtaggccaagtcaaaacgccggggttgaaaagaaaaaaggtgccgcaccattattcccacgaaatctggtgcggcaccttttcttttgaaaggaaacagaagaagtctttgcgccttacttgttgatgaccttcttgaacaggtcggaggatgccttggcgagggcgaactggccgaagcccggatccatggaggcgaggttggagttgaggatctggttgaaagtgtcgttctgcatgttcattccttttccgcggcgctttgtcttccgttcgccgctattcttttttctcttgtttcgttatgccttgattgcaggcatgtcatccccgtcgccgcatgtcattccgattgattcttttgtatattcatcggtttgccagaagatttttgaaataacttaccgcaccattaccatcacataaaccaagaaggccccgacatggtcggggccttcttggtgaaaaagggaaggagtggcaagtattggtatttattcggtcagggttttggcctcctcatcgatggcctcgacggtctcggcggtctgagcttcgtcatcgacgatttcgccggaggcaagcttggcttcgagctctttgacaatcttagcatgcatcttctcgtcgatcttgaccttgaacatgaacaccagcaggctgagcacgatcagaataagcggcacatagaaggcgcagatttcgaaggtgtggatgttggagggggtcatatcggctgcggtggcgttgccggtcatgccagcagcgacggcgatgaagccggtgatgccgttggacagcgcgccgccaatcttatcaagcatcggacgtacggacagggtgacggcctcgttgcgcttgccgttcttcagctggccgtattcgatggagtcggtcagggagaggatggcggtcatctggatgagggtgcccgggatgtagaagagcacgagggcgatgaacaccacggtcatgttggtggagaagagacccagcaggatgtaggccacgatcatggaggtcatgccgacgatgtacaggactcggcgtgggatgcgcttgttcaggatcgggtacagcggagccatgatgaggcctgccaccaaggcgatgacgccggtcatggagtaggcggcctggttgtcgagcacgaacttgaacaggaagaggagtacgccggtggtggccacgttggcgatggcgtacagcaggtaggacagggcgacccacaggagctggtcgttctggaacagggccttgaatgcctcgagcgggttgccgttcttctgggccttggcgcgcagtgcgttggtgctttccttggtgccgaacgcgacggtccatgcggtcaggatgccgaggagtccgacgatgatgccgaaggaggtccagccggcctgtccttcgcccttggcaccggtgagcgtccaagtgaagtagctgacgatcgggatgaccacgacggtgatgccgttgtagccgatggagccggtgaaggagccgagggcggtgtaggtggagcgctcgtgggagtcggaggacagcgccgggatcatgccccagtaggagatgtcacgcagggagtagaacacgtcgagcacgacgaaggtgatgacgaacagcacgatgaacagcgtggtgttgacgttcaccaggccgaacatgccgctgaagatcacggcgagcaggacggcggagatcaggccgccgaagaactgccatgggcggaagcgtccccacttggtgttggtgttgtcgatgaggttgcccagcagcgggtcgatgaagatctcggcgatacggataatcaccacgaggctggtgatgacaccgataagcttggccgcaagcgccttgtcaacgcccgagaacaggcagccggtgacatagacgatgaaatatgtgctcatcgcgttgtagaaggcggactgaccgaggttgccgcaggcgtaggcgatacgctggccgagcttgcccttcttgcggacgccaccgtccgcggttgtcgtttcgttgctcattttttcttctccttaagattccggagttgaagatcacccattgatcttgcatgtcgagtatacgctctttacaagaaaaagtaaaaaccattagcaaaatatagggtttggcggcgtgttgaattaggtaaaccgtgtaccagcactgtcatatcggtatcaatcagatgcctgatacgttacaacatataccgctgacacgaaggaattaagacgtcaagtaaaaccgatttgccttttttgtaaacaatgtttattatctggtaaaggaagttcatcttccctccatcattcacaaagatgtaatgaacgaaagcaggaaaacatggcaaacgaaacccgcatcgaacacgcatccgagacctggctcgccgattcgaccgtattcgaggtcaaccgcatcccggcgcattccgaccacaaatgctacgcgcacgatccgcagaccaacgaatggtccgatctgaggcagagcctcgacggcgaatggagggtcgaggtcgttcaggcatccgacatcgaattcaacgaggagcccttcgtaagggagaacttcgacgattccgccttcgaacgcatccaggttcccggacacctgcagatggcgggattgatgaacaacaagtacgtgaacattcaatacccgtgggatggccacgagaatccgacggaaccgaatattccggagaacaaccatgtcgccctctaccgtaagaccttcacgatggcgaaccgtctggccgacaccaagaacgccggcggaaccgtctccatcgtgttccacggcatggccaccgcaatctacgtgtgggtcaacggcatgttcgtcggctatggcgaggacggcttcacccccaacgaattcgacatcaccgagatgctgcacgacggcgagaacgtcgttgccgtcgcatgctacgaatactccagcgcctcatggctcgaggaccaggacttctggcgtctgcacggactgttccgctcggtcgagctggccgcgcagccgcatgtgcatatcgagaacatgcagatcgaatccgattgggatccggagtccggcagcgcctctttggacgcggcgctcaccgtgcgcaacgcaaccgacgcggccacgatctcggcgacgttgaagaattccgatggtaacgtcgtctgggagaccgcgaactgcgctgaccccgatacctccatctccaccggatcgttgaacggcatccgcccgtggagcgcggaggatccggtcctctacgagttcgaggtcacggtcatcgaccatgccggcaacatcgccgaggtcgccgtccagaaggtcggattccgccgcttccgcatcgaggacggcatcatgacgattaatggcaaacgcatcgtattcaagggcgccgaccgccacgagttcgatcccaagcgcggccgcgcgatcaccgagcaggacatgatcgacgatgtggtcttctgcaagaggcacaacctcaacgccatcaggacctcccactatccgaaccaggagcgctggtacgagctgtgcgacgagtacggcatctacctgatcgacgagaccaacctcgagacccatggcagctggtgcctgcccggtgacgtcctcaccgaggagaccgccgtcccgggaagcaaggcgcattgggagggcgcgtgcgtcgaccgtgtcaacagcatggtgcgccgcgactacaaccatccgagcgtcctgatctggtctctcggcaacgaatcctacacgggcgacgtgttccgcgccatgtacaagcgcgtgcacgacatcgacccgaaccgtcccgtgcactatgagggcgtgacccacaaccgcgactacgacgacgtgaccgacatcgagacccgcatgtatgcgcacgccgacgccatcgaggaatacctgaagaatgatccgcagaagccttacatctcctgcgagtacatgcacgccatgggcaattcgtgcggcaacatggacgaatacaccgcgctcgaacactatccgaagtaccagggcggcttcatctgggacttcatcgaccaggcgatctacgccacccagcccgatggaaccacgagccttcgctatggcggcgacttcggcgacaggccgagcgactacgagttctccggcaacggcctggtgtttgcggaccgtaagcccacgccgaaggcccaggaggtcaagcagctgtattccaacgtgcatatcgatgtcgccgaggattccgtgaccatcaagaacgataatctgttcacctccactggcgaatacacgttcgtgttgcgtgtccttgcggatggcgaaccggtatggcagtccgaacgccgtttcgacgtgccggccggttcgacggagaagctcgatgtcgactggccgttggatctgtaccgcgacggcgcgtccgaactggtgctggaggtatcccagcgtctcgccaaggcgaccaattgggcggtagccggctatgagctggcattcggccagaccgtcgtcgccggctccaagaaggcctccgctccggtgaagccggtcgacggcatcgtcaccgttggccgttggaacgtcggcgtgcagggatccggccgcgaggtactgctttcccgcacccaaggcggactggtctcctacacgttcaacaatcgagaattcgtgctgcgccgtccggcggtcaccacgttccgcgcgctgaccgacaacgatcgcggcgcaggccacggcttcgaacgcgcccagtggctgggagcaggccgttacgcccgctgcatcggcaacgagatcgaacagatcgacgaggacaccgtcaaggcctcctacacgtacgagctcgccaccccgcagcgcaccaaggtgaccgtcagctacaccgccgacaccaccggacgagtgaatctgcacgtcgaatacccgggcgagccgggcgacctgcccaccatccccgcgttcggcatcgaatggacccttccggtccagtactcgaacctgcgtttcttcggcgctggtccggaggagacctaccaggatcgcaagcatgccaagctcggtgtgtggagcaccgacgcgttcaaggaccacgccccgtatctcatgccgcaggaaaccggcaaccatgaggacgtgcgttgggccgagatcacggacgagaagggccatggccttcgcataagccgcgccgaaggcgccgaaccgttcgcgatgagcctgcagccgtactccagcttcatgcttgaggaagcccagcatcaggacgagctccccgccccgaagcacatgttcctgcgtgtgcttgccgagcagatgggtgtcggaggagatgactcctggatgtccccggtccacccccagtaccatatcccggcggaccagccgatcagcctcgacgtcgatctcgacctgatctgaccggcgcgccccggcggaaaccgggacttggctttcctttcgccatacgcggaaacgtatggcgaaaggacggtgccgtcgtcaagggtggaccttgacatcaaaccggagacggcgccttgaaagggtacggcacgtcttccatgttttccccgtgccgtgccctcgtttccatatcgggaacagggcttgacagactttccttcgaaaacacctcacagatgcaaaagggttcggtcctcgttggcacgtattacgcgtgtcaacgaggaccgaaccctttcttcttaaaccctacctggctttcggggtgaaactgtcccgggcgaccagcttggttgaaatcctcatatgctggttgacggagcgccccatggaaatggcctccgacagcatgaataccgcggccttggccaattcgtccttgttgatgtcatacgacgaaagcgtcggcgaagtgtaattcgcgatctcctggttgttgatgctcaccagtcgcatgtcgcgtggaaccagaatgccggacgccgcgaacgcctgcaagacgcctacggcgatggggtccgccgccacaatcagagcatccgggagcctgtcgccacattcggccacgaacctctctcccaaggcacggccgttctccacggtgaaaggcccctcatcgaacaccaggccgtcgacgtcaagaccgagacggacggtccagttgcggaacgcgaacgcacgcggatcctcgggatactcatggtcgcccatgatgttgccgaaccctccgatgaacccgattcgcttgttgccggcgtccatcaattcgtccaaggcgtccagaatggtctgctccagatccggctgcaccgaatcgaacaggctcggcgcgggattgatgtcgatgaacactccatgcggaaggaccgcgtgcagacgcttcaacatgttccttttgaacggcgccggacctattgagatgaatccggcgtatttggacgcgtccttcatcagggatttgacatcgttgtattccgtcactctcatgcgctcgtccttggcatggcgacgtaatgaaacttcaagctcgtcaaaataggcgtcctgaagccccttgtcgtggatggagttgttcagcaacgcgatgtcttgcggaatggtgacacgttggtagcgggggacgttctcgtaccccatctcaatgctggtgctcagaatcttctgacgggtggcctccttcaccgagaacgaggggtcgtcattgagtattctcgatacggtcgcctgggagaagcccgccttttccgcgatctccctgatcgtggccatggaaacctacctccttggaaattcagcaactaaacgtgtttagtaacgagtttatcatgtttgaaagcgtaattgccatcaatgtcggaaatttcgttttcaatgaaaatggattggctacaatgtattggacagtccgatgaggccattcgtggattcaagctcaatatgctgctgtacgaattgctatcgctgctgtattcgaggttcgtttccggggtacggcggccggaattggtcagatccggaagaaacatcaccatgcagatcatcggatacatgacatcgcaccgcaaacagcatctcgaagcgaccgacgtcgcacgggaattcggatacggcagggaacatttctgccgcctattccgcaaggcgaccggcaaaacgttcaaagaatttctgaccgacctgcgattggacgacgcctgcagaaaactgtcaggttcctctgcgtcgatagccagcatcgcaagggaatgcggtttccccgatacgcgcgcgctgcagacggccgtgcaacgcaaatacggcatacgcgcgcaggaataccgcgaacgatacgaaaatcgaaactaacgttcaacgagaaaaggaggaaatatgactgggcctgcaccaaccatccgtcgtatgaaaattgaagattatccgctggtatacgggttgtggacgcgatgcaccggtttcaccatgagggacatcgacgattccgaggatgcgataaaaacgttcctcaaacgcaatcccgacacctgtttcgtagccgaagacgatggcggaaggattattggagcgattcttgccggtcacgatagcagacggtcgcgcatctaccacacggcggtcgatcccgacgcgcgcggtatgggcattggctcgcttttggtgggccgagtggttgaagcgcttcgtgcgatcggcctgccgaaagtcgccgtcggtgtgcccgcagacaacgatgccggcaacgatttctgggagcatcaggggtttgcggtccgtgacgatttggtctatcgggaactacctctctaatacgacccgtccgacaacgaaccgtccaatacgctcgcactttgtctctataagcccggttccgcacttgcagcccacaacaaatatgttttgtatatcaaacgtattcaaagaccatgcaatggaatatcagacggaggaagacccgttcggagcgcttaagagagacgagctgctgtgacgaatggcgatacggtgatgtggtcatcgctgaccttgccatcgttttctctgaaacatccggcatcctcatctcacacttttatgagcgagtttttgcccttccgtaacatttcatgagggagagccacccttccatggccacctgcgcaccctatgcaccccttaaaaaacggcgccattccgccatgaaatcacccccttcatccgagcatggcattgcgcaccccgtcaaaacatggccgtcatccctggtttcccgatttccgcactttttgaaaacccgttttacccgatttccgcacttttccggatatcgagcggcactgttccgaccgcgcgactgcatcaaacgccgattccgacgattctacagattaacggtaaaacgtcgcgcggcgacccggccggcttgcggaatggaggtcaggcttattccgcggtgcccttcagcagcatcgcgccaatgccctcaccttggtgacgcaggtctatggcgagcctgccgttcccatccatggtcacaatggtccgcacggccgatccttcgccaaacgccggcgacatatgaacatatttttaggaaacgactgttcagcgcttgccatccgcttcattcagataccgatatacagtggattgcccaacgcccatcatcaccgcaatttgaccgaccgtaccattacccgtcaaaggcatggagtttcggaacgttgattacgggacgggttttgagacactttccgccggagtgtcggagacaactcccccagtccggtttacgctccgaaaacgtccgttttcgaaatggtccaagacgcattccgatggtcctagtcggattcaccaagtgttgcatgttgcattcggtacaacatttaagaattcacaggaccacactcatccaacaacgaaccgatttcgcgacatggcgacatgacaacagataacgcccagacaccgcgcgaccggtctcattcccatcactcggccacgtcaaaccgtcgtcgttccacgaagacagccggacccgcaacccttcgtcggactccacgtccacctggcaaggagccagccggttccataatcctcatcatcaagacgctagactgtcttacaaaccggaaaatcataccgtccggcggcaatcgggaatggaaaggcgatggcaatgacgcgcatcgaagacggaatccaggatacggaaccgatccggttcctcgaactattgggactcgacgaagaggacctagccggctatagcattcgtctgaatggcagcaacccggaatggggcaaatggagtgatcttcccgacgcctactattcctcctatgatgacctgatgaagtggattttcacgaagaaatggccagataaggataaggcaacagcgcagattcacacacgtaaagtcctccagttcattcagctcaagccagagaatccccaccccacacaatggctgttcgtcggagcctacgacgtcctcgacgagtacacggagaacgacggcaagattctataccgttacaatgagatcccggaatacgcctcgctaaaggccagggcggtagtgtactacaaaagagatccgggttacacgggagtcgtctttaacctgtccaacaatgaagaacgacgccgggattttctcaagacgatgacccttgagaaaatcgctcaatcccccgtatccgcgttaccgttccccggatacgagaacgttcggttgacgcaccggcagctcgtggcggccgtgaacaacgaggaatggcgggcggccctcggcagcgtccaggcggtctatctgcagaccgatagacgaacgggatggcattacgtggggtccgcctactcacggaaaggagcctcgcacggtctgctgtcgcgttggaaggaatacgcgtccggagaccactccgggggaaacaagcagctcagaaacctcggcgccggatacatcgagaagaacttccagtactcgatcctggagatcttcgacatgaacaagtcacccaaagagatcatcgaccgcgaacactggtggatggacaccctcggatccgtccgtagaaacaacgacgaagtaccccacggatacaattccgtcgccgaacgagagaactccgaccaacacgaatgatcctgtgggtagctcctaccggctgaggctcgcggtgccggccgtgacctcgccgagggtgggaagcggcacgctcgtcgaaataggcgaccgtgttcttcgaatcgtcatgttcgaggtccttcccgcaccacggcccgtatttatcgcccgcggcgcatccaagggattcctgtctaaattccgacatatccgaaatgattacggactgtcaatctgaaaaagcaaagcccatcccctggtcgagaaaccttcgaacgaatacggatatccgtttccaagacgcgcaaggacacgttccgccggacatcatttcggttcgctaagcgttttatgtaacgctggtgcaaacacttaagaattcggccgccatccgcgtggagatgcattccatcctccgtccggcttggaatacgcatcaagtcattccattgtggctagacatccagcgaatcgggtcagaccgagttcgcgcaggcgtccagcacgcccctccccgccggcccgccataacccggctattttctcgagttgaaacgcacttggccgacagggccactcgggaaaggcaaggaatgacgaaaccggcgtcgatacagcaacgtatcaggagacgcttgacacgttaagggagatgcgaccttacgggaacagcagtgctgcgttttcggcgtatgccagccgcgagcatcggccgccggacggacatgttcttccagatcgagggctatacccgttttctattgaatccgccaaatcaaacgaaagggcgcacgtttcaaaacgtgcgccctttcatgtaatggatggagaggaaacggcttctatctggccatgaccccctttctcgcgattgatcctagccaatccaaggatggcttcggatggcgttcgaaggtgtccctgtcccaggaggccaggccgaacgtcggagcgaacgagccccactcgtagttgtcgagcagggaccagtggaggtatcccctcacgtcgataccgtcgtccatcgcgtcgtgcatgccggctatggcgtcgaaggtgtagtcgatcctccggcggtcatcggcagtggcgatgccattttcggtgacgattatcggcgtgcgtttggcgacgttccaagtatggcggatggcgatgcccagcgccggcgggaagtactcccagccggtgagggtgcgttccgcgtcctcggggatcggtacggggccatccttgccgatgaaggtcctcagataggcctgcaccccaatgaagtcatccccggccgcggcctcggtgaagtagtcctcgcgcgggtactggtattcctccatctcccgttcgcatccgggcatggcgtggaacgcctggcaggcgatggtccacccggacttgatacgcgggttctcggacagtatttccctggctttcctgtgcgctttgacgagcgtggcggagatgtccggatcgggcgcaggcagcgaggcggccacgaagtcgctgccttcggttccgccacgggtcagcgcgaccatgttcggctcgttaatggtgcagacccaggtgacgtcgtggaggatcggcatcacgtaccgcacgtaccgggcgaagtagtcgacggcatcggcgttgagccatccgcccttggtggcgagccacagcggcagtgtcatgtggttcagcgtgaccatgggctcgacgccgttctcgtggcacgcgtcgatcatttggcggtagtgcagcagctgcgctttggagaagcagccctccgcgggctcgatgcgggcccattcgatggagaagcggtacatgcccaatccggcgtcggcgagcattctgatgtcctcgccgtagcggtggtagctgtcggccgcgtctcccgacggttcgctgagatccgtgcgttcggcatgctccctggcccaccagtcgctcgcgacgttgttcccttcgatctggtgcgcggccgtggacgcgccccagatgaattccggcgggaactcgtattgttctttcatgacatgtctttctatttgatgcccgttccggcgacgccctggatgaagtagcgctgcaggaatacgaacaggaggaggatcggggtgaccaccagtaccgctccggcgagcaggacgctgtagttcgtggcgttctggccggtggagtagagggacagtgccacgggcagcgtgtacttctcctcggtctgggccgcgaccaacggccacaggaagttgttccaggaggacaggaacgtgaggatggacagcgtcgccagcggcggcccgcactggggcaggacgatctggaagaatatgcgcagctcaccggcgccgtcgaccctcgcggcctccatcagcgcgtcggggattccggagatgaactgtctcatcaggaagactccgatgggctggcacaggaacggcaggatgagcgccgcgtaggagttcgcgagtcccatgttcgagatgatcacgaacagggggacgaacgtggccacgctcggaaccatgagcgtcaccatgacggcgccgaacaagatgttcttgccggcgaagtccatcttcgccagggcgtatccgaccatggagcagagcaccatgttcccgaggacggtgatcacggcgacgaccatgctgttggtgaagtaggtaccgaagttcagttccccgaaccatttcgcgaagtttgcgagcgaggcgtgctcgggcaggagcttcggcggtttggcgaggatctccctctgggtcttcaacgagcccagcgccatccacaggaacgggaagatccagaagactccgatcaccgcgaggacgcagtaggagagtccacgccccttgacgaatcggcgccagagcgactgcttgttgctttgcggcctcgaggccgcgactgtcgtggctgtcatctcaatcctccttgagaatgcggaactggagcacgctgaccagcgcgatgatgatgaacagcacccagctggctgcggaagcgattccgtactgtccgaaaccgaacttctggtacacgtagtacgcggcggagagcgtcgagtcgagcggccctccctgggtcatcacgaaggattcctcgaagaactgcaggtaggcgacggaaaggagcacggctcccagcagcagcgtgggcttgagcagcggaagcgtgatgctgcggaaggtgcgccatttgcccgcgccgtcgatggccgcggcctccttcagctcctcggggatggcctgcaggccggcgaggaagatgatcatcagcgttcccatgttgcgccagatggtcatgaccatcagcgcgggcagtgcgtagcgggtgtcgtgcagccagtccggtccggcaatgccgaagacggccaagagcgagttgagcaggccgtccttctggaggatgtacctccacacgacggagactgcgaccacactggcgacgaccggcgcgtagaacaccgccctgaagaacgcgttgaggtgcttggatcccttgttgagggccaccgcgaacgcgagggcgatcaccatggtgatcggcaggccgacgagcacgaagattccggtgacgcccaacgcgtgcaggaagcgacgatcgtggaacagtgcgatgtactggtccagtccgacgaagttgacgttgaacggggtgcggaggtccttggaggtgatgtcggtgaaggacatcgccatcgaggacaggagggggatcagcatgaatacgcagaacacgaccacgaagggcagcgcgaatccccatgcgagaatcgtgcgacggcggcggagaacgttgcccgagccctccgtcttcgtctttcttgttccgaggctcatgggatcagttcccggttccgatggagtcggcttcggactgcaggttcttcagcccctcgtcgacggtgacctgtcccttgttcatctgctcgaggatacgatccgcggcggaggatacctgggcccaggtggacagcgccggcggagccatggtgttcttcagctggtcgccgaatgccgaaagcttgtcgttgccggagagcgcgtcatcgtcccatgccttctgggaagcgggcagatcggaggacttcttgtaccattcggcctgcacctcgggtttgctgacccactggatgaacttccacgcggactgcttgttcttggaatccttgaacgtcacaaagtcgctgcctccgacgaaggacgtggcgggccccgaggattcgtccatcgacggcaggacgacggtggcgtacttggattcgaatccgtcgccgcccaattcgttgatctggctgacggcggtcggcccctgcagcatcatcggagtgtcaccggacacgaagttcgcgatgtcggcaccggagcttacgtcggcgttgacgttcgcgacgccgtccttgtagaggctggtggtgaattccagacctttcttgacgccagcgtcgtcgaaggtccatttcgactggttcttgtcagtcagcgacgctccggcggtgtacgagaaaggcagggtcccgataaacgcatcggtgcctgaggggccgagatacatgccgtatttgactccgtcgaccttctgcatgtccgcggccatctgcttgagctcgtcccaggtcttcggcgccttgtcccaaccggcctccttggcgatgtcggtgcggtagtacagcacgcgggtgtcgacgtaccaaggcactccgagctgctttccgtcgacctggccggcggccttggagccgtcagagaagtcggacatgtcgaagttctccggcacggaggagaacgaattggagaaatcggtcatccaggtggtgcccatctgcgcgagatcggggccattgcccgcggcgatggcggtctggagcttgtcgtgcgcggaggaccacggaatcgcggtgaccttgaccttgacgtcggggttttcctttttgaatcccttgacgaaatcgcccagcagatcgccctcgttgcccatggcccagatggtcaggtcgccggtggccttgcttgaatcgatggtcttgaccgcatcggaatcggaatccgcgttgttcgcggaccgtccgcacgcggacataccggcaatcatcgccacactggccatgccggccacgaccgctttgaaaaatggcttcctcattgaaatctcctttgattcatatcaatctaagcgcttagattgatattacaatttaagcacttagatttaaggaagtcaaggcgacacgcccatatgatttatgcgcttagattttttgattgcatccgcagctgccgcgcacaatgaggcgaaccgggagtactcgtctttcagccttctcccaaggctccccgttcctggaaagcagcatgcgagccgcctcgcgccccatgtcctccatgggctggcggacggtcgtcagctgcggttccatcagccgtccggcgaggattccgtcgaatccggtgacgatgacgtcgtcgggaacccggacaccggcctcctcgaggagtctgatcacgccgaaggcggtctggtccgtgccgcagaccaaggcctgcggcagtctgccggatcctatcgcctcgcacaaacccaccatgtattcatcggacgtggcgaaggagtcatccaacagcgcgtcgctggaatcgagaccacgttcctcgaggcatttccggaaggcgacgtaacgggcgacgacgtcgtccgaatcgaagccgccgacgaacgccatctcgtcgacatgatggacgtctacaagatggtcgacgatctgcctcatgcccgatgcgttatcgcattgcaggtacgcggccggcagtttttcatcgcccacacccaccattacaagcgggatggtcttcgccaacatggaaagaggaagcgcatcgttatatccgcttggcatcagcgacagtccatcaacgcggccggcgatatccgttaccgatctgtgatcatccctttccgaggcggctcccataagtattcccttgccgctcttccagcattcgagttcgaaaccacgaagcacctcatcaacgtataacggatatacaagaacgttgggttcgtcaccgtccagaggctcgtcgatggatctgggggaaacatcaggccaatcatcctcaaggttgcttccctgaggtctttccagcagcatatcgaacgcgtacatgcccaacgtgcccgtcctgcctttggcaaggctacgtgcgttgccgctgggaacgtagccaagctcctcggcgaccctgaggaccttggccttggtatcatccttcactttgtcgggatgcctgaaggcgaaggagaccgtcgcggtagacacacccgccttctctgcaacgtcatacaccgtaactcttgccataagaccagtctaagcgctttgatgcatgggacacacacgaggtcccaaaaccatagtttttccggtcttctagcaggaatccgcggcgccgaagagaaaaaaccaggagtggaaaggatttccatgcccctgcgggagacctgggaatcagatggaaatcaaggatggaaagacggggtccccggaagccaagccccacgggagtcccggaaggaagaaggaaatacgggaaataaaaaagcccttccgggaacccgcatggggtcagccggaagaaccgggaggaggaacaaaagattcggggataaaaaatggggttcccggagcgtaagctcgacgggaacccccaacatgtgaagcggcggcgtgctactctcccacaccctctcgagtgcagtaccatcgccgcgtagactgtgagtgttgtccttactttgcggctctcgtggtatttttccgtttgccatgccttgattactggtagtctgccgcacattggacacccatattcgttgtatttacgtttgaaccacatgactatgcctccgcgtctttgttccgctttcggcccgtccgactcaacataaagccgtccaaatagagctggaacaggctcacgtactgtccgtcgtcgatgtcgtcttccggtttcgcatacagtcgtgtgttcaggagtgcgaccggcagtccggtatgctcctcccgctcgacgtggaacggtatttcttcctgaccgtgagcgttctcaaggacggccacaccgtagtcgccaacctgtggctgaaggtccgggctgctgtcatcgatgtcttcatagttgagacaggacggcatggagccgctgtagccgagcatggaacggcagtgttcggcggtcttgtaatatgcgtctatttgagctttgaccactgcataagcagccaagtcatgcttctgcagcaaagcattggcaagccgtaatccctcaacctcgcgctgctcacaccattcgataaccttgtgcagtgtctcgtcttgctgactcacgttcgtggccatgtcagtgctcctcttcttcgattcggattgtgattcggtaccagccttttcggctgcttggctctccgccgcggtagtcggggccgatgagatgctttgagtcatcgtcgggccagaatccggtatcggtgagcgcgtcaaggatggccttgaccatgggcgccgcgttctccgggtcgaagcgcccgtgcgtcaatgggtgaatgacggcagtgacgtgcaccgggaagtgttgtggacggtggtggccgttttggagccagaatctggcgaatgccacggcacgctgtttgactgcgctcgtgtgcgcgaatttcacccaccagtggccgcgccgattctgcgtccaccattcgtcccgtggaatgtccacgacgaattcctgcatcatcattcctcctcttcctcggcttcttcctcgcatattgggcatgggatggggcgcgccggatacagcgcgcacccatgaatcggacatgtgggcagcacgtccggcggctcaatccactcacgcatcagaagtcaggctctccagccggagcgccccacgggtcatctgccggagcctgcgactgctgctgtgtctgctgcggctgctgatagccgccaccattggcgttgccctggtatccgcctgactgcatcttctgcacctgcgccgtcgcataacggagcgacggtcctatctcgtccacggtcatttcgatgacggtacggttggaaccgtcctgcgcctgataggaacgctgctgcaaccggccctgcgcgatgacgcgcatgcccttgcggagcgtctggacgcaatgcgaggcgaggtcacgccaggccgaacagcggaggaacagcgcctgaccgtcctcccactgattggcctggctgttgtatacgcgtggcgtggccgcgatgctgaaattcgccaccgtggaaccattgcgcgtcgtgcgcatctcaggatctgcggtcagattgccaatgatcgtgataacagtctctccggccatcactcggcctccttcacttcagtctgctgcccggtttcaacgtccggctccatgacctcggcggtcacgtcatcagctccatcatcgccatcgtcatcaagcaccggctggaacacgtcgccgtaatcgggcgtggtgtcatcgctggcggcggcggtctgcgcctgcaccgtcaacggcagataaggcgccgcgcggcggatggcggtcttcttggccatggcctcgtagtcggttttccatgggccgaaattgccgctcttgctgcgtgccctcgcctgctcgatctcctgacggttcaggacgaggaagtagtggccgccgtccttgaaatgcgcgaccatgtacacgtgggtcagttcgccggggttggcgcatggcacgtggtgcagatcctcgttgagaccatagctgtaggagaattcgtctccctggtgtacggctcgggcgctgatgtccacgagctggccgctgcgtcgcgccaaatcgatcatgccgcgatagcccatgatgaacgtggcttccatgccgccggattttttgttgtagaagggaagcacgtaggcgcgtcccaatccgtccacgttggatggttcgaggccgagcgcggagcaggtcatgaagcaggagagcacgctttgcggcgagcattccgcgagtttcggcgtcttgttgatggcgctgacgcacatctggtagaggcggtcggggctgatgttgttgccgacgacgctggcgatgcgcggccagcttttcttcatcagcatctggaggttcttcttcggcgtcatttcgaccatctgacggccttgcgcctgctgtgcgattgctcccataatcattgctccttttcttcgatggatttgaatgcgaatttgcggtatgtggtggctttgacggtgtactccttgcgggtcgtcgtcttgtaggtggcttggaggttgccgcagcgcacgcccgcatgcgagccgatgcgcaggatgatctgttcctgcaattccttctgagtggccttcatgtcatgaagcattccggtggcgctctcgtatcttgcgagcaggtcgtagaggacatcgtcggcgctttcgtcaacgatgtccggcgtcggttccgggaacgccttctgcacgtcgccggcagtcaattgcggtggagtgccggtggtgacgaaatgccagaagtcggctgcggccttgtcgatcgcggccatatcctccacgtcggccttgaacgggatctccaccggctcgtcgtctccgatggccgcgtatacgtagccccacgtccatccagtgacgagcgcgtagaattcgacttgagccaagtagtatggcggaattcggaggttgccgtcctcgtcacgccagtcccccgctcgacgattacccgccgtcttgatctcaaggattccgaagctcccgtcctccccctgaaggatgccgtcaagcgaagcgcgaagatacggcttccctcggctgatgaattgcttgtcggttccgtccgtgacgagcatttctggatgctgcgcgcggaatcgcttccttaattcgttttccagggcattgcccttgaccaccgcccacttgtcggaaatgtcctccggttccacgcgacccgtcttctcaagccacaattcgtaaggcgttttgaaagcgttcaggccgagaatcgtgctcatgtcagacccgcccacaccagccttgcggcttttcagccaggcaagatgccgttccgtcttcttgccctgcttgaaccgttcgaccgtgtagcgttccgtgtctttgagtgggatacgcttcatttcaggctccctgctgattgcttggcttgtttatgtctgctttgatgatgtcggcgtcgaaataatcgaccaggagattggcaatattcaacgcggacgtcctgagcttgatggtttccgcctcggactctggcttgatggtgaaaacgccactctcgctatcgaatttgagtctcattttgcgtccttcgagtaattggccttgatgtccatcaattcgccggtgagcagtttcgtggcgaatccgtagaccaccttgtcgttggcttggaatgctgtgcgctgcaaggcgctcaccgcgtcgaagatgccgaccaaggcgtttgcgatgatgatgcgcggatcggctgtggcttgtggcccgacgctgatggttccgacgggggtgagtttcgttgcggtgattttgtccactgtgagtttcgatgtggtggtcatggtttctttcttctttccggttgtggtggttttgcgtgttttgcggggtgaatgctggtcgaaggccggcaggagtccttctttgcggagttgaccgatgatgttgcctgctgttttctggcttatgtcgagcgcttcggcggtttccttgccgtcgaatggttggccttggtcgatgcggtttctgcaatgcgcgaggatgagatcacgtttcgacggttccgcctgttccgccgtgggcttgccgacggcctgatagtcggccaggatgtcctcatgcgcctcctgttccggtggcaggtccggggtgaggagtcctgccttgcgtaacgcacgcatttcgccgatctggagtccggcttctcccgactcgtcgtagattttcttcagttcggcgagctcgtcgcccgtgtattcgtgtttcaacgtgttcctttcctgagtctttcaatgagccgatggttttgcctgatgaattcgtccacgtcgatgccctgctgcgtgatggtcggcttgccggtatcgacgcgtgctttcccgtcgcttttgatgtttgggtggcttttgcactgtgtcgccggaacgaacatgccgtttttcatctcgccaccgtccttcggtattcgtgcgccagagcccaccgttcagcgatttgacgctggtagcggacttttcgcctgtcctgatggccttcgggcggttccacgccgattttcacgtatggcgggcctttgccgatgctgcgccagttggcgagggtgcgtgggctcatgccgagcatggcggcaagttcggctggcgtgagcaggtcggtcatggcctgccgtcccgaatgtcacccatcgggtcgatgtggaggccgtcgagcatttccacggtgtcgctgccgcctccgcgttcgaggtgacgtttgagcgccttgtcgagcctggcatgcgattcgggcggcgagtgcggttattccgccgagtctgtcgccgggcaggtgaacgctgcataccagatcatcggatgcgtctaacggcatgatgaattcgccgatgatcgagtgggtggcgttctcgtttccgatgacttcggccgagaatgtgaatctcagcgtcctgctttccttgctggtcattgctttcctttgcttgttgacgttgtaggccccgtcctgacgagtggatggggctgagtggctggcttcggagtcgaaccgatgccgtccttggattccgagcgcccctttgactgttggaacacgacctgaacgtgttcacggacggtggcgtggccgacggcgactggccgtcaggcggacttgaaagggtttgcaagcaccggaatgcctgcgtttttgatagagagagaagagattggaatccgtggacgggcgaaccgtcgcccagccaatgcgccgacagtgtatgtgcagcgataatggtcggcgcgtggataataatcgatattcagttatgtgtccccgccagccgactggtgaacgtggatgtccgcgaaaacatcccggatttggtttgttttgttggactgtcggctggtgggaagtctttagtcgcgtggcgcgaatctgacaatcagccacaatgcggtggcgatgtacacgccttccaccatgagcgcggcgttcatgctgccgccatgccatgtgagcatgatggtcaggctggagatgaggccgatgctggcgacggcgaagaggatgcggcggagcgggtagttcggcttcttccgcttcttcattgcttgcatgtcttcaagccagtaatcatggtcagtcatcgtcgctcccagtgttcactcgcttgagtgggaaggcttcaggcgggagcgtttcgcagacagtcggccacttcgcatactgtctattgccattccacatgtgattagccgagcagtcatcccatgtgcgcgccgaccagtcatcatcgatgtccttaagcaggagccgaccatcattcgcggtgacatagaagccccgctccttcggctcttcgggtagcggcttttcctgttcagctggcttgtcgagttccttgagctggccgagcagattgtcggttttctcttcgtcgtgttccttgtatgcttcgatgaggtctgcgaggatttgttctcgttgttggaagatgttcatttcttgtccttcttctggttgagttctttgagtgttcgtccgatttcgcggcggaggttcatgaggtcggttttgttgagcatgtgttcctggtatccgtctgccatgtcgaatctgagtccgatgaggcagctgtggtcactgctgtgcgtgccgtccttgatgattcgcagttcgaatgattggctcatcgcatgttccctaggtcgtcgttgagcgtgtaggcgaagttgtcgagggtgctttcagggatgtccgcaaggacttcctcgccgtccgcgtggagctcgatgagttggccgctcttgtcttcctggatgcggatggcgtagccggtggtgccgatgagttcgattcttggtttcatggttttcctcgattccggtggcgccggcgggttaagcaactggctcatgttcggtttccttaggctttgaattgtttgatgctgtcaatcggctggatgaggagcatgagcagctgcatggagtccatgtcaaagaccggtgcggcttcttcgatttccttgatggtcatcgagatgcttccattgagcctttggtcgacggtcttgagggtgcatccccaagcgtttgcaaggtcggcacgtgtcttgtcgcgtctggcgagttcggctttgaggtttctgctggctgtttccgtcagaccggccattcatcctcctcgattccctgcttggtgaggcaggcgcgccagtcgtgccagccggggccgcgcatgtggccgcacgggtagtggtcgggggtcttggtcttttttacactcatcatgtctgcgttcctttcgatacttcacagtgtatttaattaactacatctatgtattcatttatacacatcttcacaaattgggcacaattgggtatttatttggctataatgatggatatgggacgaaaagcaaatgaaatgaccccactcgccacacagataatgaacgagtgcataaggatccagaaagccagcggcatgaccgtcgccgatttcgcgaaagcctgcggcttcagccgcgattactggtacaaacacgcgaatctcagccgccctctgacaatcggcgacctggaacgaatcagcaatgccagcggcatatcggcagaagacatcgtgacgaattcgaggcgtcatgcgattgaggaagcggaagcgaaggtgcggtctggcggctatggtcttgccgcctataacgctcatggcaagcaggaggcaatcaatggagaggctgggccggattacgacgagcctgcctgacctgccaataagccgcgacatgacctacggcgccatgcgccgcgccatcgtcggcctgcccgtcaccgtgtccagcgccatcctgccggacggactatggggctgctacgacgcctccacagacgtaatcctcatcgaccggcgactcacgtataccgcgaaaagatgcgtgctcacgcatgagctgctgcactggaagcatggtgacgatggttgttcgaacgatcgttcgaagcaggagcgacgggcgagaatgcagaccgccctcacgctcgtcaatcccaccgaactcgcactgctcgaacgcatgtacgacgatgacctatggtcgatagccgatgaactggacgtgaccatgcaggtgcttgcggactaccaagccacgctcaacacctcacctaacggacgaatcacctttagcgatatcaaagaaagggttttcaatgcgtaaaaaaatcattgccatcacagctgcgacgcttctcctggcgacggtctgtggatgcggaagacagcaggagccggattccacgacggccaagacgccggacgtcagcgcacagcaggcgaagccacaacaacaggaagccgagaagacggcgcagagctttgtggacgagttcaacgcgaactcatcgacgccgataaccgacgtcgagaaattcacgccgagcgattcggacggtccctattatcggacggagtatcgcaccggcgccttctccaccgcagacgctctccacgggagactgggccaatcgtcagtggacgtgctggtctacggggcagtgctcggatgcgggaagaacgacatggttcgcgtctacgtcgatgggccgcatgatgagatcgacagcgtattccccatcatggcgaagatgcttgatccgtcgatttccgatcaggacatccaaagtcagatggcgaaggagtatccgtccaatgatctgctttacgccgatacgcatgagctgatcgagagcgcttatgtcgatggcgatcatgcgtttctcgacgcgaaaatcagctagcggtttataagtctttataagtctttataaagcttatatttgcttcagacgctcgaatacctgtgccgtctgtgcggcatcgtcggcggccctatgacgctccgtcttggcgatgccgaagtagcggatgaggtctttgaggcgatggtggtccaattgcggcaggtatacctgtgagatttcgagtgtgtcgtagaagctgatgtcgggtattccagcgccgaccctctcggcttcgtgtttgattatggggatatcgaagcggtggatattgtggcctatccaagtatccttgccacagaaggcgtagaatctgggcaatgccttgtcgatggtcggctggtgccgcacgtcccggtctgtgatgccggttatctgcgtgaccttggccgggatcggaatctggggattgacgagctggctgtatgacgcgactttgcgtccgtgcctgattctcacagctcccaattcgatgattcgagcgcttctgcctaatccagtggtctcgatgtcgatggccacgtaatcgtcctccacgccactattcgcgttgacgtgggtgattggtgccgtttccactgttggagcgtctgaggtggcttccggcgatggctcagtcgcatttgtcgcttgatgcttatggcgcggctccggcttgaggaagagatgccagaagaaccatgcgaggaatgcgaggagcagaaccgtcatgatgcttgtggccagatcgtacttcggcgtggtgatggtgtcgtatatgccgtagatgccggagattgcgaacagcacggatagcacgaggtaaatcagtttcttcatttttccccttctttcttcttgcttcaagctaccgcagatggggattagacgtgccgattcttctatttcagcgcattggcgctgtatgaaagaatgaaaataatgttacatatgtatatatgtatatgtcatgtttgcaagttagtattttccgattgcaaggttaatatgtacccttgtttacaacacgccatacacacatgtttgcaagttagtatataatgtgtttcagaacaaaaaacctccgcagtgttaacggcaccgcggaggtaaaacatgaagcctcactcaaagacttccaaacccattgtaacgcatggcttggaggtcggaaatggaccgtgaaatgggataccgcaacatgctggcagtcgaagaactcgcaagccaaggaaaactcaccgtcacccacaagggcgcacgcagtttcgacttcgcgcaatacgccctgctcagccgcatggcatggctcaccgctgactggccgctggacaaggcagcaaaggagaagcacatgatgccgcgcacctacgcttccggctggctcaaaatcgctatcgattggggcatgacgctcccacagtcaatggatgagctcgtggcgatcggcaatgagccgcgcaatccgaagcgcgagcagctggcctacaaccgcatcggcaaaatcgccaagaagctcgaagccgcaggactcatcaaatgccttcgcaagggcaacgtgcagcgcaagaacaatgccgtctggcttctgaccatcggcactccagaggaaaacgctgaggtcgaagcatacgtgcgacagcacatgtacctctgattccgtgcccacattttgcccacgttttgtagagaaatgacgtgatttggagtgaattggagtgaaataggaaagcttgaaaaccgttggaaataaaaggaaaaccgccatttctggcggtttgaaaaagtgcctccagcgggactcgaacccgcaatccgaagaggtcgattttaagtcgactgcgtataccgatttcgccatggaggctttgcgccggccagaagaaaaagccgacgccaagctattatgccacgtcagcgcgcagcaagcaatctcttgccgtaatccagcacgatgccgtccaacagaccatgctcgctggccatgaaggagtcgatgcgctggccatgatcctcatatgcggcttcagacaccttggcaagcacacggttccacaccaatgcgccgccgccgaccacatcgacgcgtccgggatgaatagtcttgtaggtcagacgctcctcacgaggcatgtgcaggaaccggttgtcaacggcataggcatcttccagcgtgcagcgtgcgccgtccacggcggtgtggtcgtattccgtcaatcccatagccaatgcggtcatggtggtgaccgttccggacacgccgatgatggtgtgggtcttgccggcgggaacggtcttgaacgcctcgtcgatatgcgcgtcgatatccgcgaccgcctcggcgatctgcccctcggtcggcgggtcgtttttcagatgacgctccgtcatacggacagacccgatattcatggagaacgcggcctgcacctgcgtgctcggatgggtggcgccgtcgcctcccagcaccagttcggtggaacctccgcccaaatcgaccaccagatagggggcctcgacctcgcgatggacgatgctggtggcaccaaggaagcttaaatccgcttcctccgtgcctggaatgacttcgggacgcacgcccaagatcttctcgatgttgtcttcgaattcctcacggttctcggcatcacgggtggccgatgtggccacgaagcggatgccgtccacgggatgttcggcaagcacgccggcgaattctcgggcggcctcataggcgcgcgccaacgcctcgtcggcgaagcgatgggttttgtccacgtcctgaccgagacgaatcacccgcaggatgcgcggaacgatgtcttccacaccgtcctcgctcacacgcgagactttcagacgaatcgaattcgtgccgcaatcaataccggcaacggttaccgacttcattactcccaccttctactcttcgttttccactgcgcaacggcatacggccggatcgaactcatgtttgatggcggacagggccatatcaccgatggggttggcgccctcacccatcaccagcgtctgggccaacaacgcatgcaggcatttgacacgcaccggcatgccgccggcactggtgccttcgatgtgttcctcgctgtcttccaaggccaaagcgatttcatggcggaacgcgaggtacagttcgtgggcacgttcgtatccggcacgcagatcctcgttttcggccagcatatcgttgtattccttcatcttgccttcggcttcgatgtgggagatggccttcaccgcttcgggcccggtcagatagcaggtcgtcgggaacgggacaccgcctggaagcaacggccgggtgaccacagccaaaggccggccgcatacgcaacgggctccgacggcgaccatgccgcgcgggtaacgtccaagctgacgctccaccacggcgatatcatgttcggtggcgggttgggcaagcactttgtccgccaaacccttggcctgttcgataatcgtcatgtccatgtcactcctgtccgtcttccgacggctgctgaccgtcctgttgcgattggccagtctgttgttgactgtcctgtttgtcttcttcgccggcatgctgcgactgtttcgtcgagtcggccttcacgggatccgaccgatccgcctgcttgaaggaatatgcaagctccttataccacggcagggcggttttcggtgattcgtcgtatgtcgtcccttttttcggctcgctcttgccggtcaccgcttcgggatgctcgacacgaatcgcctgttcgccggggaagacgaatcccaaacgatccctggcctgggcggtgacatacgccttgtcatcccatcttgcgatatcgttctccagctcgcgtttctgcgcgaccaacgccgcttcctgttttttcagtccgttaagctctgccagattcaacgcataggtatggaatgtcgatgccaactggatggttcccaaagccacgatgaacaatgccacgaagaacgcgaccgggccggcgccgccgcgttgtgatggtttttttcgtgccttcgaactcatagcaacgaaaatacccgtcgcgttcgacttggaacacgacgggtatttctatgtcaacgcattcatgatgcgctggctacgctcactcggcgatgtacttcttgcaggccttgaaagcgctgtagccggcgtactgagcggtggagccgagctcctcctcaatctcgagcaggcggttgtacttggcgatacgctcgccacgagccggggcaccggtcttgatctggccggtgttctttgccacagccaggtcggagatggtggtgtccggggtctcgccggaacggtgggaaaccatggaggtgaagccgttcttggtggccagctcgatggcgtcgagggtctcggtgacggtgccgatctggttgagcttgaccagcagggagttggcggcgccgagcttgatgcccttggccagacgtgccgggttggtgaccagcaggtcgtcgccgacgaactgcaggcgatcgccgagcttggcggtgatggccgcccagtcgtcccagccttcttcctggaacggatcctcgatggagacgatcgggtactcgttgatgaggttctcgtagaagtcgagcatgtagccggcctcacggtcgtcgccttcgaagtggtacttgccggtctccttgttgtagaactcggaggaagccacatcgagggagatgccgatctgcttgcccggctcgtagccggcggcggagatggcgtccatgatgtagttcagggagtccttgttggacttcatcttcggagcgaagccgccctcgtcgccgaggccggtgttcaggccctgcttcttcaggacgttcttcagggtgtggtagacctcgacgccagcctgcagagcctcgctgtaggtgttgaagccgtacggggagatcatgtactcctggatgtcggtggcgaagtcagcgtgggcgccaccgttcatgatgttcatgttcgggaccggcaggatgtggccgttggtgccgccgatgtagcggtacagcggctgatccgcggactcggcggaagcgtacagagcggccagggacacgccgaggatggcgttggcgcccagacggcccttgttcggggtgccgtcgagctcgatcatggtctcatcgagagcgcgctgatcggaagcgtccatgccgatgaccttcggagcgatctcctcgttcacggccttgacggcgttgagcacacccttgccctggtaaacggacttgtcgccatcgcgacgctcccaagcctcggcttcgccggtggaagcaccggacggaacgaggcccaggccctgagcaccgtcatcggtgtcaagaacgacctcgacggtcgggttgccgcgggaatcgagaatctgacgcgcgtaaacgctttcaattactgccacaactactccttataaacgttaggttgtgatgacaatgccaagaatagtgcgatttatggacgtatgccaaactttgcccgcatgttccatgtgaacgctcacactcttttttgcatcccactgtcattgacgcggtgtcggtttccagtccaaatcgtcaagcaattgactggtccatccgaccacttcgtccgagctcatcggcttggaaccaagcgagcctgcgaatggagccggtaccagatacgtcttggtcaacggccggtactggatgcctttgtagattctggccatgcgcatctgcacggattcacgcggctcgaacttcgacacgcgcacgttgcgtccttgcgcgatgatctcggaaatgccgagcttgcgagccttgaaccgcaaccgcgccacgtcgaacagcgcctcgaaatcgacgggcggcttgccgtaacggtcggtgagttcgtcgcgcagctcgtcgagatcgtcttcggtgcgtgcggaggcgagtttctggtacgcttccaatcgcagtttgtccgaatcgatgtagtcgacgggaatggacgcctcgatcggcaggtcgatggtgacggcaaccgattccttgcgttccggctccttgtactgttcgaccgcttcggacaccatacgcacgtacaggtcgaagccgacgccttcgatatggccgctctgctcgtctcccagcaaattgccggtgccgcgcaattcgagatccttcatggctacgtcgaaaccagagccgagcgcggtgttctgcgcgatggtggcgagcctgtcatgcgattgctgggtcatcggcttggtcggatcgtacaggaagtacgcatacgcgcgctcacgtccacggccgacgcggccacgcagctgatgcaattggctcaagccgaagcggtcggcatggtcgacgatcagcgtgttggcgttggagatatcaaggccggtttcgatgatggtggtgcataccaacacgtcgatgtcgcgatgccagaagtcgcggatcacaccgtcaagctgtttctcccccatcttgccgtgggctatgccgacatgcgattcgggtacgagctcgtggattttcgccgcgacggaggagatgtcctgcacgcgattgtgcacgtagaacacctgcccaccacgcaacagctcgcgccggatggcggcggtgacctgcgcgtcctcgtaagcgccgacgtaggtgagcaccggcagacgatcctccggcggcgtggccagcgtggacatttcgcggataccggtgacagccatttccaacgtgcgcgggataggcgttgccgacaggctcagcacgtccacattggtgcgcaacgccttgagcgtctccttgtgctcgacgccgaaacgctgttcctcgtcgatgatgacgagtcccagatccttgaacttgatcttcggattgagcagcttgtgcgtgccgatgaccacatccacggaaccgtcttcaagccccttgatggtctcgttgatctccttggtggtctggaatcggctcatggcagccacgttcacggggaagccttcgaaacgttcggtgaaagtctcgaaatgctgttgcacgagcagtgtggtcggcacgagcacggccacctgcttggaatcctgcaccgccttgaacgcggcgcgcaccgcgatttcggttttgccaaagcccacatcgccgcagatcagacggtccatcggaatgggtttctccatatccgacttgacctcgtcgatggtggtgagctggtcggccgtctcctgataggggaaagcgtcctccagctccttctgccacggcgtgtccttgctgaaggcatagcctttcgtacgctggcgtgccgagtagagcttgaccagatcctcggcgatctcatgcacatgcttgcgtgccttggctttggtggcggcccagtcggaaccgcccagcttgttgagtttcggcgtttcggcgccgatgtatttgctgacctggtcgagctggtcggtggggatgaacagtttgtccgccggcgcgcctcgtttgctgggagcgtattcgatgaccaggtattctcgggtggtctggttctcgcctttgccgatggtacgttggcgcatctcgacgaaccggccgatgccatgctgttcgtgcacgacgtaatcgcccgttttgagttccatcaggtcgatggccttgcggcggcgtttcggcgttttcgcctgtcctgcggcggatgtgcggccggtcaggtcgcgttcggtgagcagggcgattttcgcggcgtcgtccacgaaaccgtcgatggcgcgcgatcggacgcaatcgaaattcgcgatgccggtttcgttgatcgcacgcttcagtcgggtgagtgtgccttgggccgcggccgtgatcgtcaccgcatagccggcgtcgagcagtccttcgatgccggaggccgctttgttttcgtcaccgcggtattcaccgggtttggtggcatcaagttggatgtggccttcccgggtggcgtcgacgccgaagctggtgagtttccacacgtcatgtttggagaagacgagtgcggagatggtttcctcgaaatcgtagaaattcgcctggtcgaaggtgatcggcgctccggcgccatgtccggatgcggcgacgtgccagcttgcggcaaggaattcgttggcggttttcgccagatcgtcggcggcgcgacgaagtttttccgggtcggacagcatgaccagcgcatgcttgggcagcatgccctgcaccggttccatatcgtcgaccagcgcgggcagcagcgattccatgccttccaccgggatggcgttggcgatggatccgagcatgtcctcggcgttgggaatggagccgatcagcgatttcgcacgttggcgaatctggtcggtcaactgcagttcacggcatggcgtggcccatacggtggaaatatccttaccgtaggtgcgctggtcggatgcgtggaattcacgtatggtgtcgatctcgtcgccgaagaattcgatacgcaccggatgcggcagagtgggcggaaaaacgtcgatgatgccaccgcggacggcgaattcgccacggtccatcaccaagtcgacgcgcgtgtacgcgttttccaccagtttgcgggatgcttcgtcaagaggcagttcctcgccttgggagaacacgagtggttcgacgtcccccaagcctgcgaccaccggttggatgagggagcgcaccggcatgaccagaatgcggatggggccgaacagcgtgctgccctcttcgggatgcttcagcctgcggaacaccgccatgcggcttgccacagtgtccgcgcgtggtgaaagccgttcatggggaagggtctcccatgcttcaagctgcgccacatcgtttgggtctccgtcataccaggaacggatggactccacggcttcctccgcttcgcggctggaggcgacgacgagcacgaccggctgtttgcccgcagcgccggctgcgagcgccgggcgtaggccgtccggcacaccgacggtgatgctggggtcgatgtctgattccggttcttcgatttccccggcgatgagcgcgcggaaatcgtcatcggtttccagcacgtcgaggatgccggcaagcgagcctgcggtcggcagttgcggtggttgcgccggagacgtcggttcagcggccattgaatcgctcctgggctttggcgagaccgtcgaagatgatggtttcggccgcgtcggcaccgtcggcgaggaattcggggagctgcttgcgttggtccggtccgaagccgcccagcacccagttcacggtgttgtcgtgcgcgtgggctccgcgttgggcgtggccgacgcccatgcgcacgcgcgcgtatttcggggtgccgagcgaacggtcgatggatttgatgccgttgtgcccgcctgcggagccgccggctttgactttgattctgccgaagtcgaggtccatgtcgtcgtggataaccacgatatggtccggttcgatctggtagtaggcgctgatggaggcgaccgcgttgccggattcgttcatgtaggtgagtggcttggcgaggaagaatttgacgttgcggccggataggttcatcacgcctttgccgagcatggcgagtcccttgtggtcggagaagttgacggaccagcgttcggccagcacgtcggcggtcatgaagcccatgttgtggcgggtgccctcatatttggagccggggttgcccagtcctgcgatcagccagaaatcagatgccataataatcgtccattcctctgtgttcttgcgtgctctcgtcttgtttaaccgcacagattctactgtcaggtgcttacaggtcgagatgccagtagctcatgtcgcgcatggttccggtggagtcggtggcggcttggggcatgagtccgaattgggtgaatccgaaatgtttcatcagtgcgatggatccgcggttgtcggcgaagatgatgccgcaggctttgcgcatgtggcggtttcggcattcgtcaagcagtttggccagtgtgaaggtgcccgctcccctgccctgccattcgggggcgatgtagtaggcgaggtcggtgacgccgtcgtagccggcgcggtcgtagaacacggacagcgcggagaagccgatgatccgttcgccgccttccgtggctgcatccgtggcaggcacggtggtgacgaacaccgcatatggatcgtggtgcgattccacccatgccttgcgttgcgcgtaggtacgtggcgtggtgtcggcggacgagccgccgcggatgactgccgcgttgtagatgtcggtgatcgcttggatatcgtcttgcgtcgcgatgcggaaagaatagtcggccatgcgcccagcatacccggcggcaaacgacaacaggggccggttcctttggaaggagccggcccctgcgtatttcatgaagggaattggacgggaatcactgttcgagttcgatggccttgttcagtgcttcctgaagctgcttctgagcgtcgccgtaggcggaccaatcgcccttcttcatggcggcatcggaatccttcatggcctgtgcggcatcgtcgagtgccttcttcaggtcggcgctcatcgtgccggacgaatcgccattattgccgccggtcttaccgtcggtattggatggcgtgtcctgcttgccgtcagtgttggtcttgccatcggcggaatcgtcgttcttagcatcctgcttgtcatcggtggtgtcgcccacgttttcggcgtcgcctgcggacgcgccggaatcgccgccgaacacctggtcgagagcctcgtccagcgtgtcggcgaagccgacctggtcgccgaatgcgacgagcaccttcttcagcagcgggaagctggtggagccggacgatttgacgtacaccggctgcacgtagaccaggcctccgccgagaggcagggtgagcaggttgccgcgctgcacattggtcgagccggattcgagcaggttgagttccttcgacacgtcggcggacgcgttgaagttgttctgcgcctggccggggcccggcacgttggaatccttcggcagttcctgcaatcgtatggtgccgtagctcgagccgattttgcctttctcgtggcccgcgtcggaatcgaccgacaggaagccggtcaggatttccctggtggacgagcctgcgggaatgtacgacgaggtcagcgagaacaccggttcgctggagccgccggtctgcagcgtcagatagtacggcggctgcaggatgtctcgctgttgcgcctgctgcgattcggtcgggtcgacgggggtctgccagaaatcctctccggagaagaactggttggcgctggacacgtggtatttggccagcagttcgcgctgcaccttgaacaggctttccggataacgcatgtggctcatcaggtcgccggagatttccgacagctggtggtactggccggggaagatcttctcccaggctttgatgaccgggtcggactggtcccatacatacaggtccacggaaccgtcgtatgcatccacggtggctttcacggaattgcggatgtagttggcgttcttcgagttcaggctgcttaccgtgtcggaggattccgtggtggagtccttggtggcctcgcccaagtcggtcatctgagagtatgggtaggcgtccgaagtggtgtagccgtccacgatccacttgacccgtccgtccaccacggccgggtatacgcggccgtcaagcgtcagatacggcgcgactttggccacacgttccttcggggaacggtcgtagagaatctgcgaattggagttcacacggttggagaacaggatctggtcggagccgaagcggatggcgtacagcagtctggagaagatgttgccgatcttcggaccgccatcgcccttgaaggtgttggtggcgccttccgaaccggtcggatagtcgaattcccaggatttggtgccttccggagcgcctacgatcgaatattcggtggcgttcggagagaagtagatgcgcggctcgtacttttcggaatcggtgagcttgccttgggtggggatgcccgcttcgaagaacttcggctggccgtcggcggtcaccttgttgccgtaggcggccacaacgccatagccgtgcgtgtacacggtgtggtcgttgacccagttgcggttgtcgagaccgtccagatcgagttcgcgcgcggcgatcaccgtgtcctggctgacgccgtcgacgtcgtatttgtcgaccgcgacggtgtcggcgaacgtgtagtactgcttggactgctgcagctgtttgaacgtcggggagatgatctgcgggtcgagcaggcggatctgagcggtggattccgcggaatcagccaatgcgccttcctcgccttcggtggtggccttgtactgttcggccttcaccttgtccaagccgtacgcggcgcgggtggcgtcgatgttgcgctggatataggtggattccatttcctgcgcgttcggattgacgcggaagcgctgcagcagcaccggccaggctacggtaagcaccaggctcaccacgatggcggaggcgatggccacggtcggcaccttccacgccttgagcgcttcggaagcacgtgccgcgatgggtgcggaaccttccaacgtatgggatttcataatccacaggcccagtatcacgccaaggatggcggtgatggcggccatgatgaacgtgacggggatggtggcgttcaccgtggtgtaggtggcaccggtgattctgctgccttcctcggtcaggtgcgagaacactcccagaacctgattggcggcccaggcgaacatgttgagcatcagccagatgccgatctggcggcgggcgcgtttggtgatgcggaacaggccatggccgttcaccggcatggtgatgcggatgccgcccataagcacgtgggtgacgatggagaagatgatgccagcgagcagcaacagcgagacagcggacatgatgagtttcagtccgggcagcacgaacacgtagaagccgttgtcgatgccgaactgcggatccttggtgccgaagctttgcgagttgaacatgagcaggatttcggaccagttcgcgttgaaccgggagccgaacaccagtccgacaatcagggagatgaccacggcgatgcgtcgagcgctcttggagctcacgctcttgccgatttcgatggtgtcgccgttcacgcggatggtggagccgtccgcagcgtcgggacgcgcccatatcgccagcgtggcggagatgaagccgactgcggcgatgagcaccgcgtacgccagccagaggccgaccctggtgcccagctgcgtccaaatcacgctttggaagccgagctggctgtaccacatgacatcggtgacgaactgcgcgagcgcgaagaacagtccgatgacgatggcgagcgccagcaccacgccgatgaagatcttgctgccgttcgacggtttgcgcggacggttcggcttgctggtgatgcgggggcccgaaggtcgtttcgggggaacgttcgacgatggttgcggaccgtcccctccgtcggtttcgacgttgaggatgatcggatcgtcgttgctgggtttgcgcggattctgcctgccggcacggttcgagccgccttcgggatcgaacatgggaccaaacatatcaaagaaagacatgctaatagcctagcgacaggcgaggaacgccgttaagccgccagccgaacggatctggccgtgggctgaatcggctgttccgtggcatgtccgtatgaagagaacatatggggaatgccggcatgccataatggcggtatgaagaaggctcatgggtttttcacacgattggtggccgcctgctgcgtggcgatgctgccggtcacgttggccgcatgttccggcgacgcttccccatcggacgccgccaccgcagctttttccactcgccggccgacggtcacgcatgattccctcgacaaggcgcaagtgccgtccgtccgcgacgattcgccgcatgccaaggcggtgcgggccgtggagtccatgagtgtcgaggaacgggtcgggcagctggttatggcgccattgttcgctggttccgatccgtcatcgttgtatgacctcatcgcgaacaggcatgttggttcggtcttgatcatcggcaactggaattcggggaccgccggggtcgcggccgccacatccacgctgcaatcgtatgctccgggcgacaaccagctgttgatgtccaccgatcaggagggtggtctggtccagcatctcaagggggccgggttcgataccatgccttcggccacccagcagggcgcaatggatgtcagccagttgaggcaatcggcatccgcatggggcacgcagctcaaggctgccggcatcaatgtcgatctggcgcccgtcgtcggcacggtgaccgtggaccgttcgtcgaacgccccgattggcgcgctgtaccgtgatttcggtcttgatccggccggcaatgcggaccatgcgaaggcgttcatacagggcatgtccgattcgggggtaggcagcgccatcaaacattatccgggtttgggatcggtgaccggcaataccgatttcaccgcgaacggcatcctcgacaccaccaccacgttggatggtccggaaatcagcgcgttcaacggcacgttggaggcaagcccttcgatggtgatgatgtctttggccacatatcaggcgatcgatccgaataatccggccgtgttctcatcaacgctggtcaccggctatctgcgcgggaaaatcggcttccaaggcgtcgtcacttccgattccctgtccgcaacggctttgagtggcgtgcagccgagtgatttgggtgtgcggctggtcgaagccggcggcgatttggcatgtatcggcgcctcttcctacgtgcagccggtgttggacggattgaacgccaaagcggccggcgatgcgacgttcgcgcggaaggtgcagcaatccgccattcgtgtgatgacgctcaaatacgagatggggctcgccaggtaatcgcaatgccaagcacaggcggaagccgtcttacgagaaaaccagctgtaccagcagcatatagacggcggtgccgccggcgatcgacagcagcatgttccttttccatatgtgcagcagggcgattgcgataatcgccaacaattcgggaatgccgtggctgcctgacgtcaggcgcactcctttgagcgagtacacgacgagcaggcctgtcatggcatacggcaggacggtgcccaggtaggtgatgaaacgcggcggttccttcgattcggggaacagcaggaatggcaggaaacgtgtcagcatggtgccgagcatcgccatgatgatggtgatgacgccttgccacgtggtcatgatcatcatgcgttcgtctccttgtccgcgttgttcgtttcgttctccccgtccgtcttgtcgatcttcaggtcgtccaggtatggccgcagcagaatgaacatgacgagcatggcgaccagggatgggatcatgaaattgtcggcgccgaacacccccagacagatcgcgggcaccgctatgccggtaagcgcggccatgtggcttttgcgtttcgtggtcagccattgatccacgaaaatgacggcgaacatggcggtcatgatgaagtcgagaccggaggtgttgaaggtgatgcgttctccgagaaggccgccaagcgtggcgccggccacccatgatgactggttgagcaggccgacgaagaagtagaaccatccgcgatcgacgtcggccgcaatgatggtgccgttgtcgatggcgaaggtctcgtcgcacaacgagaaaatgagatacggcttcttggcgcccatgttcttgaaccggccgagcatggagatgccgtagaacagatgacgggtgccgagcatgacggccagcatgaacgtgacgaacgggttgaacgcggacaccagcagattcacggtgacgaattccatggaaccggtgaagatgaacgcgctcatgcacatgggccacaggaacgaaaagccgcgcgtgcccatcagcacgccgtacgacaacgccagaaggaaaaagctgatgcagaccggcgacgtccgcggcaatgccgttctgaacgccttgcccatgacggcgttcctgttctgcgtccgcaccattaaatatcagcccttcttccgtccgttcccatgcttctcttctcatgccttctcttgccgcgccctgatataccccgacgcgccacaacgacggccaacatactatcgccgaccccgacaaaccatgcgcaaccgtatcggcgcgtggacatcgacggattacgtacaaagcatgcgcgacgagattatcatgctgcatactggaacgtaacgaaaaacctttggacaaggagcatgaatgaagacactggtactggtgttccacccgcatctggaaaaatcgcaggtcaaccgcaagctcatggacgcggccaacgagaccggcgacgtgaccgtggtggacgagtacgccgcatatcccgacttcaaaatcaacgtcgaacatgagcaggagctcatcgaaacgcatgaccgcatcgtgctgcagttcccgttctactggtacagctcccccgcgctgctcaagcagtgggaggatgacgtgatcaaggccggctgggcctacggcggcgggcgggcgctcgaaggcaaggagttcatgttggccgtgtccaccggctctccggcggactcctacacgcgtgaaggcagccatgtgcgcaccatggaggagctgctttccccgttcgagaccacgttccgtcatacgcatgccacatatctgaagccgttcctcatccaaggcgtcgccacgtccaccgatgagcagatcgacgccgccgtggcgaagtatccggcagcgctgatcggctgattcctctgcctgtttcggcgcgcatttcccgattttccgcagggagccgtgttcgttccagacgaacgtggctccctgtttgacttcaagtacttgaagttcctattctcttccaacagagcatgaaggagcatacggtgaataacactccagatacatttacatccgctgcggagcaggacatgtccgaaacccgccaggcgttcctcaccggcgagcgcgcggagttcttcgcgcatgaccgccggtacgtcgatacgattttcgacgatggcgaatcgccgttgaagcatgcccatgacatcgaactgaggtcgagctcgttcaaatggaagtatccgctgtggtattgctcggatatcgatgcgaaggactgcacgtggtttgagatggcacgtgcgggcgtatggtacacggaccatatcaaggtggaggattcgacgatcgaggcgccgaagaatttccgccgctgccatgacgtgacgttacgcaacgtggatttcgtcaacgccgaggagacgttgtgggcctgttccggcgtgacgttggacaatgtgagcgcgcatggcgactatctggcgatgaattgcgcggatgtgaaagccgacaacctacgtttggtgggcaattatccgttcgatggcgcaaggaacgtggagatttccaattcccgtctgatttcgaaggattgtttctggaactgcgagaacgtgacggtgcgcgattcgttcatttccggcgagtatctggcgtggaactcgcgtaacgtgacgttcgagcattgcacgatcgaaagcctgcagggcctgtgctacgtggaccatctggtgttgcgtgactgccggctcgtcaatacgacgctcgcgttcgaatattcctccgtcgatgccgacgtgcgcggcacgatcgacagcgtgttcaatccttcgtccggcacgattcgcgccgaccatatcaacgagatgacgctcgatccggcgaaaatcgatccgacggccacgacgatcgtgacagccgacgccgcataacagtaggtaggattggcggtatgacttacgatttcgatactccgatcgaccgttccggcacgtactcgctcaaatgggaggaggctggcgacgcgctgcccatgtgggtggcggatatggatttccagaccgcgcccgtaatccgcgaggcgttgcgtcggcgcgtcgagcatggcgttttcggctattcgatcgtgccgccagaatggaatcaggcgtacgtggattggtggggacgccgtcatgggcttgccatcgacccggactcgctggtgttctgcaccggtgtggtgccggcgatctccagcatggtcaggaaactcaccacgccgaacgagaacgtcgtgatcatgacgccggtctacaacatcttcttcaattcgattctcaacaatggctgccgtgtgcttgaatcgccgctcgcctatgacggcgaaggacattacgagatcgattgggctgatttcgaaacgaaactcgccgacccgcagaccacgctgatgattctgtgcaacccgcataatccgatcgaccgtatttgggattgtgagactttggaacgtatcggcgaactgtgctggaagcatcatgtgacggtggtcagcgatgagatccactgcgatctgaccgatccgggtttcgattacgtgccgttcgcctcggtgggcgagcattgcgcgatgaattcggtgacctgcatggctccgaccaaaacgttcaacatcgcaggactgaattccgcggccgtgatgattccgaatccggtgctgcgtcataaggtgtggcgagctttgaacaccgatgaggtggcggagccgaacgccttcgccatggacgccaccctggccgcgttcaacgagggcgaaccgtggctgaacgaactgcgcgcttatctggccggcaacaaggcgaccgcgcgtgcgatgttcgacaaatacaacgcttcggtgccggccgaccggcgcatcatcatggtcgaaggacatgccacctacctgttgtgggtcgactgttcggccatcacgcatgacacggatgcgttgtgcgattatctcaaacgcgagcataaggtgatgttctccgagggttccgaatatggtggcaacggtcatgatttcgtgcgtatcaacgtggcttgtccgcgtgcacgcatgatcgagggtcttgcacggttcatcgacggtctgctcgcgtatcgagcacaatcgtttccaaagatggaccgataaacccttggactgacgcatgacggatgcggcaacggcctcttcaaggaccatgaaaggacgcaacatggtggtggtgtttttctcccgcgccggcgaaaactacgaagtgggcgaggtgacggtcggcaataccgcgaagcttgcccaagaggtggcccggcggaccgattcgccgatgattgaaatcacacgtaccgagccttatccggaacggtacgccgcgacctcagaaatggtgcaggaggagcagcgtgtcaacgcgcgtccgctgctcacgctcagcggcgatgtcgatgcgctcgattcgtccgataccgtgttccttggctatccgatttggtgcggcgatatgccgatgcccatgtacgcttttctggaaagccgcgactggtccggcaaaaccatttatccgttctgcacgcacggcggcagcgggcttggacggactccggaacgtatcaccgcaatcaccaagacgacggtgaagccggggcttgcggtcatggggaccgacgcacagaacaacgcaagtaaagccgccgaagccgtcagcgggtggatcgccaaatccggtctatagattcgcaatccacatccgtccgttccgtctgcttcagcacgccttcgagttggagcagacggattttggtttcaatgcctcccgcataaccggtgagactgccgtcagcgccgacgacccgatggcagggcacgataagcgcgatcggattgtggtgcaccgctcccccgatggcgcgtgcggataccctacgcccgtccgcacgtttcaactccaatcgacgtgcgagtccgccgtatgaaaccgtttcgccgtatggcactttccgcagcaatgcccatgcttccttgcggaacggcgtgccttccagccgcaacggcacttcggtccgaggtatgcaacctgcaaagtattcctccagccatcgtttcgcggcgccaatcgtcggcgaatcacccaaaaccgcggaatcatcgtccgcatagcctggctgccaatcgaaccacaggccgagcaatgccgtttcgtcggcgatcagcgtgatgccgccaagcggcgaatcgtaatgcgacttctttttcaccgccgttatccacctttccacaaaacacctatctcgcctatgaatggcggatttcgtctttcgacacatgttatctcgcttatagatggcggacggcaaagtgaaaagccgcgctttttacccccatacgctatctcagggggtctaaatcgaaaaacatccgccatctatagtggagatagcatcaggcagacccgcaaatccgccattcataggcgagataggaccaaaacgaaggagttggcatgggatacgcactcatcacgggagcgtccggcggcatcggacgcgaactggcggcgctgttcgcagcggacggacatgacctggcgatcaccgcccgcagccaggaacggcttgacatggtaaaaaccaagctcgagcagcgttttggcgtgcatgtggtgacgttcgccatagatctgagcgaagcaaatgcgccgaagaaactccatgatttcaccacatcacaaggtattgcggtcgaccatctcgttaataacgcaggcttcgctgactggacggattttctcgacgccgactggaaccggcaaaatgagatgatgcagctcaacatgcatgcgctcgctgagttgacgtatcggtatggccgagacatgcgcgccaacgggcatggcaggattttgaatatttcgtccgtcgcctcgatgatggcaggcccatacatggcgatgtatttcgcgtcgaaggcgttcgtgcgttcgctatccgaggcagtggcccacgaattgcgcggcacgggcgtgacggtgacctgcgtatgtcccggtccgaccacgaccggctttcagaaggctgcgaatatgagtggccgcaacttcttcaccatgaccaaaccggccaccgcacgtcagcttgccacgtacgcctaccgcaggatgatgcgcggctcaaccctcgcctaccatggtccgctcaccaaggcgggcgcgctcgcggaacgggttcttccccgcgctttgacccggcgaatcgccgcgttcatggacggcggcaagccgcacacgctcaaggtttaacggcgaatcgcttggacggacggtagcagagcagagcgatgccgatgagtacggcggttgcggcgaggctgatcgggtagacgatcatgatggcctcgaacgtgcgatgcgcggggaacgcgaacgcgatccaggtgatgcgcacgccgaccacgccgattacggtgagcagcgccggcaccagtgagatgccgaagccgcgcagatatccggacatgacctcgtacagcatgctgaacgtgtaggcggagaacaccatgacgagtctggtgtagccgacggaaatgacctccggtgtcgcatcgaacaacgccagcagactatggccgaagaacagcacgacggcgatggtgaccgcggtggcgatgaaatcctccagaatgcagatgccaagcacgcgcttgcagcgtccgatccgtttggctccatagttttgcccggtgaaggtggcgcaggcctggctgaacgagttgagcacgtagtaggcgatgatttcgatgttgaacgcggcgctggaggcggccatgacaacggtgccgagactgttgatggcggcttggatgatgatgttggccacggcgaacaccgcgctttgcacgccggcgggcagtccgatgcgcagaatctgacgcagggtaaaccagtcgatgccgaactcgcgcaaatcaacatggatggctgcgtcagtatgaaccagtcgatacagcagaatcatggagctgacgacgttcgcgatgactgtggccgtcgcgacgcccgaaacaccccaatggaacagtacgacgaaaatcagtcccatggtcacgttgagcacgccggaaatggcgagtacggcgagcggagcctgggtgtcgccgatgctgcggaagatggctgtttcgaaattgtatagcaggatgacgggcatgccgatgaggtagatgcgcaggtatgcgagcgccagggggaacacgtcggcggtcacgttgagcatgccgagaagcggtccggcgagcaattctccgatgatggcgacgatcacgccgccgatcagggcggtgacgatggacgtgtgcacggcgttgcgcaccgcttcgcggctgcctcgtccgatggcgttggcgatgacgacgttcgcgccgagagcgatgccgatgaacaggttgaggatgagtccggtgacgggcgcgttggagccgacggccgcgaccgcggcggtgccgtcggattgggagaagttgccgacgatcatgatgccggatgcgttgaagagttgttccagaatgccggtcgccgccacggggagcgcgaatcgcaggactttcgtccatatgcgcccgtgcagcatgtctatgccctgcttgttgtgcaccatgttttgcctccgccagccgcagccggctcgtcgttcgcttccgaaggcattgtagtggcggcaccaaacgagggaaccgccatgccgttttgtaggatgctctaaaaaagggcaatgacgttttcgaattccctttggtggcgagtggagcccgcgcgttagtatgaaaggcatgagtgaaaccgtttcaaccgcatccaacgcggccgacgcatggacgaatccgctgcgcgacccgcgcgatctgagacttccccgcatcgcaggcccatgcagcatcgtgattttcggcgtgaccggcgatctgtcccgtaagaagctgctccccgccatctacgatctggccaaccgtggcttgttgccgccaagcttcggtctgacaggcttcgcacgccgcgactggaccgaggaccatttcaaggacttcgtcaaggagaacgtgcaggcgcattgccgtacgccgttcaaggaatcgacttggaagcagcttgcggccggtatccgtttcgtacaaggcacgttcgatgatccgaaagcgttcgagcgtctgtccgacacggtcgccgagcttgaccgcgaccgtggcacgcgcggcaatcacgcgttctacatgtcggtgccgccgcgcgcgttcccgcaggtgtcccgtcagctggccgactgtggtctggcgaaaagcgacaagggcgcttggcgtcgtgtgatcatcgaaaagccgttcggtcatgacctggccagcgccaaggagctcgatcgcgtggtctccgaagtgttcgacccgtcgagcgtgttccgcatcgaccattatcttggcaaggagaccgtgcagaacatgctggcgttgcgtttcgcgaacgccatgtacgagccgatctggaacaacaattacgtcgaccatgtgcagatcaccatggccgaggacatcggcgtggccgggcgcgccggatactacgacggcatcggcgccgcacgcgacatcatccagaaccatctgctgcagcttatggcgttgaccgccatggaggagcccgtctccttctccgccgccgatctgaccgccgagaagaccaaggtgctctccgccgtgcgcctgcccaaggatctggccgcgcacaccgcgcgaggccagtacgccgccggatggcagggatcgcacgaggtggtcggctacttggacgagaagggcatcgatcccgaatccaccaccgagacctatgccgcgatccgcctggacgtcgacacccgccgttgggccggcgtgccgttctatctgcgtaccggcaagcgcctgggcaagcgcgtcacggagatcgccgtggtgttcaaacgcgccccgcatctgccgttcgaatcgaccgccaccaaggagctcggcaagaacgccgtcgtgatccgcgtgcagcccgacgagggcgtgaccatgcgcttcggcgcgaaggtgccgggcggcacgtcgatggaggtgcgcgacgtgtcgatggacttcggctacggtcgctcgttcaccgaatcctcccctgaggcatacgaacgcctgatcctcgacgtgctgctgggcgacccgccgctgttccccaccaccgaggaggtcaacctttcgtggaagatcctcgacccgatcgaggagttctggtcgacgctcggccagccgcagccgtatcgttccggcacgtgggggccggaggaggccgttgaaatgctcgcccgcgatggacaccgttggaggatgccgtgatcattaccctgcaagacaccgagacccgcgagatctcggcgaaaatcgacgaactgcacgaggagcgcggcgaggcggccctgggccgtgtgctcaccctgctcatctccaccaacgaggccgagctcgagcatgatctcgaagtcgccaacaatgcgagccgcgagcatccctgccgtgtgatcgcggtcgccccgagcagccgcaagatcagcccggaagaggagcatcccaccttccttgacgccgagatccgcttcggctccgacgccggtgcgggcgagatcatcgtgcttcgtccgcgcggcggtctggtccgtcacgccgacaccctggtgatcccgctgctcgtgcctgacgctcccgtggtggcatggtggccgaacgaggcgcccgcgaatctgtcgaaggacctgctcggctccatggccagcagccgcatcaccgacgcgatgcactcctcgaacccgcggcgcacgatggacgatctgcgccgcaaccgctccgccaaggacgtggacatgtcgtggacacgcctgaccgtatggcgtgcgatgatcgcctcgatgctcgaccagccgccgcacctgccggtgagcaatgtgcgcgtgaccgggcagaaggattatctgccgttggatctgctggccgcatggctgcgactgcgcctgaacgtgccggtgatgatcgaggaggatccgaacgccacggccgtcaccggcgtgtacctgacgcgcggcgacggcgtgctgagcctggagcgcccctccaccgacgacgggttcgccgtgatcagtgtgcccggccagtcgccgcagaccatcagcgtgcccgcgcgcacgcttgaggaatgcctgagcgaggagcttggccgcctctaccccgatgagatctacagcgaggtcgtctcgcaaggactagatctcgtcaagcccaggcagtagccaccgagcgtcgaaccataatacaaggagtgaacgtgacagaacgtaaaaccgtcgtataccccaatccgcaggtactggcggaggctgtggccgcgcgcacgctgctgaccatcatcgatctgctggccgagccgaatcgtaaacgtgtggatatcgccgtgaccggcggcaccgacggtaaccgtgtgttcgccgcgatgaacgccagcccgctgaacgatgccgtggactggagccgtgtgcacgtgtggtggggcgacgagcgcttcgtggcggccgatgacgacgaccgcaacgcgaagcaggctcgcgaggcctggtacggtgcgcttgtggaaagcgggcgcatgccggcggcgaacatccatgcgatgccggccgatacccgcggcgccgaggagatcgccgccgcctcccccgaacagaccgatgcggtgctggccgaggccgccgcggagtaccagcgcgagctcatcgagcagttgggcgagaatccggcattggatatcgcgatgttcggcatggggccggacgcgcatttcgcgtccctgttccccgaccacggcgaggccgagatcgacgacccgcacgtgctggtcgcaggcgtgcgcgattcgccgaaaccgccgccgctgcgcctgacattgaccgtgccgatgatcgcccggtcgaagcatacgtgggtgttcacctccgaagagcgtaaggccggcgcggtcaaggccgccttcgcccagcgcaacaacccgcatgccccaagctcctacgccgatggcgaggaactgctctggctcattgacgagggtgccgcttccaagttgtgaggttcatccgaaacaggtaacagggggtgtcccgcgactcatgccgtgagacacccctttttttgagtgttgattgattgttgagtgtcgttttgacgcaggttcccgctggactgcagcttcgtaggcggtttcgcgtttccgtaggcggttgccccaagtatcggggtcatggaaaaggccggtttccggccttttccgcagcaggctcccaagaccaaccacctatggaacgcaaaaaccacctacggaatcccaatccgccgcctatttcgccccatagcttccgaaaacctctcggaaggaggttagacgatggcattagactcccctagaaacgcaaatgggatgcatcacaaccacaagtaccattcgttctgcttacggagcgacactatgctccgtcaatgcaacggtacggcaatatcgcagctcagtaatatgcatatgccagaggtcttgcaatggaacacatcgcaagacctctggcatatccgccctgacacagaggcaaggaaaagatcaggcttcgatctcttcgcggcccggctcggcccacagggtgtggaacgcgcccggctggtccacgcgctggtaggtgtgggcgccgaagtagtcgcgctggccctggatgagggcggccggcagacgcttggaacgcaggccgtcgaagtaggacagcgacgaggcgaacgccggggtcggcagaccgttgatggcggcctgggcgaccacgttgcgccaggacttctcggcgttttcgatggcgttcttgaagtacggggcgaacagcagtgacacgttggcctcgccggattcgaacgcttcggaaatgcggttgaggaacttcgcgcggatgatgcagccgccacgccagatgcgtgccacggcggcgaggtcgatgtcccagccgtattccttggcggcggtggtgatctcgttgaagccctgtgcgtaggcgacgatcttggaagcgtagagggcctgacggatgtcttcgatgaaggccttcttctcgtcgtcgttcaggttgagcttgccgtcggggccggcgaagccctgcttctgggcttcctcacgcaggtcggcttcggaggacaggccgcgggcgaacacggcttcggcgatgccggtgaccggcacggcgagggacagtgcggtctgcacggtccaggtgccggtgcccttcatgccggcgtggtcgacgatgaggtcgacgagcggcttgccggtcttcttgtcgacctggtgcagcacttcggcggtgatttcaatgaggtaggagtcgagttcggtcttgttccactcctcgaacacgtcgccgatctcggccggggtcatgcccaggccgcggcgcatgaggtcgtagctttcggcaatgagctgcatgtcggagtattcgatgccgttgtgcaccatcttgacgaagtggccggcaccgttgagtccgatgtgggtgacgcacggttcgccttcggccttggccgcgatggattcgaagatcggcttgagggtcttccaggattcctcggaaccacccggcatcatggacggaccaagcagggcgccttcctcgccaccggacacgccgcagccgacgaagtgcaggccgcgggcgctgatttccttttcgcggcggatggtgtccgggaagtaggcgttgccggcgtcgacgatgatgtcacccggctccatcaggtcggcgagcgcgttgatcatggcgtcggtcggctcaccggccttgaccatgatgatggcggtgcgcggcttgacgaggctgtccacgaattcctcaagcgtcttcgccggatagaactcgccttcgccgccatgctcgttcatgagcttttcggtacgggcgtaggtgcggttgaacacggccaccttgttgccgtggtgagcgagattgcgtgcgaggctgccgcccatggcagccagaccgacgacgccgacgtttgcttcagctgacatactgttccctttcatggagaaacgtagtactttttatgaaccttccccagtgtagccccgagcgcacccaaagcgacggcccatctcagggatgacgggccgtcaaccggtcgcatggtttcagttcgttttcgtaggcacgatggtgcgtacgaatcgcatggcttcggctggggtgagcgacggcacgtaggcctgcgcgacggcaagcgagatctgcggcagtttcgccggatccggatagcagatgtacactttggcttcatccggatggaacttgagtttgaagcggaacagggagtggaatccgtaagccggttccatgatgtcggccaccatctgcagcacgtggtcgagtacggcgctctccccctgttcgtggccttcgccgctcatgccggcaagtggcgccgcggacaggctcatgaatcgcacttcgccttcgtcgcgcagccgttcggccatgcgggcgatgaggaattccatgatgccgttgacgctgtcggtacggtgacgcatgaagtcgagcgtccatccgaccactttgccgttctcataggtcggcagccagctggtgacgcccagcaccttaccgtccgtgtccaccgcgtacagcagtttgacgcgtggatcgaccagctcgtccacaccacccagggtgaagcccatttcaggcagggccttctcgccggcccattgcgtggagatctcacggatctgcgtctgcacggagaacggcgattccttgaatgtggcgagcacgtcggtgatgccgtcgcgcttggctttgttgatggcggtgcgtacgtcctgccatttcttgccgcgcgtctgccatgcggccgggtcgatcaccatttcggtgccgacgtcgagcgcgttccaaccggcggagaccaactcgtcacgttgttcggcgtgcacgctgtagaacaccggtgtcagggaacgttgggtgcagaagtcggcgaacgcatgcagatcgtcctcatattcgtctgggtcgccgaaaggtccggtgacggtcaacgcgatgccgtacgacacgcggtaggcgatggcggaacggccggtggcggagaaccagtaatcgttgcctttccaagtggccatgaacgacatggattcgccgccgagtccgatgatctcgtccacgcggtgacggtacgcgtcgttgatcatggaacggtcacgcaggccaccccatgtgcagcacagcgcgaccagccaaaacatcggtccgacgtactggtagacgatttcggaaagcagtccgaccggcacgaacgccggttccacgccacttagcaggccaatcggcagcaaacgctgcacgtagtctgcgatcagatcgaccagcagcggcgtttcgttgaagccggacggcatggacaggccgtagccgacgtacagcaatcccagtaatacgaatgcggcgaacgtgatggcgataccgcgcagcacggtctcgcttttcgtgcgaatggtgaaacatgcgcggaacaggatgatgatgacgatgcacagcagcggcaacgccatcgtggccagcatcgcgtggaatgcgccgtgccgttgcaatgcggatatcgcatccatgtatgcaccggcgtcggagccgtccacgtaggacagcggaatagccacatagaacaccgtcgatagcgcaatggtgcatgcgttgaacacgatgctgagcgtggctgcgagatgacggcctcgatacagaccccaggcgatgagcagcagcatcagcgtcggcatgatggataccagccagttgccgggcatggtgaaacgcatcatgcggtattgcgtgaagcagtccgtatgcgaggcgccgctgaggcagtcgaccacatgtccggtgtcgaagtcggtggagccggtcaacagtccgaacatggacagcaggccgaacgattggcgtgacgagacggcgacgagcgagccgatggcctgcacgcccgcgacgatgccgataagccgacgcatttcgtagatggcgccatgccggtattcgtcgccatgcgtgcaggaggccatcagatagccgagcacgtggccaatcaccgaagtggcaagcaggcagtagtcgctcacctcgcctcggtagaggaacatgatgagcacgaccgcatagccgatcacgcggatacggcggcgccacagcatggttgtgaacgcgctgacgcacataagggtgccggcgacgagaatcagcggaccaaggatggcgccatcatgcgagatcgcatgccattgggggctgcgcccgtcggatagggagcacagtcccatgcccaaggccacgccacccagtgtggtgatgacggacacccatgcggttttgattttgccgatcaccgattcggccaggccgaacgcaaccagcatgagcggaacgtcgatgagcagacggcccagattcggcacgtacagcatggatatcggcgcggtgtaccagcggccgcgtgcgagcgcttcgaaacttactttggccaggctcggcgggaacggctgacgtatgagcgcgcacacgatctgcgtgcccacgttgatgaggatgacgaacagcacgaggcagacggtgagcaggtgtcgtctgatccatccggccagatcggcgagcagcgcgcggaagccgaacagtggtttcgcgggtgatgcctcggctggtttagcaggcgcggtttgcgtttgagtcatttctttccttttctgggattctcaggcttgcgggtttgtgttcaggatcgtcatatcgtgatgcgtttgagattcggatagtcggataagttcgggttcgcaccatccagtccggtgtcgtggccgaatacggcgagcccgtaacgcagcacgtcctgcacggcgtgccagtcgtgtgcgttgccggacgattcgacggcggcgacgcgcatgccggctttcgccgcgaccggcgcgattgttttgacgttgcgtattgaggtggtgtccttctcccccgcgcctatgatgagcatctgatgggtgggcgtgtggttgcggatggcgttgaccggcacttggttctcataggctgtggtgtcgccgtcgaagaaccggtcgatcatttcctgtcggctgccgttggtcggtttgatttcgctgtcggtgggaatcatggtgccaaacaggtcgggatggttcacgccgatctgcagcgaacatgtggcgccttgcgagaatccggcgatggcccaatccttggcatcctgtgcggcgggcaggttggttttcacccagtcgaccacgtcctgcgtcaggtaggtcagcgcattgccgtacaccttcgaatccacgcatagcgtgttgtgcgaatcggcgccaagctgatcggctgcgatgacgattggggcgagtccgtcgtgggttttcgcatatccgtccatcatggtttggatgccgccggcttggaagacgcgtcccggactgcccggctgcccgctcagcatgaggacgaccggcagggccggcttgcgtttcgagtcggccaatgccgccggaggcaggtagacgagggctttgcgtgcttcaaactgcgatttcgtggccggaatgtcgattttgttgacggttccgttcgccggaatattgcggatcgtgccgttggcggcctgtttgcgccactgtgcgacggtgatgaggtccttgcgtttggccagtccggtcagatcagcttggctgtaggaatcctcgccgaacagcgagccgatggtggcgtattcgccgtacgattggtcgatgccgatcgccgcggccagtatcgcgaatacggtcaagatggccgcggccacgcgcatcatgcccctgctcaacacgatatgcgcgatggcgaaaccagcgatggcgaaaccagccgccacccaagccatcacacgggatcccaatccgacgccgaacaccacgaacacgtcggacagcagccaagctaccacatagccgatcattccggacacggccgcaacgccgatcggcagcacggtagccagtatgcgtccgtcccgtttcgaaacggccgcgctgaccagcagggttacggacagcactgcgacgacggcgaacgccgccgccggaaaccagcctccgaccaggcttatgttcataagccactgacgcatatttcccatccccaacatataggttttccttcaacttgacagttgtagtacgcaaaataacgggcacgcgtcatccttatggctgatttcgcctcaaaactcagggaaaaccctgaaaccgccgtgaaccgttcgctattggcgtatggttttggctatgacatacgtattcgaagcatcgaacgtacgctgttcgattatggtcgacggcgaacgccgcaccatattctccggattgtccttcgccatcgagcctggcgaaatcgtggacttggtcggaccgtccggcgcaggcaagagctcgctgctgaccgctttcgcacggctcaatccgcgcgcgtcaggcgatttacggttggatggccgttccgccgacgatttcaccccgcagcagtggcgcgcgcaggtcgcgtacctgccgcagaagccggtgctgttgggcgagacggtggcgcaggcgattcgtctgccgttcacgcttgccatacgccagtcggcgagaacgaagcaggggccgcgcagaatctcccccaccgatgcgttgccggacggcagaatccgtgaaaccttggacaatatgggctgtgccgacatcgatctgaaccgtccgccacacgacttgtccggcggtcaggcggcgcgcgtgagccttgcgcgcacgttgctgacccgtccgaaggtgctgctcgccgacgaagtggacgccggattggatgacgacaacgccgacaaggtggcgcgtatcctcgccaaagcggcggcggacggcatggcgatcgttcgtatccggcaccggccgccggatggccgtgccacacgtgtcatgcgtcttgccgatggcacgctcacgcagtccggcaacgccgaagcggacggtactgcgacgggtagtacttcgacgggtaacacggtagaagggagcgtcgcatgaacggcaactactatgcgatcgacatctggggtctcatcgccgcgctggtgatggtggccatcgcggccggcatctccgaaatcatgcgcatgggtgtgggacgtacgttgctgtggtcggcatgccgagctttgctgcaattgtgcgcgatgggcttcattatggagtacgtcatccgttcgaacaatccgtggctggtgctgctgctggtggcgttcatgctcatcgcggccgtgcagatcaccctttcgcgcgcgaagggtgtgccgaagggactggccggaccggtgttcctcagcctggtcgtgaccatgctcattatgatttcgctggtcaccgagctcattatccgcccgaaaccatggtatgcgccgcaattggtggtgccgctgaccggcatgctgctgggcaacaccgtttcggcattggctgtgggattgagccggttcttcgaaagcatgaaggaacgtcgcgatgaagtggatacgctgctcgctttgggcgccaccacgtgggaggcggcacgtccaagtatcgtctcgtcgatccgtctgggattgctgcccaccaccgcgtcgctcgcctccgccggcattgtgacggtgccgggcatgatggccggtcagatcatcgccggcggcaaccccatcgacgcagcgaaataccagttcatgattctcgccaccatcgcggcgcttacgctgctggcggacagcatcatcatgctgatggtctataaacgttgcttcaccacgctcgaccagtatcagccggtcaacggctgatactgcgatatcccgtatagaaaaagccgttcattccttgcgattgctggaatgaacggctttttgcttgaccgttgacgtacgtcagcgggagcggaacggcgccttgtggatcttcgcatgcttgcggtacggcttaccctgcctttcgcccgcatgcttgtcgtggcgttctccgtgaccgccacgacgaccggaatcgccatacttggcttccatgcgacggtcataacgcttcgcgtcctcgccacgctcgtcatgaatcacgcggatttccttgcgatggatgcgtttgccgccctgacggcggtcgtcgcatccgtcgcggttcctgcggtattggcgatcgtcctcgtaacggcgttcggcacgggcttcggccttgcgctgcttcttggtcggcgcgccctgctttttcgcatactgctttttgccgggcttcctatcggattggccacgctgatcggaacgctcgtcggagcgccgcttgcgattgtcggttccacgctgttcgccggcttcggcacgctgctgctcatgcagccgcgcgtacttttcgcgacgcttgttgttgcgcttctcctcgtgcttctcgcgcttctcctcttggatttcaggatgttcccaacgatgctcgcgtgcctcgtattcgcggttgtcgcggccttcgaacttggcggcgcgacgttcggcgcgattctgtttcggttcgaaacgctgctcgcgttcggcgacttcggcgcgctcctcacgtcccttgcgattcgcgcggtccttgcgttcggacttgaacggcttgccgcccttgtccttgccccggtccttgttgcgtccgccggaacggttgcgtccggagcgcccgccgttttccgcggaaccgtcgccgaccttgccatgcttcctgcgacgcggattgcccgccggctgggactgctcaagcgtccaaccgaaacgcggttcggccggctcgcccaccaattccaacacttccggggaatcgtgggtcacttcgatcggcttgaccttcagtccggcctcatgcagcatgcggcgggtgcggcggcgctggttcggcagcacgatggtcaccacatcaccggaatggccggctcgcgcggtacgtccggagcggtgaaggaacgatttcgggtcctccggaggctccacctgcaccacgagctccacgccggacacgtcgatgccgcgggcggccacatcggtggcgaccatgacgttcacgtcgccggattcgaaggctgcgagattgcggtcacgctggttctggctcaggttgccgtgcagctcggccgccggaatgccgttcttcgtcaggtccttggcgagcttctgggtctggaatttggtgcgggtgaacaggatgcggcgtcccttgccggaagcgagggtgcggaccagctcatgacggtcaccctgcgtggtttcgaacacgtggtgggtcatttcgtcgacggccgcggtggcggagtcgacgctgtggatcttaggatcggtgaggaacgtgttcaccacctcgtcgacgccatggtcgagggtggcggagaacagcatgatctgcgcgtcgaacgacacttggccgagcaggcgcttgaccggcggcaggaagcccatgtcggccatttcgtcggcttcgtcgatcacggccacttcgaccttctccaaggtcagcgcatgctgttcgagcaggtcctcaagacggcccgggcatgcgacgacgatatcggcgccggcccttagatcgcggatctggcgggcgtagcgcacaccgccatacacggtggtggtggtcatgccgtacatctgcgcgagcggcatcagcacgtcgttgatctggttggccagctcacgggtcggagcgagcaccagaccgcgcgggtgcggcaggaaatcgtcggcgcgccgttcctcggcatgccccttgcgcacctgttccacctcatggcggaactggctcatgttctcgtactcgtcggcgtcgacctcacccagtcgcgcgaccagcggaatcgagaacgccagggtcttgccggagccggtacggcctcggccgagaatgtcacgaccggccagggaatcgggaagggtgtcggcctggatcgggaaagcggttttcttgccatcggccgcgagcacgcgtaccaacgggccgggaacgccgagttcggcgaacgtctgggggcgttcctcctcctcgcccgcctcatcgaaatcggcggcgagggcatcttcattttcaatcacagcggtatcgggcacaatggcctttcatgtcaaacattgcgcacgttgcgcaaacctgttaacagtagcccatgcccgatacttttgccttggctgtgactggtggccgacgctaccggtagttgcgttcgatgaggatgtcggaaaccgtcagattcgcgtcgttgacgaggttgaacagcaccacttcggcgagttcggcagcactcatgaaggaatgctgcttttccaacgatacgtaatcatggctatcatggtagaagtcggtgtcgatgccgcccggatacacacccacaaccttcacactggttcccttgtaggccgccttgaggctcgtcgtataccccttctcaccccacttggtggcgcagtaaacggattcgttggcgttgccgcgtgtggcggcggtggacatgacattggcgattttgaggtcctgctcgccgtcggccttcaatgtttcgacgctccacagaatcatgcctttgagccccttaaggcacttgtccacgtcggcggcctcgtagtcgaccggctttttgaacgacggctgtcccgcgttgttgatgagcaggtcgatgtggccgatctccttgatggccgcgacggagtccttcacgaacgcctcgtcgctgatgtcgccgacgaaggcgcggtattcgtccgcgccgaacgtgcgggacagttcctcctgacgggccgtgttgaaatcgatgccggccacgaaccagcctttgccgatcagctgacgtgccagctcatatcccaagccaagcgcggaaccggtcacaatcgcgattttctttcctgccgcagtgctcatgttgtctcctttgccacattgcgcaatcgcttatagataccatcataaaacgtatgcgacgcaacacgtcaatcgattgacgaaaacggcaatgaaaaacgcccgccgacctttttggccgacgggcgttgaactagccagcgtgagatgcgatccgttacaggatgtccggatcgtccttggcgatggtgccggtcgccttgccgatggccttcaggccgtggtaggcgacgaggatgacgacggtgccgatggcgatgccgttgaaggagatgccgttgaaggcgaactcgaactggccgacggcgatgatcatggtgatggcggccaccatgacgttgaccggcttgtcgaagttgaccttgttctcaacccagatgcggatgccgaccatgccgatcatgccgtacagcagggtggtcacgccgccgagcacgccggcggggatggtgttgatgatggcgccgaacttcgggcacagcgacaggatcagcgcgaacgcggcggcgcaccagtatgcggcggtcgagtagaccttggtggcggccatcacgccgatgttctcgccgtaggtggtggtgccggagccgccgccgaaaccggcgatggtggtgccgagaccgtcggcgaacagcgcggtgccgatctggtcgtcatagtcgcggccggtcatctgggagacggacttgacgtggccgacgttttcggcaacgagtacgagcacgaccgggatgaacatcggcaggatggtgaagtcgacctgcggcagacggaattccggcagaccgacccatgcggccttgccgatggctgagaagtcgacctggccacggaagcaggcgtacgcgtagccgatgatcacgccgatgaggatgttgagtcggccgagcagacctttgaacagcaccgcgacgagcagcaccgcgacgagggtgacgatggcggtgtcgggagcgactttgaagttgttccacacgctcggagccaggttgaagccgatgatggccacgatggcgccgttgacgaccggcggcatgatgatgtcgatccacttggcgcccgcgtaatggacgagcacaccgatcagggccagcaggatgccggtgaccatgatgccgaaggatgcgacggcgaggcccttgtgggcgctggcgacggccgcgatcggggcgatgaagccgaaggacgagcccaggtagctcggcagcatgttcttgttgatcagcaggaacagcgcggtcgacatggccgtgaagaacagggtggtggacgggtcgaaaccggtcagaatcggcaccaggaacgtggcgccgaacatggcgatgacgtgctgcgcgccgatttccgcggtgcgcggccaggtcagcctctcgtcaggttcgacgacctcgccgggcttcagcgttttgccgtcaccgtggagcttccacgtgaacaggcccgcgattggattggacatgtgattgtctcctaactctcttacggcacgaaatacaacggtcgtgccgtacaatcacacgccattgtaatggcaccgcagatacgagaggcctcaacgcaagtagggggcaccaatcgcaagcagacaagacagatgaatcgtatatccgtggtatgtcacaggtgacggtcaacggcgtgcaccacgtccaccagatcgccgttcgacagaacgggacgtttgaattcacgccattcgtccactttcaccacccaacggccatccgtctcgtcaagcaccggacgcgccgtctgctcccaacggaaccgcttatgtgtacgcccggttgccggatcgcgacgcgaataatggaagcatgtgcagttggtgatcttccattcgtcggcggccgctcgatgcatgaactcctcgtcggacaggtcctccaacgtgagcatcaacgccagcatgaggtcgccatggctgaccatcaccacggattccgcatccgacttgcggttcagggacgtgagcaggttgtgcacgcggttctcggccacgtcggcgatggactcgcccgccggcggacgccagtacagcggatcggtgttcttgaacatccagttgcgcgcgtagttggttttgaaatcgtccttcgtgatggtgttgatctcaccccaggagcgttcgcgcagcacgcgagtctcctcccatttcgccttaggcagggccatcgtggccgccgtctcacgcgtgcgcacgtacggcgaaacgaggtagcggtcgaacagcggctgctgcgcgacgagccaacggccgatgcagtcggcctgcttgcgtccggtggcggtgagcctccacgaacggtccggcacggtgacgttgtcctgcgtatacagcgagttgtcaccctgttcgccggcgctgatgatgacgttcgcctccgactcgccatgtcggatcacatacagatcaaggggcattcccatattcgtttattccttcgctttcatccacatcctgcgcgcacgttccttgttccgccgttcattcggccggtggcgcgcatcatcattgaatgcttccaccgtagctgattcgcgcgtgtttcgcacgcacggacacgtcgatttcacgattggcacacccgaatttcgcggtgccgtcaccggcggttcaccgcaaccggcgtggtagacgccgtgatcgcaatcactccggccagatgccgctctgcgcgtacttggtgcggtactcccccggcgtcatgccggaatgttttttgaacaccttcgagaagtggctttgcgaccggtatgcgaggatctgggcgatctcgtcgaagctgtattccgagtatttgagcatgttctcggccgcttccatacgcttgtcggtgatgtattgcgatatggccgtgcccgtttcgcgtttgaacagctccgacagatacgtgggattcagatgcacatgctcggcgaggatgggcacggtgattttctcatgcagatggtagtggatgtagtccaggcattcgttgacggctttggaatgtgtttccgccttctgcatgtcggccatggcccatgtgaagaatgtcatcatgtcggtgtgcaggcggcgcacgtcgtcgggcgttttgcagttttccaggttctggatgtacaggtcggaggcgttgtaggcgtcctcctcgtccataccgccttcgatggcgaaacgtgtggcgagcgtgatggtggtgacgaaccggtatttcgcgtttttgagtggatcgtccgacaggtagccgtacagtccggagtcccacagacgtgtgctttcggcgatggcgttgatgtcgccggaacgcatcatgtcgtattgcttcatttcctcgacgtaccggtggtgccggacgcggtcctccctggaaagaaagtccaggtatctcagcttcgcttcgtcaacaaccgccatacttctcccactgttttatactgccgtccgctatttgcgatcgtccagatcgaatcctccttcaaggataaagcttttcagcaacttggtggcgagaagattcgcagtgaattgggtgacagggctatccggcttgctgaagaacgcctttgccaaaggcttgttgatggacgctttcaactggtcgaaccgaccaaattcgttcaacgtcgcctcggtaagatcaagccgcatcatctcgttgagcaaagctccatccacgccaaacgccttggtgatttgctccacctggctgttcttggcgctgttcgcgtaatacgtgatgtagtcgcgcagcgtcttgccttcctccaactcgatttcgccacgttccacatcatgcatgaacagttcggcataccgttgttcctcttgactgagcgaagcaaacgacttatgcaattcctcctcggctgatgccaacagggccggatcgcctccgccaagcgccttgagccatttggtgaagttggcgttcatgtaatccgtatcaatcaatcctgtatctatctcagtgatatgaccgtcaagttcatatggtgcttccggaccgctgccggggccttcgccgctgctgaacatctccttatatcgctgtacaagaatcagatatgtccgttcatcaagcttcggccgcacaacctccacggatccatcgtcataggtgacggaatactcctgctgcccccaagtgaatccttgcactttggcggattccaggaaatcattgagttccacgaacagttttgcgaacttgcggcatgcctccaccgattccggcagtcgcatgaaatcttccacgcctccggcactgaacacggaagcgatctcttcgaaacgcgcatccatcaggcgcacgttttccggcagtttctgcacgaacagatcgagcggcttgtctccggaatacagttttaccgccgcttcgatataccccttcatggtgtgtggcttgcggtagtagcgaatagttccgaaaggcttgtcggggccgaacagtcgattcgtacgactgaacgcctggatgatgttctcatagtcgatgattttgtcgaggtacagcgtgttgacccacttggaatcgaaacctgtcagcatctgatcaaccacaatcagcagatccagccgctcctcacggtgctggtcgaccgtcaggtacggacgcttgtgggaaagccgcgcggtgatgtccttcttcatcttcggccatgtggggatgatgaaatccttgtcgaacagttcgttgtaatcgccgatgatttccttaagcgcatcctccttgaggattgcgccgtcggaattgtcgacgttggggtcgaacagcgcggtcacgtgcatctgcggagcacgttccttgaacagatggtaatagctgatcgcctcgggaatggaactcgtggccagcatcgcatggaatttgttgcctctgctcagcaatgggaattggtcgagaatatcctccacgaccttgtcctcatgtggcgtgccttgcgcatactgcgctgcggtcagatagtcctcaatgcctttgacatgttctcctgcctgcgtttccatgggtcccatcggcatttgcttcgggtccatgtaatggtagaacacctcagctttcgccggatccacctgggcttcctcaaccgttgccgctttcgccttctgcaacgcgacagcctgacgaacatccttgtctcggtaggtcaacaccatgtacgggtcgaatccgagcacattgccatcgcggatgccgtcggcgatgctgtatcggtgaaggcaatcgccgaacaccattgatgtggtcgcgcccttcttacggttctcctcatgaatcggagtgcccgtgaaaccgaaatacaacgcgttcgggaaggaatggcgaatatcctgcagcatctcgccgaacgtggaacgatggcattcgtcgataatgaatacgatgcgtttgccggcgagcttcctcacttcctcttcggtgatatgcccctcgcccgctttgatgttgctcattttctggatggaggtgacgatgagcgtgtctttggggtcgatgcttgccagtttcgatttgagcacatccgtgttttccgtgccctgcacatcatcggcatcatccgcgaacgaccggtattccagcagcgactgcgtgcccaattcgacacggtccatgaggaagaccaccttgtcggcatctttcgagccagcgatgagctgcgcagccttgaagctggtcatggttttgcccgagccagtggtgtgccacacataaccgcccggacggcccggcgtgccgcttggcaccggctcatcccatttgcaggtgcgtacacggtcggaaatggcgttcaccgcctggtattggtagctgcgtagcactttgaggcatccgtctgcggaatcggcgaccgtatagaacccgatgagctggtgtgccatgggaatggatagcagatcagatgtgaaacgcttccattcatcctgcccgacatggttgttcgccgctatgggctcgttgttgaagtcagcccagtggaagaagtagttgctgttgaaatcgccttcaccgggattggcgaagtacacggcatcatccggattcatggccacgaaaacctgcacgagtcggaacagcccggtgaacacgccttcatgcgcgtatttggcgatttgattggtggcctggcttacgggaatgccgcttttcttcagttcaatatggatgaccggcattccgttgataagcaggcaaacgtctcccctgcgatcgttcagcatcttgcttttcgctggatacatcggctgtcttgcaatttggtagcggctttgcccggcggcgatttcctggcgatcgtagatcttcagactgatttccttgccgaaatgtgctgtgtctgcgggattgtcacgtttgatggacacggttttgccgttgatgaaagagttcaacgccaatggcgtgcgcaatgtttcgatctgttcaaggatctgcgccatctcacccttggtaaggcgctgcccgttcaggcgatcgatgcctttgttgttgtcgaataggatgttggcccagttatcgatgagatcctgttcagtcgggtattccaacacaccatcggtccacccgtggcgtttcagcaccgcgaccagatcgtcttcgaaatccgattccttatcgtagaacatgtttcatctccccgaatgcgccgtcactttctgagcccaatcttacgagcgcaacccctaacatccaagaagcaacaccacaatacttacgctgatgaagggtgatgagcgagtccagacgatcgagggcaataccaattcgaaataagaaaattgacgatcgccttataaggaaaggcgcatcgcacaaaaacctcaccgtccttcaaggcctcccggccactcgcaaggagcggacgatgaactggcaatcattgactataaagaagtagtacaaatacgctcttgagttctcaaaccaccaccgcaccagcaagccaccccaatctccaggagcgaggccgccgtgctgagcagcaagagataaacctacacgagaacccgcaatcgcgcaacccgcagggcgcaatgaagcacggaaccgttggaaatccaacgttccatcggcgtgtcgaaaaccgggaaaatgcgtccggaaagcgccgataccatcagaatagaccccgaaaaccacaaccaggtgaacgcaaaaccaatagctgtcggcgtgtcgaccatcaacatggtcaaccacatccgcattttgcggtccaaccacggttctcgcataacaaaagccggaagctccgtggttagcggaggctcccggctttgttgttcggctactggatattcagctttggtcattcgaatcgctgaccattgctaatgctgcctgtagccgactgttttcagttattacttcagttatcgctgatcaggcagctcactcggcattggccgggccggcggcaaccggttctgcagccgactcgaccgtggcgacggccttcttgcggttcaggtaccgcttgatggccacaatctccaggccgatcacgagcaccgcggtcacgccccaagccacgtacatggcggtcttccagatcggggtggcgaccttcggctcgccattcgcgtactgccagctgttggcggccgtgtacaggatgttgtgcgcggcctgacgcatcgccttcacggaagtggcggacttatcggtgatgtggttggtgatcttcgtggtggcgagcatcgaatcgttgcccgcacgcacttcctgatcggcgttctggtagccgtagccgccgaagtaatcggtcaggacgaaacccttgaagccccactcgccgcgcagcacggtctgcagcaggttgctggaagcgccggcgtaggtgtagccgatgtagttgaaggagctcatcacggcctgggcgccgccttccttcacgctcatctcgaacggcttcagataggtttcacggatggactgctcgttggcccacgtgcacaccatgttggtgcggttggtctcctggtcgttgagtgcgaagtgcttcatgaaggagtacacgcccttggacttggcgccggcgatttcgttggaggccatcgcaccggagagcagggagtcctcggagaagtactcgaaggtacgaccggagaatgccgaacggtggatgttcatggccggagcgtaccaaccagccacgtgcatgtcgtgagccatgtcgccgatcatctcaccgaactgcttggcgagatcacggttccaggtgcaggcgaacgcggtggaggccgggaagccgatggagccaacaccggtgaagttgttgttcagcgaggccgggccgtcggcgtcggtcagctggatcttgccgacggacttcacagccggagtgccgtaaccaccattggcgatcaggttgtccatatcgtcgaaggtgagctggtcgagcagcttgtcccaatcggcgtcgtcataatccttgccatacatctggtacagcttcaggccattcttggcaccggtggtcggcatctcgtccgaatcgttgtcatacttcttcggatcgtagttgctgttgttggtgaactcggccttggcttcgtcgctcatcgagaagttggtcggagcggcggtggccttggcatagttcgcgaagtggcccgcgcgagacaggtacgtcacgtcgccggcggcgtaatcgaactcgttggtggcggccacggcatcgccgttatgggtgttcgagtcggaattgtaggtgacggtgtccttcacggtgaccttctgatggtcgatcacgtggtgcgaatcggactggatggagatgtcgtaatcgccctgctccagcacgtacgccttagcgtccttctggtcgtaggaggccatgtcgtcatcgtcgaactcgatcttcacggtctgggaagcgcccggctcgagcttcttggtcttttcgaacgcaaccaggttcttggatgccttctcgatgccgccatcggtgtacggcgggttgtagtagacctcgaccacgtccttgccggccttatcgccggtgttggtgacggtcacatcgaacgagatcttgccgttcttgtaggagaccttgcccatctcctgcttgaacgtcgtgtaggacaggccgtagccgaacgggaacatgacggtgtcgtcgtagttgatcagaccttcgtcggcggcggtctcatagaacttgtagccaacgtagatgccttcgacgtagttgacgaacgtcggggtcaccgtgaccttgtcgccactgaagcccatgtaggaagcagcgagatcatccgcattgtcgtaagtgaacttgccgttcgtgccgacggacgaagcgttgccggcggcagtgccatcggtgttgttgaacacagcggtcttggtcaggtccttcacgaacgtgtcggaggtcttgccggacggattcacatcgccggcgagcacctcccagtgcggagaagccggtctggccggccggcgggcaccacagcacggacttgatctgcggatactgggacaggaagtcgaactggaacgcgttggcgccgttgtagacgagcgtcaccttcttgaagttcttggtgaccaggtcgatcatgtcgcgctcggtctgggacagctgcaggaagtgctcgccatccttgaaatcttcgtagtccttggaattgttgttgtaggtgatgcccttcgccttcatgttcgtcggcaggtcagcgccttcgccgccgacgcgggtgatggtgatgacggcttcgtcggagaagtccttggcgtcggagatcagcttgtcggaatactgcttggccggaacctcaggcagggtccaatcctgcgaccacatagccaccatcgggcggtccttgcggtagtcggtgtacagcttggtcagctcggaattggtttcgatgccggcctgcttcatgccgtcaagcatggaaacggtctcgtactggtcggacatggagccggagccggtgccgccgtaaaccgggttggtggagccccaaccgaacacgttgaccttcttgttggacagcggcaggttggaatcgtcgttcttcagcatggtgatggcttccgactgcacttccttggccagctcgttggctttggaaacggtggtgtcggacagcatgtacttggtggtggtcgcgttgttgagcagcgtggaaagcgggccggtcagcatcatggacacggccacgacgatgccgacaagcgccaccagccaggattcggaatggacgatcttacgggtcgccacgtccttgaccgtcttcttgttgacggcaaaagtgataatcagcgcgagcgcgaacagcacgccaatcgcaataaggtacggcgtcaatgagccgatgacgttcataacgtcagccatgttgatttgcagcatggtctgcctcctccttgattctcataaccaaacgacacgtaggctccgatgcctttatcggaaccgcgaaaccattcaacactgccccgcatctcatggtttcggtgaagtggctgcagatgcgtgcggcaagtgaagacacttcttcatgtcgatgattcgatttcatcagacttcaacgtgcggcacatggcgttttccccagcctgtcaattcgcgtgcataatctgcacgccaagtacgatggaagtatgagcgacttaagcgcattgaatctggaagcaggcagcctggttggcggctacacgttgatttcccggcttggttcgggtgccatgggctcggtatggcgtgtgcgggacgatggcggccatcaatatgcgatgaagattttgcgcgattccctctccgacgacgattccccgcagcagcagcgcgacgagttgaccgcacgcgagcgcctgcgcagggaggcgatggcgttgcagaaggtgcggcatccgggcgtgtgcggcattgtggatatggaacttgacgacgcgttggcttttattgtgaccgagttgatcgaaggcaagaatctgcgtgaggatgtgcgcgtcaatggccgatatgtgggcgacgatttggaacggctggcacgcaagctgattgaggcggtgcgtgccgtgcatgcggccggcatcgtgcaccgcgatatcaagccgacgaatgtgatggtgtcgagcaccggcccggtattggtggatttcggcatcgctatgggcgaaggcgaaagccatgtgacgcgtaccggtctggtgatgggcacgccggggttcatcgcgccggaaatcattgatggcgcggaatcggatgaaatgaccgattggtggtcggtggcgagcgtattggcgttcgccgctacgggtgagccggtgttcggcacgaagccgatgatgaccgtgttggaacgtgcggcggcaggcagcgccaatcttgcgggacttcctgcgggcacgatggccgcgttccgttcggcgcttaatccggatcggacgaagcggtgcacgccggacgatttgctgcaggcgatcgccgtggatgcgttgaatccgcaggcgtgggttgcggccgacaatggtggcgcagcggatggcgatacggaggcgatgcccccttttgttgaatcgcccgacaatccgcgcacgttgtggcaatcgcaggacgacataaccggcgaaaacgccatcggcacgcgcacgatgccaaggctcagcgaagcaacgcaggcgatcgggcagcccgatgtgagcgcaactcaagtaatcgggaaacaagtgaccagccaatccgacgcgagcgcaacgcaggtgatcgcacctgttgacgatgccgagaccagcgtgctttccgacgcacttcccaacgtgggcagcacgcgggcgatgccgacaggcacgcaggtaatgccgcaatccatgccgtcaacacaaatgctgccggcccagaacgcatggaatccagcggaagcgccgacgcaagtcgacccgaccatcaaacccgcgttgcaacgcatcgccatgcggcagccaccgtccgtcataccgcaggccacggtggccgcggcgcagcaatcgcccgcaatgtcattcccgccggtacccggtatggatgggccgaacgttgcggaagcacccaatcccgccgatgtgaagcgtggcgcgatgttgggccggggcatgctcccctgcgcgctgatggcgattcccgtggccgtctgcggactgttctcactgtggacggcgatggcagccgcgttgctgttcgcctgtgcgctggccactatcggattcaacacggaggcgcagctcgagcgcgaaggcaaacgtggcggcgagaagaaaagttccgactggctgctgcgattggcgggactgccctggcacatcgtgaagggcttcggcgtcgccatcgtgcggacgctgatcatgttggccgtggccgcgctgggtttgtcgctcaccacggtcgtgctgcagcttccgtatgccgtgatggatacgtggatatttggattgacgattccgatgccgacgctgcttggcggtccgctttccgaaagcgggctggcgcaggctgcgttctgcgcgatcggctggcttgtggccgtggccgctccgggcgcgatcgtactgcgattgggcggcggcgcactgcgtaaacagccgtatctgcgccacttgagcgagctgccgacgcaatcgcaaggcaatacggaattcccggcgaatcgatagcaaggcatcgctagtatggtgcccagcataacaacgtgaggtcgaaaggaatatcgatggcccagaacagcaaggatgcgcagaagcgtaccagccgcgccgagcgtagggccgctgaggccgcggcgatgaaggcgcgcgccgagcagatggagaaggaacgcaagcagcagacgatcatcggcggcatcgtggtggcggtgctggtgattctggtggcgatcggcgcgttcaccgtgtaccacaacatgcataagaaggccgaaacgaaggcttccaccgaaaccgtgcaggaagcgtacacggcgttgcagaaagtgaagaacactccgaagctcgtcgataagaagggcggcctgctgatttccaagaacggctacggcaaggctgtggagggcgcgccgaccgtcgagctctacatggatttcctgtgcccgggctgcggcaacctgcaccgccagttggacgccgacctgcagaagatggtcgatgccggccagatcaatctggacctgcatttcatggcgttcatggaccgttggtccaccgacgagtattccagtcgcgcggcgaacgcggccatctacctggccgagcatgacagcgacccgaaccatctgatctccttcctggagaaggtctacgccgaggatttccagccggaggaaggctccgcatacaagtcggtgagcgacgccaagatcaaggagcagatgatcgccgcgggtgtttccaaggatgttgcggacaaggcgtttggccgcgattatcaggaatggcttgatgcgatcgacacttacacgccgaagcgttccgaactgtggcatcagtccggcagctacaagggcagcatgaccacgccgaccgtgatcatcaacggcaagtattgggatatggaccagctgaccaccgcccagacgacggttaaggacggtctgttggaatcgatcggcctgaaggacagcgaagtcggcgttgccggcaagatgccgtccatcggagccaagaaggggccgatttccgtcaccacgggcgaataaccccttacgggcagccggcgcgtctcaacccgcaatgctaagttgactgcggtggaagcgctggttatgctattcatcgttcctctgttgttttcatagcaaaagaggacatgcctccttagctcagatggccagagcggccgccttgtaagcggcaggtcgtcggttcgatcccgacaggaggctcgaacccgtatgacgggcttggacctcttaccatgggtaagtgctccagaagtcttcccccaacttgagacttctggcaaagcggacgagacgtcccccaacctgtctcgtccgaccgggggcaggacatccccttctctcctgccccctttttatttttcgcttttcgcacctgctttcaaaaatgtggcggtatggataaaaccatcggaaagcacggcgaccgttccagctgagccgttacaataacggcgttgtaggcagcgctgaaaagaggataaatgacgagaaggtggacccctcggagattcgtgacgcttcgtcgtgtccgcgtcatggcatgcgtggcctcattgactttgacttcggcgttggcgtttggtgtgggcgcgcgcaaatccgtggcgttgaccgtcaatggggagaccaccacggtgaccacatatgcgatgagcgtggaccgtctgctgcaggagcagggcgtgaaagtcaaaacgcacgacctggtggaatcgaccagcccgaccagcatgctgaagaaccatgatgtggtgaacgtgcagagcgcataccagaccaccatcaccatcgacggccaggaagtgccgttctggacggtcgcgtccagcgccgagcagttgctggacttcttcaaccaaaacgaaaccgaagcggcgaaaatcaccgtcaatatcagcaacgtctacaacaagctcaccggcggtctcatcatcaaccagaaggggcccgtcaccgtcatcgcggacgggaaaagctcggtggcgccgaacggcaagctgcccgctgcctccattcttgacgccaaaggcatcacgttgggcaaggaggatcgcgtcagcgtcgaaaaggacggcaaaaagaccattctgcgcgtccgccgcgtgacccacggcgaggaaacacgtacgaaggaagtgccgttcggcacgcagaccatcatcgacccgaacctgcagccgggcgaagtcacgatacggcaggaaggcgaaaacggcgaaatccagcagacgtacgccgtcacctacgtggatggcgtgaaggaaagcgagacgctgaccgaagagaagaccacgaaaatcgccatcgacaaagtcattgcggtcggaccggaaaaaactacggacgataccgacaagtccgacaaatccgacaacagcggcaacggcaacagcaacggcgataacggcgattccggcaagacggacgacggcaagaacgattcgggtaagaacgactcgaataagtccgattcgaataagtccgattccgacaaaaccgattcgaacaagtcggattcctcggataagaacaattcgaacaacaactcgaataacaattccaacaacaccgagaaggacgatccggcaccgacccccacaccaacccctgcaccgcagccgactcccgcaccccagcccaaaccgcagcccacgccgcagccgagcaatccttccgcaggctgccgcttgtaccatccttccgcggcacaggcacaggcctacgcttccggcgcggcggcgcagcgcggctggaccggccagaactggacggatctggtcaaactctggaatcgcgaatccggatggagctggagcgcggaaaacgtgtattcgggcgcatacggtattccacaagcgttgccgggcagcaaaatggccacgttcggcgcgaattggaaggacgatgccgccgtgcagatcgactggggtctgagctacatcgcacagcggtacggcagcccgtccgcggcgtggcagcactccgaacagaccggatggtactgatccggctaatcgccaacgattttcgtaccggcatgaacggataatgagggaatgacagaagagggaatgacggaaaacgtgaacgagcatacgcagggccatttgctgggggcggccgacatccgacgcatcgccgccgacgcgggtatcagcccgacgaagaaattcgggcagaatttcgtgattgatccgggaaccgtgcgtcgcatcgtgcgcgaggccggcgtgaccgccgacgaccatgtgctggaagtcggtcccggactgggttcgctgacgctggcgattctggaaaccggcgccacgatgacggctgtggaaatcgacccgccggtcgccgaacgcctgccgaaaaccatcgccgaattcatgccggacgccgtggaccgcttccgtgtggtcaaccgcgacgcactcaccgtcaatccggagaatctgcccgatttcaaggatgacgattccttcacgctggtggccaatctgccgtacaacgtggccacgccgattctgctcaccctgttggaacgtttcgacaatctgggcaccttcctggtgatggtgcagaaggaagtggcggaccgtttgagcgagaagcccggttcgaagatctacggcacgccgagcgtgaagctcgcatggtacggcaccgcggaacgcgtgggcgtcatcggccgcaacgtgttctggccggccccgaacgtcgattccgcgctggtgctgttcaagcgctacccgggcggtcacgcccccgccgcggacaatgcggacggttccgtggtggatcgcgaaaccgtgttccgtttgatcgacgcggctttcgggcagcgccgcaagaccctgcacgccgcattgaagaaaatcgtgccgtccgaagcgttcgagaaggccggcatcgacccgacccgtcgtggcgagacgctcaccatcgacgaattcgtggcgttggcacgcgcgttggatgaggtgttcgcgtcatgagcaccattgattcgcccgccatcggaacggccaccatcaacgccgtgagcgtggactgcccggcgaaaacgaatctgaccctgcatgtgggcccgtcgcatgccgaatggggcggccgtcatgaactcgacaccatctattgcgcggtcggcgtatacgacaccgtcaccgccacgcgcaaagcgccgggaagcggcttctcgctgaatctcgagggcgcgtatctgggcgacctggcctcttccggcagcgatatgcgccgcaaccatgccgtgctggcattgttcgccatggccgaagcgagcggccatgagccggacgtggcgttgaacatcgacaagcgcatccccgtcggcgcgggcatggccggcggttccgccgatgcggcggcgacgattctggcattgaacacgttgtgggatctcgattggccgatcgaacgcctgcaggaagtcgcggccacgctgggcgcggacatgccgttctgtctgaccggcggttacgcgcgcggcaccggtttcggcgaacgcatcgaacagcttgatgacgatggcgatatcgtacgcgatcttacggaacgtgggtttaccggccatctgctggtcggcgcataccgtgcggaactgcgcacgccggaagtgtatgccacattcgatcagatcggtgccggcgatggcgatgagaaccacctgcagaaggcggcggtctccctgcatccgcgtagcggacaggcgatcgaggaagccttgcgtgcgggagccagccaggcgttcgtctccggttccggcccatccgtcatcgcgttcgtgccgacggaggatgcggcggacgccgtgcagcgggcatggcaggacagccgttgcgtcgatcgcatcatcgccacgaacgccccagcccgaccgattgtgcatatcaccgcatgacacatatcaccgcatgacagtaaagttgatggcaattggtttgttcaaaaggaattcgtaaatgacccaggctaacgacgagcgcgccgcgcgcaaagagtacattcgccgccgtcagaagacggtgttcagcatcgtcggagccgtcatggtggtcgccatggtggtgtccctgctgttctttttccatgtcggaggcctgggcaacgtcaagtcggccgccgtacagccgaactacggccagcaggcaccgtgccccatcaaggaagccgacggcagcaaggccaagtatgtggagaatcgcaacatcacgctgcgtgtgctcaacggcacgaagttctccggcttcgccaaggcggtgagcgacgcgttgcagaaccgcgagttcaacccccagacgccggacaactacaccaagaaggtggatcgcacgatgatcgtcttcggcaagaacggcgtgaatcaggcgtacaccgtggcaagcaatttcaccgacgccatgctggttatggacgaccgtcaggaccagctgatcgacgtcatcgtgggcgccacattcgacaatctgcaggatacgaagaaggttcccgccgcaggcaaggcgatcaccggcatccagggctgcgtcgcggtggacaagatgaccgacctgcccaaggcgcccgagcatgatgcggtgaatccgcaaagctgaccgccaatcgaaatcgatataggcaatatgaaaaacccgcgctcccccaatcgggaacgcgggttttcgtattcgagctgttccaagcacactgttccatgcatgcggcgaaaccaccgcatgtcaatcgctattcgctctgctccttgtaccagcgttccagctcggcaacggccacgtcacgctccaccggaccgttatcgaggcggtattccagcatgtgcttgtacgccttgccgaccatcgggcctggttcgatacttagcagctgcatgatctcgtcgccgttgaggtcaggacggatcgcgtcgaagtcttccttttctttcaggtcgcgtacacgctgttccatctcgtccatggccgccgagaacatcatggccttgcgcttgttctgcgtggtcgtgtcggcgcgcgtaaggcggttcagacgctcgtacagcgggccagcgtccttgacgtagcggcggaccgcggaatccgtccacggctcctccacgtagccgtggaagcgcagatgcaggttgaccagctcgctgacgtcctcgaccatgtggtggtcgaaatgcagtgccttcaaacgcttgcgtgtcatcttcgcgccgacggcgtcatgacggtggaagctcaccttgccgcccgcttcgaaacgacgggtcttcggcttgccgatgtcgtgcagcagagccgccagacgcagcgtcaggtccggggccggcaccggaccgtcgggaccggtttcgagggcgacggcgcgttcgatgacgatcatggtgtgttcgaacacgtccttatggcgatggtgctcgtcgatttccagctgcagcgcgggaatttccggcagcacgatgtcggcaagaccagaatcgaccaacgcttcgatgccggcgcgcgggcgatcggacagcagcagcttgaccagttcgtcgcgcacacgttcggcggagacgatttcgatgcgatcgaccatgtcggacagcgcttcggcggtttccggctcgatgcggaagccgagctgcgccacgaaacgcacggcgcgcatcatgcgcaacggatcgtcgtcgaacgactgccgcggatcgacgggggtacgcagcacgcctttggccaaatcgttcgcaccgccgaacggatcgacgaattcgagttccggaacacgcaacgccatcgcgttgacggtgaaatcgcggcgggaaagatcgccttccagcgtgtcgccgtaattgacttccggcttgcgcgagtcggggtcgtacgtgtcggaacggtaggtggtcacctccactttcacctcggtgccgtcctcacgcctgcgcatcgcgccgagcgtgccgaatttgcggcccatatcccagaagccatcatgcccaaaacggcgcagaatatgctcaaactgctcgggacgcgccgatgtgcagaaatccaaatcatgcgatttgcgatgcagcagcaggtcgcggacaggacccccgaccagtgccagttcatagccttccgcagcaaacatacgtcctaattcaatggcctctggccacacttcgaagttcacgccatacctttcagcaccacaagttttccgtttaccagcataccgttaccccacctgcacacagaattgagtatggttggaatcatgattacgcccgcagaccttgcacgcatgcttgcccatgctgcggacgaccatgcccaaaatccgctggaaccggacgaactgctgtacacatcgcagtcggtttcgctgcagcagctgcaacaactacagcaattgcagcagcgcacgatcatcacgccgagcgcgcctacgccggcgatgatgccgcgccggcgcaccgcggatggtccgaccacgttcgcatcgcttgacgcgcaggagctgccggtggtgcgcgagtattcggcgggcgggctggtgttcgacgacaagggtcgcgtggcgatcatcgcacgtcattcacgcagcgggcatttggaatggtgcctgccgaagggacatatcgaaaaaggcgaaacgccgcagcagacggccgtgcgcgaagtgcatgaggaaaccggcattctgggcgaggtggtcgattccatcgccaccatcgactattggttcaccggtaccagccaacgcgtgcacaagctggtgcaccacttcgcgttgcggcagatcggcggcgagctgaccgtcgaaggcgatcccgaccatgaggccgaagacgccatttgggtggattttgctgatttggacgatgtgctgagctatccgaacgaacggaagatagcatggttgtacgcaaggaaactcaacagacaggcgtaatagtgaatcaatccgcacaacggcacgtttcgcgtggccttcgcgcgttatcatccatcctcgccatggtattgaccatggcgttgatgttgttgtacgcacccacgccatcggcaagggccatggaatcgaccacatcggcggagtcgacggacggtatgttgtccatcaactcttccacggccgtattgacggacatctccggataccatctgaacgccacggtgaccaacacgaccggacaggagattcccgcgggaacgctgacgctggccatgaacgccttctacacgttcgtttcgcgcaacgacatccaggattggtctgaaggcaacgggcgaatccccaccccgcaatccgtgggacaggccgatgtgcccgcgttgcagccgggagccagcgccaacgtgagcatcgacgcggacgcccatcaggaatcgctcgcggccatcaactcttgggggccgaagccggtgctgctgagctattccgccaacggaaccccccttgctcaatcgcatacgttcgtgacgcgcaccggcgcgggactccacacgcccagcacgccggcgctgcacatcaccgtcgcccagccgctggccgccaacgggtggaccaccgacagcaagctgcttggacagctggtcgatgaagggggtatttcctcctcgaaactggcgaaaatcgccatgcccagcaaggatgacgacgcacggctcaaatcgttgcagcagaccttcgccaagcacgacatgctgcaggtcgtaggagatccgacctacctgcaggcgatggcgatgccaacgcgggtcgacggcatcacccagcccgcattgttcgacataaccgcctatagcgccatgaacaacgctccggcctacagcgcagccggcatcaacgaccgtcaatggtccgcagccaaagcccggaaaacctatcaatcggcattgggtgacagcaacgcggacatcaccgcatacgcgtggcagggcaacggcaattggaccctacaagcgttgacgaaggcccgccagcaggggtacggcaccgtcatcgccacgcatgacttcgaagaggacgatgcggctaccgtacgtaccggcaagacggtggtctccaccgatgccggggacatcaccgtgctttccgcgcagaatgtgctttccggcctggcccaaggcaaggcgaccagtgacgatgccaacgccgacagcgagggaaccacggccggcagattggcgcgattcgtcgcgcaaagcgcgttctaccagatggaacagccttatgcggaacgcaacctgctggtctgtctgaacgaggattccgaccccagtgttgtggacgcgctgatgagcgacatcgagcagtcgccgtggctgaacctcaccgatctcgccacgttgaaggatgccgacatctccgaagatgcggccagcatgtcaaccgaccttccccaaacggacggccttaccgatggcatgcgcagcgacgtccagcagactctgagcgcgctggcgaactcatcgagcaacatcaaacgtttcaatacgtcgatcctcgtcaagccgaacggaaaagacgaatccgacgtcaacacctggagcaggcagctgacgaacgcccacaccatcatggccctgcacgcgttgggcggcgagagcccttccagaagcacgatggcggaaggcgcgaaccagctcgcggtcctgctgatcaacggtgtggcgatcacgccgacggaaagcgtgaacgtggtcagcgaaaccgcgaaaatgccggtgaccatcagcaacagccacccgtacccggtaaaggtgaaggtctcgtcgctgaccgattccatgcagatcgtcacgtcccgattcgacaccgtgcaggtgccgccccacggcgaggcacaggtggcgttcaccatccgtgtgtccacgtccggcaccgccaacgccaccatcagcctgttcgacaggaatggtgcagcgtttggagccacgcaggtcacccacatcaccagcgcgctgcagatcagcgacaagagcggtttcgtcatcatcggcttcgccgtgctcttgggcgctgtgggactgtggcgtcaattcaaccgtaagaaggatcccgacgaatgagttcttccgttggccgtaactcactgatcatggcctccggtaccgccgcttcgcgcgtgaccggccaaatccgcaccatcctgcttgcctgggccttgggcaccaccggctatgccgccaacgcctaccaggccggttcgatgattccgcaggtcatctacacactggtttccggcggcatcttcaacgcggtgcttgtgccgcagatcgtgcgcacgctgaaatcgaaggacgccgaaaccaagctcaacaagctcatcacccttgccatcaccttgttgttgggtgtgacgctgctcatggccgttgccacgccgttgttgaccaaactgtatgtcaacggcagcgccgaaaccatggccctcgccacctccttcaccttgtggtgcatgccccagatcttcttctacggcctgtatacggtgatcgggcagattctcgcggcgaaggaccatttcgtcacgtatgcgtggagctcggtcggcgcgaacatcatcagctgcatcggtttcggcgcgttcatcgcgatgttcggcagggccacggaacgtccgctggacttctggacgccgacgaaaatcgcgctgaccgccggcacttggacgcttggcgtggcgttccaggcgctggtgctgttcattcctttgacgagaatcggcctgaaataccgtccgaaattcggcgttcacggcatcggactgcgttcgatgggaccggtcgccgcgtggagcctcggcatcgtcggcgtcgatcagatcgtcaacatcatcgtcacccgcgtggccaccagcgcgccgttcaaggcttcggaacagctgcatatgagccagttggacgtggccggcaacgcctcgtatcagaatgcgtacaccatctacatgctgccgtattcgctgatcgccgtgtccatcgccactgcgatcttcccgaaaatatcgaaagccatcgcggaccgcaatatcgacgaggcgcgcaaggatctgagctcggccctgcgtaatctcaatctcatcatgtgcttcttcgcagcggcgttcatcgtgcttccgttgccgatcatcctcgcactgctgccgtccatcagcgtgcgtgaggcgctgctcatcagcgcgccgctcgccgctttgggcatcggcctgccactttccagctcgtatttggtcatccaacgcacgttctacgcgttcgaagacggcaagcatccgtttattttcatggcgatcaccatggccatccagggtggcgtcatcatcgcgtcgacgttcattctgccgcccacgcagtggatcaccgtcatcggattggcgatttcggtgagcttcatcctgccgtatccgctgcttacacacatgctccgctcccgtttcgacggcgatgtggacgacaagcgcatcatcaccgcctatgcgaaggcgctggtggccacgatagccgcctgcgtgattggcctgctgtgccgcaacggcgtctaccggctggtcggagcgcatatcggccccgacgacggcactatgaactggggtcaggcggttctgtccgcgatactgctcaccatcgtcatcgccatcgtctatctggcgtgcctgtgggcgctgcgtgccgaggagctcacttcggtcgtgggcatgctcgccgcccgcataccagggcttggcaacaagcctaagtctggcggaacggccagccccaacggtaaacttgagcaaagtaccgccgaaaacggcgaccaagaataacagcgtaggtagaacaatcgttacagagttgaaggaaaccatgaaacctcaactgggagataccatcagcaaccgctatgtgctggtttcgccattgcgcgaggaaaccggcttgcaggtttggaaggcaagcgatcacgtgcttgcccgggattgccagctttttatcgtcaacaaccgcaaggctttgcaggacgtcaatgcgacggcctccatgctggcgatttcccacgacgcccatttcacgcaggtgctgcagcttcagcacgtgggcgaggtggcgttggtgatcacgcagctcgatgccggcatgtcgttgagcgagtatctcacgcagtccaacaagccgctgagcttcaccgcgatccgttccattcttggtgaggtcgtcgaagccctgcacgtgttgcagaaagacaatctcacgcatttctcgatcagcacggacaccgtgcgattgacccgcaacggcattgaaatcgccgacgcaccggtaagcatcatgctggccgatacttcgcgcgtgcaatccgtagaaaaccaggagcagcttgcgattcgccagatcgcttccctgctgtattccctgctgacgcgcacgccgtcgacgctgtccacgaactaccatcttgacgcgatttcaccgaacgtgccgatggagttccgcgtgatttgcaagcgtggtctggatctcaaggagaaggacggtttcccgaccgttccgatggccaccatcgccgaattggaggcgttgctgggcgactacgagccgctggcgaagcttaacggccctgatattgcgttaccgtccgcggattcggaatgctcgattgtgaacgtgcccctgctgcagattctcgagcaggatgccatcgccttgcccgatacgctggctgaaaccggaagcattccggaaatgacgttcgaagcgcctgaaccacacactgatttctccgacagcaaggaagccttggccaagggtatggccgcgaccggcggtgccgtgaaatcgctgtggaacaacagccgcgaactactcagcgaagaggacctcgacggatcctccgaagatgtggattcgccgttctccttccccatccgtgtttccacgccgtcgccgcagggcgattatcatacggacgattcgcaattggagaagaccggtcgcattccggtgatcggacctgacggacgggtcatcgagccgggcgaggaatccgcacgcgcgttgaaggcggagcaggaagcgatcgacgtggcatatcagaacgaaaacggagcccccgttgcggtgccgccgagctttgcccctaaagcctcttcctccagtccggccgaggtcgccaatgccaaattgttcggcaagctcaccaccaaggtcgtggccattgtggtcgcgttcattgtggtggccgtcgcattgggattcgccattcatggtttgaccaagaagccggatgacggcatcaccaatacgaattccaacaatccgtggccggaaatgaaccttgacgacgtgcctttcggcaataatggcgattccggcaatggcagcagctccgccagcgatgcaaacaacgattccaacgatgccaacagctccgacaacggcagctccgattccagcaagccgaagaaaaccacgaaaaagagccattccgccaagaaggacgtcgacaaggtggtgacttcggataagaaggtgcggaaggttccggaaccgaagatgccggagaacacgactccgtatgagatcgacaaccgccagttcctgtccaatccggacggacaacagggttacggttattacctccacctcagccagccccagaaagcgtatcgcatggtcatcaagatccgttcttccggcggccagggctacattcgcgtgaacgccaagtccagcccgaaccagggtgaacaggtcgcccagttcgagttcgacgccagcggcaccaccgaaatcaagttcaacaaggccgtggagacccaggacatcctcttgtgggtgccgttcgacagccttcccggcaaccagctgtacatcgattcggtgcagattttctgacgcatcggcagacaaggagggtgtgcggattgttccgcgcaccctctttttgtttcacgtgaaacaacatgacggatagctgacttttttgaacgcttttttgaacgcctttttgaacgccatctgcaaaaccgcccgcaaccgtcgtggaaactgcattacagtagcaaccatgagtgatatgcgtgatgtggtgattatcggttccggcccggctggctatactgccgcgatctatcttggccgcgccggcttcgagccgctggtcgtcgccggcgcgctgacgcccggcggccagttggtcaacaccactgaagtggagaatttcccaggctttcccgatggcatcatgggtccggatctgatggacaatatgcgcaagcaagcggaacggttcggcacgcatatcgtttgggacgatgttgtttcggttgcttcgaatgccgattccggcatcaaaaccgtcacccttgacggcggcgacgtgtacgacgcacgcgcgctggtcatcgcaacaggctcaaactatcgtaagctgggcgtgccaggcgagacggaatacgcaggcaaaggtgtatcctactgcgccacctgcgatggtttcttcttccgcaacaagccgattgtggtggtcggcggcggcgacagcgctttcgaagaagctgatttcctgtcccgtttcggctcgtccgtcacccttattcataggcgttccacgttccgtgcttcccgcatcatggtggagcgtgcgcaacgcaatccgaaaatcgatttcatgcttgacgctgtggtgcaggagattcgcggcgacgagaacggcgtacaggaggtggaggtgcgcaacaccgccaccgaaaagacctctgtaatccccgctaacggcgttttcatggcgattgggcacactcctgccactgcttttcttaacgggcttgtagacgtcgattcagccggttatatcacggtcgatggcgccagcacgcgtaccagcgaacccggcgttttcgccgcgggagactgcgtggatagcgtctatcggcaggccatcagcgcggcgggcatggggtgccgcgccgcgctggatgcgcaggcttatctcgattcgctcaagtaaggctcaaatcgttcaaatcattatcgctcgccgagctcgattggctcggttcgttcagctctgctgctgcataagcaggtcgacgatgcgtttcatatcgtcttccgatttgaacacgatttcgattcgcccgtgcttcttcgatcccttgatggagaccttggtgccgaaacgctgctccagaccaacctgaacgggggtaccagcccacggattgagcttgctggccttcggcttcttgggctggtcgctttcggcggccttcatcgacacgatttcctcggtgctgcgtacggacagtccctcggcgatgatgcgcgtggccagctgttccatatccgcttccgtcggcagtcccagcagcgcacgcgcgtggcccgcggacagcagtccggatgcgaccttcttttgcacggcggccggcaggttgagcaatcgcaaggtgttggcgatttgcggacgggatttcgacaccgacttggacagttgggcctgcgtcaggccgaaatcgtcgatcatctgctggtaggcagccgcctcttccagtggattcagcgcgacgcgatgcaggttttccagcagtgcgtcacgtagcatgtcgtcatcggcggtggttttgacgatggccggaatcgttttcaggccggcgatctgcgatgcgcgccaacgacgttcgcccatgatgagctcgtacatgctatccatgcgcccgtcgaacatgttgtgcggttcggccggtttggctgcggcttccctgcgggcggcttcgatttgcgattgcggacgcttgcgtacgacgattggctgcagtacgccgacttccttgatggattcggctagctcgcgcaggtcgtcttcatcgaaaatggtacgtggctgatgcagattgggaccgacgtcgctcaaacgcagttcaaccagatatccaccctgcacgggaagcagttccggttcgtccttcttatgttcggtcggcgtggtttcacgtgaaacactcccctgctgctcgccctgttcggaagctggctgagcggtggagccgaagaacatgtccgcgggatgcgcgctttcgttcaacgaaatcgacggcatgctggcacgacgatgctggtttttcttggttgtttcacgtgaaacagcatgcttcatcccctgcacggcgttcaccgatgcctgtgcggtagcggacgcgctcttggattccacatgcccatcagtcttggaagccttgacttccttggcggcagcggcaggcgccgcatgctcctgatgctgcggctcccccggaagagaaggaaacagtgcgccaagacctttacccaaacgcgacttagttgccatgatcagttctcattccttcttgcatcgattgcctgcagcaccgtatcggaacgacgcgaaagttccagcgcggcttcgcagtacgcgatcgcacccatgcccttggggtcgtatgcgatcacgctttggttgaagcttggcgcttcggaaatcttcaccgtgcgcggaatggtggtgtcgagcacgattgtcggatagtgcttcttcacttccccatgcacttcgcggctcagcagcgtgcgcttgtcgtacatggtgatgagcatcgtggagaccagcagcgacggattgtaatgttcctgcaccagtccgatggtgttgatgagctggcccaaaccttccaaggcgtaatactcggcctgaatcggaatcagcatttcgtgcacggcgcacatggcgttgatcaccagcagacccaggctcggcgggcagtcgatgatcacgtaatcgtaatgctcttcgctggtggcgaggaactcgtccaccgcgttcttcagcagcgagttgcgatccgccatgtcggcgacctcaagttcggcgccactcaaatcgatggatgcggggaccacgtcgaggttgtcgaaatcagggcacgtgcacttgacttccgcgatgcgcttgcgcccttcgatgacgtcatacaccgaaggctgaccggaggcgtgcggggcacccaatgccgtggaggcgttgccctgcggatccatatcaataagcaggaccttgcatccgaaacgggccaaggccgcggacaggttcaccgcggatgtggttttgccgacgccacctttctggttggcgactgcgatcaggcgcgtttgggccggcttcgggcagaccgcatgctccaatgccttgtatcgcgtcgattcatcagcgatttgcgcgcctacgggggatgtcgagccttcgaagattcgcttgatggtttccgtggcggattccatcgacgtcaaattgtctggttcttcaggtccagtcatgaactagccttcctatacatattcaacaatcaagtttcatcatttgggtggacagattttcacctgttcacggccatgtgcaccattgtgaacaacggtggatagttggtggataactcatccgaccacccaaaagttatccacagaacaatcgttgcaattccaagcttcttcaagatgcttcgtaacacatttccgcgattgtggatactgtggataactcacgcgattttgtggataacttatcgcttgtccaccatcagcacatgcgtcggttccagacccggaccgacctcggcctccaccacgcggggatggataccgccgtttttggagatctctttggtggccttgacgatttcctcctgcgcggatcgtcctttcagggcaaccagccgtccgcctttgtccagcaacggcagcgtccatccggatagtttggtcatcggcgcgaccgcacggcaggtcaccacggcaaacggatgcctgaccgggatgggatttccgtcgagatcgacggcatcctctcccctgcccttccggccaccgttcgaaccgcggacggcttcgattacggcgttggctcgggagcgcactatcgagacattgtccaatcccatttcgtcaacgcactcatgaagccattcgatacggcgttccatcggttccaccaaagtgaactggtggtccggcaggcaggcggccgccacgataccggggaatcctccaccactgccgatatccgccaccgtcttgaattgcctcttggccgttgcttcacggatgaacggtacgatggccgcggagttcagaatatgccgttcccaaataataccgacatcgcgtggccctatcagcccgcgcggctctccttccgcagcaagtttcacgtgaaacaccttcaacttgcccaatgcatcgccaagcacttcctcaagaatcggcgacccatccaattcgtcattcacatcactcatgcacaccatcctaatctacaggcatcaaaaagcgccgcgagaaactcgcgacgcttcatgtttcacgtgaaactatttcaggcttcgtcgatctcgtcggcgtcatcggctgcggaagccttgacgtacaccgtgacgtaacgatgcggttcttcgccatgggaccgagacttcatgccttcctcgcgcaccacatcatggatgatcttgcgttcgaaggagttcatcggcttcaggtccaccggctcgccagtctcgcgcgcctcgtcgatggcatccagcgcaaggtcgtgcaggcgctggcgcttgcgcttcagatagccgtccacgtccacgatgaggtgggaccgctcgccggtcttctgttgtacggcgagtcgggtgagctgctgcagggcgtccacgacttcgccgttgcgtccgatcagatgtttgatgtcggtgtcgtcgtcggcaacgatctgcacggtcggacggttgttgcgcacgcccatttcgatatcgccctcgtagtcgacgatgtcaagcaatccttcaaggtaatcggcagcgatgtcagcttcgtcattgagctgatcgatggttttctcagcatcctgcgccatggtgttttactcctttgagcggggttcgtattatttcaagtctactgaaagtctactgattgggttgtatcatatgggcgattcgcccgatacaaaagcggtgtgtcctgcgtttcacgtgaaacacaggacacacacttgatgttatttcttcttcttctttttgcggcttggctgctgacgctggaagccgttcttttccttcgcctccgcggccttcttggctttctgcagctcctcctcttcgagggacggcagaccggccttggcgcggcgggcgttctcgtgggcgtggtcgcgcttttccttcgcttcggcggccggggatcccggagtcgggaagacgtggatctgccagacggaacgcagcaggttgcagatgttgttggtcaaccagtacaccagcactgcgaacggcatggcgacgccggagaagatgtacatgatcgggaacatccacagcatcatcttctgcatcatttcagtctgcttgttcgcagcgctctgggccatgttgcgcttcatgctgttgtactgcatgagccacaggcagaagcacatcaacgccacgaagatgccgatgatgatcttgccgtggatgtcggcggtggtgaagttctcggccacgttcacgccgaacacgttggtggaggtgaactgcttggcggtggcgatgtcgaaggcgccgaggccggaaccgttcctgaacttgccacgggcgatgtatggaatggccgacagggtgtagaacatgcacatgaacacaggaccctgcacgaacataggcagcatcgacgtgcagccgcccatcgggttcgcgtcgttgtcctggtagagcttcatcatctcgcgttgcaaagcctctttgctggcgggatcgttcttgcccttgtacttgttttggatgcgctgcatcttgggctgcaaaacggccatctgggcctgcatcttgcgcatgcccttcatggacttgtagaacagcgggaacacgcacgcctggaccacaatcaccaggaacacgatggacatgacccacgagaaaccgatctcgttcatgcccagcatcaccatgaatcggtggaatccggccataatctgcgtcatgagccactcgacggggtacaggagcttgtacagccagccccagaaaccactatcgaggaggaattgatcttgattcattacaggccattctccttatcgcctataggttcatctacatccagaggcgtgagacgaggctcctcatgtgccttcgaccacgaacatctgtaaaacaaggaatagagctgtggaacgtcgtcgattcctccacggttccactggttgcaacgaagaaggcgtaataacgcaagaaggccacctttaaggcagccaaatcgttcaatcgcctgaatcgcataattggagcagctgggataataccggcaccgaggtgcggtatgggcggaaatatgtttctgataccagcggatgagccgcaccatccaattgcgatgatgccccttgctcattgccgggaagcggttttacgtttcaccgcttcgaaacacgatgccatctgctgctcaagcgacaggaaatcggcacgtgcggcacttggcttggcacgcaacacgatatcgcaggattcaggtaatagtgattcgtactttcgtgcaagcacacggaaacgccttttcacggcgttgcgcgtgaccgcgttgccaacagctttggaaacggccaagccgacacggcggccttgcaccgtcgctgtatcgcccgttacgacatcgtcgtgcatcagataatgcacgacgatgtcttctcgcgataccctacgacggcgtttgagcaccgcaacaaaatcgcgatggcttttcagccgttccaccgctctatgccactaaaaaatcaggcagcgagggacttgcggcccttggcgcggcgacggttgatcagagcgcggcctgcgcgggtgcgcatgcgctgacggaaaccgtgcttcatgtggcgacggcggttgttcggctggaatgtcctcttcataattaatgctcccggtgtttttagccatgccaaggcacggctcctcatgagtcaagctctactaaattactctgacccctgaacagattgccgcgtcgtccattttcttcacattttcatggggattccccgcataaaacaatccacataatcgttgcgattccgccgaattccccacaaaagttatccacaaactacaacaatgttattcacatttcaatcttttcaacacgcacgccggtggataactcggggaaaagagagtacaaatatacagttgcacatcagtggtacgtctgtcgagaaaggattatccgtggttgataacacgacaacagatcctctcgagcaggctcgtggggtgtggtccgacgctttggccctgctgcaccagaatccgtcgctgtccgtacgtgacaaaagctggctggagaacgtctatcccgaaggcatgtggggtccgaccatcatgctgtgcgtgcccagtgaggcggctcagcaggctttgcagaccgaattgaacaagccgttgatggaggcgttgcgcgaatccgccgaacaggacatcttccccgccttcaaaatcgttgaaatgaagccgaaaacggaggaacagccggaggaaacctatccgcgcttctcccccgcgaaatcaccggcgaaatcccctgcgaacgagacgatgcaaggccagttgccgattcccgcgacgatgccgccggaacaggaccatttccagagcggccagaacaggccgctgctcgaccccgaaacgcatttgaacaagaacgccaccttcgacaccttcgtgcccggcgattccaaccgtttcgcacgtaccgtggcgctggccgtggcggagggttccggccatgatttcaatccgttgtgtatctacggaggctccggcctgggcaaaacccatttgctgaatgccatcggcaactacgcgctggtcaaggaccccaatctgaaggtccgctacgtcaccagtgaggaattcaccaacgaattcatcgaggctctggccgatacgaaccaaagttccggccagatcaaggaattcaaccgccgctaccgcgaggtcgacgtgctgctcatcgacgatatccagttcctgagcggcaaggacgcgacccttgagcagttcttccacacgttcaacaccctgcatcaggccaacaagcgcatcgtgatcgcctccgatgtgccgccgaaggacctgcagggcttcaacgaacgtctgatctcccgcttcgaatcgggcctgaccgtggacgtcaaaccgccggatctggagacgcgaatcgccattctgcgcatgatcgccaccatgaacggctccaatattcccaacgacgtgttcaacctgatcgcggaacggttcaccgagaacatccgcgagctggaaggcgcgctgaaccgtgtgaccgccatggcgtcgctgagcaaccagccggtcaccaaagcccttgcggagcagactttgcaggacttcttcaccaccgacgtggaaatcaagcccgcggacatcatcacgcaggtggccaagtacttctatttgacgttcgacgacatcgtcggccgttcgcgtaccaagaagatcgcgctggcacgccagatcgccatgtatctggtacgcgagctgaccagcatgagcctcaacgacatcggcctggtcttcggcggcaaggaccacaccaccgtgatgcacgcgtatacgcgcatcaacgacgagatgcaggagaagcaggagatctacaactacgtgaccgagttgactctgcagctcaagcagcgttccaacgacaagtaacggaagcaaccacaacaaacggcgtatttccaacggtttccttaggctggtaaattatttaccagcctttttactatccgcgtgacacgcccggacagaatttcttgtacatcgagttttccacatacatatccacatttcggggaaaggtctgtggaaaagccgttggaaacacggaaaacggcagtggatggctcgtggattattcacagtgaattgtggataagttttgcgcggccatgagcctgtggataacccatgctcttatccacattcgactcagaagttatccacagatgtcgcctcgtactgagacgttgctgcgcttgggctgaacgagcttatccacactatccacagggcttattattacgaaagtacgtttttcttactttcatcgtcattctcgtaatgcggggaattccccacgctttcgtcgtcgttgctcttatcgctagaatggcatgtgaatcgaacgaaacgaggaataccccatgaaagtcgaagtcaattcccaagctcttgccgatgccgtggcatggaccacacgtgtcatcgacgcacgtcccgcaaccccgattctggcgggcatccgtctggaagccattgacggcacactccagctttccgccttcaactacgccatttccgcacgccaccacatcgaagccggcgtggacgaggccggtagcgttctggtgctgggcaaactgcttgccgacatcaccaagtcgctgcccgctgcgaaaacctatctttccactgatggttccacgatgaccatcacgtcgggcaagtcgaccttcaccatgcagctcatgccggaaagcgaatatccggatctgcccgtggtgccgacgaaactgggtcaggtggactcccccaccttcgctcaggccgtcaaccaggcgtccgtcgcggtctcccgtgaggagaaccgtccggtgctcaccggcatccgcgtccagttccagggcgacaaggtcatcatgagctccaccgaccgtttccgtctggcccgttccagcttcacctggacgccggaggatgcgaccatcagcaccaccgctttggtccgtggctcgctgctgcgcgacatggcgcgttcgctggacgagcatcagaacgtcaccatcgatttcgatgcggacaacccgtccctgctgggtttcgagaacgccggccgcgtgtccacctcccagctcatcgacggcgaattcccggccgttgaccgcctgtatgccgatgaatacccgattcatgccgtcatcaacaagcaggccctcatcgacgccatcaagcgcgtttcgctggtcgccgaacgcaacgccccgatccgtatggtcttctctggccaggagctgacgctgtcggccggcaccgccgacgaagcacaggcgaaggagattctcgacatcgacatggacggcgaggacatcaccgtggcgttcaacccctcctatctggtcgacggcctgagcgccatcagcgagccgttcgtgcgcatgaagatgaccaccgcggtcaagcccgtggaattcaacggccagcaggaagcggattccgacgaatccatggactaccgttacctgctcgttccgatgcgcttcaacaactgatttcgttccacctgtggcccggacggcaagttcccgtccgggccaccatgccatcgccttcaaggaatcccggttttcatgcatatctcccgtctcgcgctcgaccattaccggtcatgggaccattgcgtgcttgatttcgaaccgggaatcaacattctccaaggctcgaacggcctagggaaaaccaatatcgtggaagccgtggaagtgctgtccaccggctccagccaccgcacctcgtcatcgctgccgctggtcgaaaaaggccacccttccgccactgtccgggccaacgtcgaagatgcgggcgaacagcgcacatatgagatcaccatcgccgcgcgaggcgccaacagggcgcgcgtggacggcggaaaatcgcaatatatgagggatatcgtgggtttggtcccctccgtgtcctttacccccgaagaccagcggttggtgtctggcgatccggccacccgaaggaacttcctcaaccaggcggcttcgctgctgttgccccgttatgcgcagtcgttgcaacagttcacgcacgttgccaaacagcgtgccgcattgctcaaacagctgtccgacggctccggcatcgaccccgaatacgggcgtcaggccgtgctgagcggtctggaagtgtggaccggccaattcatcgccctcggcgtgcaattgaccaaggaccggaacgatgtgatcggactgctgcgcgagccgttcacccgcatctatgcttcgctggcgggcgaagaggaacaggccgacctggtgtatgagccgtccttcgacgaggtgcttctgttcgacgagccggccgcggaaatcagccgtcatttccaacgcatctaccccggcgaagtggcccgtgggcagaatctgatcggaccgcagcgcgatgatctgacattgcggctcaacgacatgccagcccgcgaattcgcttcgaacggcgagatgtggacgatggcgttggccttgaaaatggcgctgtacgaagtggtttcggcgcagcgcgacgtcaagccgatcgtgatcctcgacgatgtgttcgcccagctcgacgagtcccgtcgcgggcagatcctcgacttcgcgcgacggcaggaccaggtgctgatcaccgtcgccgcggcaagcgatattccgcaaggcgaggcgcatgtcatcgacgttgccgcgctgcgtgcgcaatcgcaggagacggacggcgatatcgcggcgatggcggccatgcttgccgccggacgtggcgcgcaatcgcaaggaatcgaggccgaatcctaatgccgaaaccaccaatctgcgaactgctgaacctcgaccaacgcaaactgccggccgaagtgttcgaccgcatcagcgaccgtgccgggcggctcaaggaacgcgaggaacgcgcgcgcaaggcgtgggaaagcttcggtaaacccggacgcgatccggaaaccgtcggcagcctgttcaatctgctggcatcgaacggcgcatggatgccccacctcaaaatggcgcagatgcgcgaccattgggaccaggtggtgggcgtggaaaacgcgaagcactcctaccccgccagcctgcgagacggcgtgctgacgatacgttgcgacagcccggcctggaccaccaccctgtcgtatatgacgccgttgctgacggacaccatccgcaggaaactcgaaggtctgaccatcaatgaggtgagggtcaccggcccgcagagccaagggttcagccgtgggcgtatctcaaggaagattcgctactgagggctattgcgaagtcgacttacaatcgacctctctgacaggagagatcgattgtggcgcgcgtgaaacaggccgttgcgacggggtttacggaggttttccggctcgtcggacgcgttcggaaccatgccgaagccgttgaaaaccgttgaattccaaggacaaatgtctatagcgcgctgtccccctccatgagtagaatatccagcagtgtatgtaaacgcctagaaggggcctttatttgcgttctaggtggtatcacctgcggaaatgacccttgatggcgggaaaaatgcaggaaggaatctctgtggcagaccttgatgcggattcgctgaacgaatcagctgaaaacacgcaggaagatcagattcaggatcagatccagaacgaccagctcgaagatgcgcaacttgacgattcgctgtctccggaacactacgacgcgtccgatctgagggtgctggaaggccttgaggcggtgcgtatccgcccgggcatgtatatcggctccaccggcccccgcggcctgcaccatctggtgtatgagatcgtcgacaactccgtcgacgaggcgcttgccggctacgcgtcgcacatcgaagtgacgattctgccggacggcggcgtgcgcgtggtggacgacggccgaggcatcccggtcgacgaagtgccgggcgaaggcatctccggtgtcgaaaccgtgatgaccaagctgcacgctggcggcaagttcggtggcggcggctacgcggtctccggtggcctgcacggcgtgggcatctccgtggtaaacgcgctgtccacccgcgtggacatcgaagtgcgccgtcagggcttccactggacccagacctacatcgaccagaagccgaccgcgcgtctgctcaagggcaagccgatggaggaaggcgagtccaccggcacttccgtgaccttctgggccgacggcaagatcttcgaaaccaccacctacgatttcgagatcctgcgcaaccgcttccagcagatggcgttcctgaacaagggcctgaagatctccctgaccgacctgcgcgagcccgaccaggccggcgacgaggtttccggcgaggaatccgaaaccgaagacaagttccagaccgtcacctaccagtacaacgacggcatcaaggactacgtcgactacctggtgaagtcccgcaaggccaccccggtcgaaccggacgtcatcgacttcgaggccgaggacctgaagatcggcatctccgcggaaatcgccatgcagtggaccaccgcgtattccgaagccgtgcacaccttcgccaacaccatctccaccaccgaaggcggcacccatgaggagggcttccgcgccgcgctgacctcgctggtcaaccgttacgcccgcgagaagaacatcctcaaggacaaggacgagaacctgtccggcgacgacgtgcgcgaaggcctgaccgccgtcgtgtccgtcaagctcaccaacccgcagttcgaaggccagaccaagaccaagctcggcaactccgaagcgaagaccttcgtgcagcgcgtcatgaccgacaagctcggcgactggttcgacgcccacccgaacgaggccaagaacatcatccagaaggccatcgaggcctcccgtgcgcgtctggccgccaagaaggcacgtgagaacacccgccgcaagtcgatcttcgaatcggccggcatgccggacaagctcaaggactgccagtccaacaaccccgaagaatgcgagctgttcatcgtggagggtgattccgcaggcggctccgccatccagggacgcaacccgatcacgcaggccatcctgcctctgcgaggcaagatcctcaacaccgagcgcgcaagcctggaccgcatgatgaagtcggacaccatcgaatcgctgatcaccgccgtcggcggcggctacggcgaggacttcgacctcaacaaggtgcgctaccacaaggtcatcatcatggccgatgcagatgtggacggcgcgcatatcgcaaccctgaacctgacgctgttcttccgttacatgcgcccgatgatcaccgccggctacgtgtacgtggccatgccgccgctgtaccgcctcaagtggaccaagggcccgcacgacttcgtgtacaccgacgccgaacgcgaccgcgtgctcgccgaaggcaaggccgccggccgccagctgccgaagggcgaaggcatccagcgctacaagggtctgggcgagatgagctaccaggaactgtgggagaccaccatggatcctgaccatcgcattctgaagcaggtgcagatcgaagacgcggccgcggccgacgagaccttctccatgctcatgggcgacgaagtcgaaccacgtcgtctgttcatccagcgcaacgcacgcaacgtcagctggatcgacgcgtaaacgcgtagggtttcgcaggacttcaaagcaaggattagaaattggcagacgaaaacaacagcaacgaagacggccagttcgtgcctgacggctccatggaaccgttgagcccgcaggaggccgacaacaccgattacggcctgatggtcggcgaacgcgtccagaagaaggatctgcagcaggaaatgcgcgaatcctacctggcgtacgccatgtccgtcatcgtcgatcgtgcccttccggacgtgcgagacggcatgaagccggtgcaccgccgcgtgatctacgcgatgtacgacggcggctaccgccccgaccgcggctactccaagtgcgcacgcgtcgtcggcgaagtcatgggcaagtaccatccgcacggcgattccgccatctacgacacgttggtgcgtatggcgcagtcgtggtcgatgcgatacacgctcgtcgacggccagggcaacttcggctcccccggcgacgacccggcagccgcaatgcgttacacggaatgccgtatggcgccgctcgccatggaaatggtgcgtgacatcgacaaggacaccgtcgatttcctgccgaactacgatggcaagacgcaggagccgaccgtgctgccggcccgcttcccgaacctgctgtgcaacggctcgtccggcatcgccgtcggcatggcgaccaacattcctccgcacaacatgcgcgaggtggcagaaggcgtgcattgggcgctcgaccatccggacgcgagccgtgaggaactgctcgacaacctgatccgcatcatcaagggaccggacttccctaccggcgccacgattctcggccataagggcatcgaacaggcgtaccgtaccggccgtggcctcatcaccatgcgagccgtggtgaacaccgaggagatcaagggccgcatgtgcctcgtgatcaccgaactgccgtaccaggtcaacccggatcgtctggtcgtgtccatccgcgaagcggtgcgcgacggcaagatccaaggcatcgccgacatgcgcgacgaaacctccggccgtactggccagcgcctcgtgctcgtgctcaagcgcgacgccgtgccgaaggtcgtgctcaacaacctgtacaagcattcccagctgcagcagaccttcggcgcgaacatgctggcactggtcgacggtgtgccgcgcacgctgtccctggatgcgttcatccgtcattgggtaaaccaccagctcgaagtcatcgcacgccgtaccgcctacctcaagcgcgaggccgaggaacgcgaccacatcctgcagggctatctgaaggcccttgacatgattgatgaggtcatcgccctcatccgtgcctccgagtccgcggagaccgcccgcacgggccttatggacctgcttgacgtggacgaggtgcaggccgacgccatcctcgccatgcagctgcgccgactggccgccctggaacgtcagaagatcctcgacgagcacaatgagctcatgcgcaagatcgccgactacaacgacatcctcgccaagccggaacgccagcgcaagatcgtcggcgacgagctggacgaaatcgtcgccaagtatggcgacgaacgccgtaccaagattctgccgtactccggcgagatgaacgtcgaagacctgatcgccgaagaaaacgtggtcgtcaccgtgacccactccggtttcatcaagcgcaccaaggccgacgaataccgcgcgcagcaccgcggcggcaagggcatcaagggcgccaagctgcgcgaggacgacgtggtggaccacttcttcctgaccagcacgcacaactggctgctgttcttcaccaacaagggccgcgtgtaccgtctgaaggcatacgagctgccggaaggctcccgcgattccaagggacagcacgtggcgaacctgctgcagttcggcccggacgagacgatccagaccgtgctgtcgattccgaactacgacgtggccaagtacttggtgctcgccacccgttccggcaaggtcaagaagaccgcgctcgccgaatacgactccccgcgtcagggtggtctgatcgcggtacgactcatgaccgacgagaacggcgagaacgccgacgagctgatcggtgccgcgctgtgcaacgccgacgacgacatcatcctcgtctccaagcagggcatgagcctgaagttcgaagccaacgacgagcagctgcgcccgatgggccgccagaccgccggtgtgcagggcatgaagttccgcgacggcgacgagcttttggccatggatgtggtgcagggcgattccgacagggatctgctcgtggtcaccaacgagggcttcgccaagcgcaccgccatcagcgaataccgtctgcagggccgtaacggctacggcgtcaaggccgtgcagctcgccgaaggccgtggctccctggtgggtgccgtgatcgtggaggaatccgaccagatcatggccatcatgaagtccggcaaggtcatccgctccaacgtcgccgaagtcaagcgcaccggacgtaccacccagggtgtgacgctcgccaagcctgacaagaacgacgaaatcatctccatagcacgcaacgaggagaccgacgaggatgacgccgagcaggccgccgcggaaaacggagcagtccagaacgacgcagccacgcaatcgcaagccgaaaccactactgaaaactccgctgaaaccggtacggaagccacttccgatgccggcgatggcgagaatgtagaggcctgagacacaggcggggaatcgtctgcgaaaactggtagcctcggctagaagtaggcaagattctgcaaggagcaacgatgagcgagaacaatgaaagccatcaggcgcaggcaggggcgcaggccccacgcgtggcccgttccgcatccagccagccgttgagcggtacggaacagtctcaggcgcatgagaacatggccgccgcgtccggcggtgtgaaggttcgtgaaaaagcgcgtcgtggcgcgcctcgcgcccgccgcatgagcctgtccctgacccgcatcgacgcatggtccgcggccaaggtggcgttcatgctttccatcgcgggaggcatcatccagatcgtcgcggtgacgctgctgtggctgctgctgaacgtggtcggcgtgttcgatcaggtgacgcagatcgtgtcctccaccggtcttgacgccggcggattcgaccttgccaacgtgctttcgctgagcaccgtgctaagcgcggtcaccatcttctccatcatcgaagtggtgctgttcaccgtgctggtggtgattctcacgctgctgtacaacgtggtgagcacgctggtcggcggcatccacgtgacgctcggcgacgactgatcgattcgtcatacggcgttcgtacggcgcttgcgcaacgtaagccgttcgtgcaacataagaagacggcgcttccctacttcgggaggcgccgtcttttcttatgtaatcgcgattatgcggtcgcttttatgcaatcgtcatactgcgttgcgtgttatgccgtaaacgcatatgaaaacggtccgtgcgaacgaatcgcacggaccgttgaaacggattgtgaaagacgatcagagcacgccctgggcgaccatggcgttggcgaccttgacgaagccggcggcgttggcgccgagcatcagatcgccctcatggccgtactccttggcggcggccagggaattggcgacgatgttctccatgatggacttgagcttgttgtccacctcttcgaacgtccaggaaaggcggtaggagttctggctcatctcaaggccggacacagccacgccacccgcgttggcggccttagccgggccgtacagcaggccgttgtcctgatagacggcgattgcctccggggtggacggcatgttggcgccttcgcacacgaccttgcagccgttggcgacgagggccttggcggactcctcatcgatttcgttctgggtggcgcacggcagcgcgatgtcgcacggcacggtccacacgcccttgcagccctcgtggtattcggcacccggaacacgctcggcgtattccttgatgcggccgcggtggccgagcttgatgtccttgacgatgtcgagcttgatgccgtccggatcgtagacgtagccgttggaatcggaggcggtgacgaccttcgcgccgagggcctgggccttctcggtggcgaagatggccacgttgccggagccggagatgacgacggtcttgccttcgaaggaatcgttcttcaggacgcgcagggcttcctgggtgtagtagcacaggccgtagccggtagcctcggtgcgagccagggagccgccgaattcgaggcccttgccggtgagcacgccggagtattcgtcgcggatacgcttgtactggccgaacaggtagccgatctcacgggcgccgacgttgatgtcgccggccggaacgtcggtgaactggccgatgtgacggcacagctcggtcatgaacgcctggcagaaacgcatgacttcggcatcggacttgcccttcggatcgaagtcggagccgcccttgccgccgcccatcggcaggctggtcagggagttcttgagaatctgctcgaagccaaggaacttgatgacgccctcgttcacgctcgggtggaaacgcagaccgcccttgtacgggccgatcgcggagttgaactggatgcggtaaccgcggttgacctgcaccttgccctcatcgtccgtccaggcgacgcggaacttcaccacgcgctccggctcgacgaggcgctcgagcacgcccgccttctcatattccgggtgcttctcaacaaccggctcgaggctttcgaagacctcgcgaacggcctgcaggaactccggctggtcgccatcgcgcttctcgacctgcgcgtacacgcgcttgacgtactcatcagtgagcatatttttccccttcgggatagttgggttatcaatacggcggtttcattctatgtgcttgattgtgagacgcacaagatattgctcaagatttggctggagcgtgcggatataggatggattcgggcatgcaagagagacacgtccaaagagagacttgtccattgacgcgattcacggaatcgcgaatgcagaacaggagcaaaaatgttcgaaggattcaagaaattcatcgcacgcggcaacatgatcgacatggccgtcggtgtcgtcatgggcggtgccgtcaccaccgtggtcaacgcgatcgtcaacagcgtcatcaatccgttcatcgccatgatcttcggcaagccgaacatggatggtctgctggcgatcacattcaacggcgcgaccgtttcgttcggcgcagtgctgggcgctattctgaatttcctcatcatcgccgtcgccgtctatttctgcattctggtgccgatcaacaaattccgcgacatgaccgaggcgctgcttgccaagaccaagcttgccgagcagaaggaagccgaggaaaaggccgctgaagagccgtctgccgaagagcagaccgtccagctgctgcagcagattcgtgacgagctggccaagcagaacgcggcccgcaactagttgcgattcgtggtgccactcccctattgatttgatgattccggccgcttgcgggtatgcaggcggccgttttatttggtttgcgggcgatcgcgtccgttggatggtcgacaagaggctgaatacgaaaaaggcttccgattactcggaagccttcaattctgtggagctaaggggattcgaacccctgaccctctccatgccatggagatgcgctaccagctgcgccatagccccgtggagctagccgggttcgaaccggcgaccctctgcttgcaaagcagatgcgctaccagctgcgctatagccccataggtgaaaaaagcggctatgccgcttccttaccatctacgtgggcccgggaggacttgaacctccgacctcatccttatcagggatgcgctctaaccacctgagctacgggcccaacttgctgtgtcttgaacacaacgaattgaaatgatacttgaatcacagggaaagtcaagtgccgccgtgtcatcggcgtgtcgtggcataatgcaggcatgacatacgggcagcgtaacggcggtaacggccgttacggcaggggagtggggcatcgcaaccgcaatcgcgtgatttccgaaacgacggcgagcatcgccggcatgcgggtggccatcgtgcgcaaacccatcaaaaacatgtacctgcgcatcaaaccgccgaacgcggatatcgtcatctccgcgccgcaacgaatgtcgcaaagcgctatcgaacggtttgtgacggaacgcaagccgtggatcgaacgggcgcaacgcagcatgcggcaggccagagacgcgcaactcaacgcgcagcgtgcgcaaaacggcaatattggcgatactggcgcttccgccaacccgcccgctttcgtatggacggacgaggccaaggcgcgggcgcaacgcaacatcgaatcgcaattgcctgtgttgcttgccaaatggggcccgatcgttggccgtacgccgacgcatatcacgttgcgtctgatgagttcgcgttggggatcgtgcacgccgaagaccggacgtatccgacttaacctgcagcttggtttaatggcccctagattcctcgaatacgtgctggtgcatgagatgacccacctgtgggagaacggccacggagagggctttcaaaggcgtatgagcgcctatctgccgcaatggaggcagttacgccgcgacatcaaccggcaggtggtgctgtaagaggctgctcgggttacttgccgtccgccgcggaatcgccagccgcggaaccgtcctcatcggcggtgtgccgacgcacttccagcgtttcgatacgacggccgtccaccttggtgacgaccatgtcataaccgtcatcggacgacagcacgtcgcccacttcgcccattttgccggtgtgcgccaggaaatagccggcaaccgtctcgtatgggccgtcttccagctcgatgccggtcaaatccgcgaaatcctcgatcgtcatgccaccttcgatggtggccacgccattgacgaaagcggcgcgttctgtgcgttcaccgcccttttcctccggcaggtcgtattcgtcgcggatgtcgccgaccaattcctcggtcatgtcttccaacgtgacgatgccgtcggtgccgccgtattcgtcgattaccacggccaggtgaatgcctcgtttgcgcagcagctcaaggcttggcagcagcttcgacgtgcccggcagggaaatgccctcacgcgtcacgtcggcaacggttctcgccttcggatcgcggatgtcaagcaggtcgcgcacatgcacgaagccgagcacgtcatcgaaatccttgccggtgacggggtaacgcgaatacggcatttcacgcacgtacgcggcggcttccgcaatcggcatggagccgtccaggaacgcgacgtcggcacgaggacgcatgacctccgccacgatggtttcggatgcgtcgaacacgtcgtcgaggatggtgcgctcgtccttgctgaggttggtgttggtgttgacgagcacgcgcagctcgtcgtcggacacctcgctgtcggtttcgttcggatcgaagccgagcagccgcacgatgccgttcgtgttcttgccgatcagccagatgatcggcttgcacactttggcgaacacatggatggccggcaccacggcacgcgcgatctgctcgttgcgttgcatggcgatacgcttcggcaccagttcggaaatgacgatcgagcaatacgagatgatcagtgtcaacgcgatggtggtcaggggagcggcgacgttatgcggcacaccccagtcttcgatgaccggcacgatatacggggcgattgaggattcgccgaacgacgcggacaggaagccgcacagcgtcacgccgatctgcacggtggacaggaacgtgttcgggtcgcgtgcgatctgcgccacacgcttgccgcgcgcatcctcctgttccatctggtcgatctgcgatccgcgcaggctgaccagcgccagttcggtgccggcgaacacggaaccgagcagcaggaaaatgaaaatcagaaggatgttcaaaccaagcgacatgattccaatctaaagcaacggcatgtcaaaacagcgcgacgcaacggatccggaagccgtctttttccggaaaatcgtcagaagctcagcacttccaccttgccggtgtcgagctggtagcgtgctccggtgatcatcagccgatcctcggccagcgcgtgctggatcacttcggaacgttccaccagctgttcgatggtgcgtgcgatgtgcacgcgctcgaaatcctccgccgattccagttccgattcgtgcgcctgccaaatcgaaaaaccgaccgtgcgcagcatcagcgattccgcgttcataatgcgttcgtcgatgtcggcgatgctgtcggcggccatcagcgaatcctccgcgtcggcggtcaactcgtgcagcagcgcctcgtattccttgcttgcctgcttgatcgcaccgcaattctgatggccgagtaccaccaaaagccgcacgccgagcacgtccaccgcgtattccaaagaggcgatcacagcatcgtctatgacctgccctgccgtgcgcacggtgaacagatcgccgatgcctgcgtcgaaaataatatcggggctgacacgcgcatcagagcagctcagtatggccgcttccggtgcgtgtgtgtccacaagtgcctcgcgtgcttcagcgccacgattcggatgttccggtttgccctccgcaaacctgcgattacctgccagcatgcggctccaaacgccgcttgccgtgccttcgacctcgtcttggtctacaaacagttcgtctgccattgactccacccctcattgttcaggctagccaacatcatacgttttggtctgaccgttcgctgggaaatagagcgatatctcgcttatgtatggcagatttcgtgttctgtccggtgatatttcgcttatgtatggcagtcccaaaggtgaaaaaccggaaaaatgtacccccgaagtgggtttttcgcatgatggtctgccatatataagcgagaaggctcatgacaaggctccgattctgccatatataaggcagatataggtatgaaaaagggtccccgatcggcagtgcgaacggggaccctgaaagaaactggctaaaatcagccggtgttctgcaggcctgctgcgacacccgacacggtgcacaggatcaggtaggtgttactgcagtctgcagaagatgaaaagaataagagctaaaacaagaaaggcggcaccgcttattctcattaaggatgtgtatagattgctcggatctcctttttgagtccagaggaaattgcttattttccagagttgccttggaaaaataagcatacataatcctagcagggcaagtgctgtgagatatatgtactgcactgttctccttattttaggtagtcggagatgcaagggtatggtccttgtttatttattccgttgcttgaatctttgaagaaatcgatactctcaaatgtaatccctttatattgcttcacggtaattactttaaaatgaaggttaattctgtcttctttcttgtacttgctggtgatatttccattaaatttccattcaatatatttgttgtctaataaaaagaagagtgatgtattgttttcattgggattgaattgaattttatctatggtatcttcaaaaataatatcatctcctgtattgtagtcgcgaagataatcgactgatataccacttttttcgtcataaaattgattgttaagttgtttgatgtcaagggttggggcttttgttgttcttggttgatctgggttggcgttgtatcggaacgtggtgccatcgttagccaggtagtcgattagattggtatttgggacgtcgatgatcgttggaagacttcttccattgccgtaatattggcggtaataacactgccaatttttcccgctgtcatcttcggtgaaacgagcgtcccatgttccggtgccatcgctgcttgatctggtgtatgagacatactggtttgtccctactgttttattgataacccttttgcctgaggttgtggacaaggctagaactatattggctccaaaatcgacggggttagctctatgcgcgtgcatttcgaaactggtcacacggctggagacttgagggcgcatatagaattcgcccccattggtgccattgttgaaaacaatggaaggtgaaaccatataggtggaatattgatcatttgaactttgcccatcgagattgactacccggtcgatgacgttattggcgacaatccatccaacctgtcaccaatttacagcaaaggctggagtggtcataactgtgcataggcaaactgagataattgtggagaataaaaaactcttctggatttcataatttcctccatgtgaaaatttaatctcaatcgacaatgattaagatattaagagtattctaatggaaaatgagtaggggtgcactttagggtgtgattttctagtgaaaatagcaaaggttctctctcgtggaagttacaaacgagggcttcgctatgtgtctgtgtttcaggagtcatgcagttgttactgaatcatgagtggattgaggataagtatgctagtgctgcatgttaggcgctgaacaaaaaccttcgagtgcggcgtcttccgtcaacaacacaactcgttcagaaatacacccaatatggtcaaacagtaagacagcgctatgatgcgaacaatcttcttccaagacagtttgtcatgaaggaaagccgtaaccaaaagggttgtcattggggttataagcaggacgaggaagaaatagagaaatgtggactaggctcaatctgataacgtccgaattcctgcgcactttcggttttgttcttcgttgagatgttgaaagaagctgatggatgacggcacgtacatgaagatcctcaagcattggggcgtcgaatccggcgccgtcgacaaggccgagatcaacccgaccgatttgggctgatcggcgcactgacgctgcgggcgtaggggcatcggatgtatatagatcgatgcccctacgctttttgccgattaacgtcagcgtagcattgcggttttatcgtgtgcctttggaatactggacgtctgattggcaaatggacgattaccgttcagtggatgggaagagaatagaaggagaacccactatgtcgttgaaattcaaatcgtttgccgctctcgcgctgagcgcggccatgatgttctccgtcgccgcatgcggcaccacggattccggtgacgccaaaagcgactcgaaggcgaagaacaccaccgttggttacgatgtgagcaccatcaagaaggatgacgagctggccaagctggccgcctccgcgaagaccgtcaaggacggcgagctgtccgtcggcatggaactgtcctatgctccggccgaattctacgccgaagacggcaagacgccggtcggctacgatgtggacatgtccaaggccatcgcccagacgctgggcctgaagccgaagatcgtctcctccatgttcgacaccatcgtcccgtccatcggctccaagtacgatctgggcatcaccgccatgaccatcaccgaagagcgtctgcagtccgtcgacttcgtaagctactaccgcgccggctccacgtgggccgtgcagaagggcaacccgaagaagctcgacacctccgacatgtgcggcgcgaagatcgcagtgcagaccggcaccgtccaggaggacgaggccaacaagatcgccaagggctgcaaggccgacaagaaggccgaagtgatgtcctacaagcgtcaggccgaagccgccaccgcagtggccaccggtaaggccgacgtgttctacgccgattcgccggtcgccggctacgcgatctcccagaccgacggccagcttgaggcgctcggcgacgttgaaggcgtggccaagcagggcatcgccatcaagaagggcgaccagcagctcgacgaggccgtgcagaaggccgtgcagaagctgatggatgacggcacgtacatgaagatcctcaagcattggggcgtcgagtccggcgctctcgacaaggctgagatcaatccgaccgacctcaactgatctcatcagatagatagaaaaaggaaacagcatcatggcgaagaaacaagtcgacggcgacggcctcgatattcccaatcgcattaaagccttgcctgtcaagcgtacgggtccgatcgtggcggccatcatcgtcgcgctcttcgccgcgatgctggtgcaggctttggtcaccaatccgcgtttcgaatggaatgtggtctggaaatacctgttcaacgagaacgtactggaaggcatcaagtacacgctgctgctgaccgtcatctcgatggtcatcgccatcattctggcagtcattctggcggtcatgcgcaaatccatcaacccggtgctgcgcggcgtgagctggttctacatctggttcttccgtggaacccctgtgtacacgcagctggtcttctggggtctgttcgcggtgctggtgccgcgtatcggcgtgggcatcccgttcacctcaatcgaattctggagcattgactcccagtctgtcatcaccgcgttcaacgccgcatggctgggcttggccctgaacgaagccgcctacctggccgaaatcgtgcgcgccggcctcgaggccgtcgatccggggcagacggaagccgcaaaggccctcggcatgaagcgcacgctcatcatgcgtcgcatcgtgctgccgcaggccatgcgcatcatcatcccgccgaccggcaacgagttcatcggcatgctgaagaccacgtcgcttgtcaacgccgtgccgttcacgctggaactgcagttcgccaccacggcgatcgcgacccgtctgtacaagccgattccgctgctgatcgtggcctgcatctggtatctggtcatcacctccatcctgatggtcatccagtcgcgacttgaaaagcacttcggcaagggcttcgacgcccgtcccgccggagcccgcggcaagcgcacgccgctgccgggcaagaccttcggcgaacccaaggatgacgtcgacaagcagaacgaagccacgttcgcgggaatgaccgcgtgaggggaatgaccatgagcgaaatcacaaccaacgaaatcgttcccgccgtcaaggcgacccaggtgcacaaggccttcggcaacctgcacgtgctcaaaggcatcgacatgaccgtcatgcccggcaccgtcaccgtgattctcggaccgtccggttccggcaaatccacgttcctgcgtctgatcaaccagctggaaaccctgaccggcggcgaaatcgacgtcgacggcgaaatgatcggctacaagtacgtcgacaagggcggcgaacgtgtgctgcagaccctgaacgacaaggaagtggccgaacagcgttccaaactcggcatggtgttccagcgcttcaacctgttcccgcacatgacggctcttgaaaacgtcatggaggctccggtccacgtcaagcacatggacaagaaggaagcccgcgaactcgccattcaggagctgaaccgcgtcggcatgggggagcgtctcgactactatccggcacagctgtccggcggccagcagcagcgcgtggccatcgcccgcgcgcttgccatgaagccggagatcatgctgttcgacgaaccgacatccgcgctcgatccggaactcgtcggcgaagtgctcaacgtcatgctcgacctcgccaaggaaggcatgaccatggtggtcgtcacccatgagatcggcttcgcgcgcgaggtcgccgaccagatcgtcttcatggacggtggcgtggtcgtcgaacagggcggaccggagatcatcgaccatccgaaggagtcgaggtttaaggacttcttgcagcacgtcctgtagcaagtaaggctgtcgtactgccgtaaattcccaatccactgacgtcaagcgtccacagacgtccggtgggttgggttttctttttgctgccgacgatgggcgcgttgcgtgcgccactggttcgcacgatttccctgggggagtgggatttcgcatatatggcaaagatttgtaaggacgcgcggcttggtttcatgattgacatccttacccgataggctaaggagctatgtgtggaatcgtaggatatgcaggaaatgttcggaccgcgtgcggcaaacccttggaggtctgcctccagggtcttcagcgattggaataccgtggatatgattcggccggcgtggcgttgaccgcgcccggcatggaccatgtggcggtgcgtaagaaggccggccgtctcgccaacctggtgcaggacatcgaacgcgatccgatgccggacgccaccgtgggcatcggccacacccgttgggccaccaacggcgtgccgaacgacaccaacgcgcatccgcacacctcgcgtgacggcaaagtggccatcatccacaacggcatcatcgaaaacgcgtcccagctgcgtctcgacctgcagacggaaggctaccatttcgtttccgaaaccgatacggaggtcgcggcgaagctgctgggcaagatcagcgacaagatcatcgaagagaccggcaagcctgacctgttcaaggccgtccgccgtctcgcacgcatgctggaaggcgcgttcaccatcctcgccaccgatgtgcgccagccggacatcgtggtcggcgcccgtcacgattcgccgctggtggtcggtcttggcgaaggcgagaacttcctcggctccgacgtggccgcgttcgtggcctacaccaagcgcgccatggaaatcgaccaggaccaggccgtgatggtgtccgcagacaaggtcgtcgtctccgacttcatgggcaacatcgtgcccgatccgaagacctacaccgtggactgggatgcgtccgccgccgaaaagggcggttgggactccttcatggacaaggagatccatgaggatccggccgccgtgcagcgcactctgctggggcgtctcgacgagaacggcaacatcaacctcgatgaggtgcgcatcgacgagcatgatttcaaagccatcgacaagatcatcgtcatcgcctgcggcacggccgcgtatgcgggcatggtggccaaatacgccatcgagcattgggtgcgcattccggtagaagtggaactcgcccacgaattccgctaccgtgacccgatcctcaccccccgaacgttggtggtggccatttcgcagtccggcgagaccatggacacgctgatggcgttgcgccacgcgcgtgaacagggctccaaggtattggccatctgcaacacgcagggcgcgtccatcccacgcgaatccgacgcggtgctctacacccacgccggtccggaagtggcggtcgcctccaccaaggcgttcgtggcgcagatcaccgccgcatacgtgctcggcctgtatctggcccaagtcaagggcgccatgtatcgagacgaaatcgcccagactttggaatctctgaaggacatgccccgcaagatccagtggattctcgacacccagaccaagaccgtgcaggaagccgccgaacagatggtggatgcgaaatcgttcctgttcctcggccgccatgtgggctatccggtggccatggaaggcgcgttgaagctcaaggaaatcgcctacacgttcaccgaaggcttcgccgcgggcgaactgaaacatggtccgatcgctttggtggacgaaggcgaaccggtcgtattcatcgtgccgccggcgcgcggccgcaacgtgctgcactccaaagtcatctccggcatcgaagaggtcaaggcccgtggcgcctacatcatcgccgtggccgaggaacacgatccggacgtggaacgttacgccgacgtggtcttctggcgtcccgcctgcccgacgctgatgagcccgctggtggacgtggtgccgctgcagctgttcgccatggacatggccaagctcaagaactacgacgtcgacaagccgcgcaatctcgccaagtccgtcaccgttgagtaacgaacgcaggcaccgctacgtgctcgaggaacctcatattcccttcgaatatgaggttctgtacgaggacgagaacatcatcgtcgtcgacaagccgcatttcctcgccaccacgccacgcggcatgtggtatcgcgaaaccgcgctgatccgtctgcgcgaacgctacggcgagccggacatcgtgcccgcgcatcgtctagatcgcctgaccgccggtgtcgtcgtgttcgtgcgcaatccggccgcgcgcggcgcataccagatgctgttccaaaatcgcaaaaccgtcaaaacctacgaatgcctggctccgctcgcccctgtgcgacggccgcggtacggaacggcggtccgcatcgatcggcatatgccgtttccgctggtacgcaggtcgcatatcaacaaggaccgcggacgattacaggcgtacgaaagcgccgacgttcccaacgcggaaacgctgatcgaacggggaagcggcatccgcttcgttgccggcagaccgtacgtgaattacacgctgcatccgaaaaccggcaagacgcaccagttgcgcgtgcatatgaattcgctcggactggcgatactgggcgacgatttctacccggacatcgtgcagcgcgcgtacgacgacttctcgcaacccttggaattggtggcgcgcgaactgcgattcgatgacccgctcaacggcgagccacgtcgattcgtatcgcacgtgccgttgggcgcgggcttatagaaacccacgattttggacattcccctatctcgcccgacacgcccgattatcatggcgttctgttgacttgccggagcgtttccggcatcacgagagtaagagagaaccatgggtaaaatctcgaaagccgtccgcggcgtcgccgacatctacaacggcgcatcgctgatcgtccgtatcatcgtcggcctgatcatcggcaccgtgctggcattgaccatgccccacgtgacctggatcggcgaattcggcaccctgttcgtggccgcgttgaaggccgcggcaccgattctggtgttcgtactggtggccagcgcccttgcgcagggcacgtcgaaactcgaccgccgtttcggcaccgtgctgttcctgtacctgttcaccacgttcctggcagcggtcgtggccgtgctgacctcccgtctattcccgcagaccctgtccttgggcaaggccgccaaagccgacgtggtgccgcaaggcctttccgaagtcatccagacgctgctgaccaacatcgtggccaatccgatccaggccatcatcgacggcaactacatctgcatcctgatgtgggcctgcctgttcggactcgccatgaagtccatcgccaacgaaagctccaaagcgttcatggccaacgtggccgacgccgtgtcccaggtgatccgctgggtcatcaacctcgccccgttcggcatcatgggcctcgtgttcaccaacgtggccgacaacggcctgtccgcgttcaccaagtacggcagcctgctgctcctgctcgtcggcaccatgctgctcatggtgctcgtgttcggcccgctcgtcatcttcatcttcctgcgccgcaacccgtacccgctggtctaccgctgcttcaaggaatccggcctgaccgcgttcttcacccgctcctccgctgcgaacatccccgtcaacatgcagctgtgcgagaagctcgggcttgacaaggacatgtactccgtgtccattccgctgggtgccaccatcaacatgaacggcgcggccatcaccatcaccatcatggccatggctgccgccaacacgctcggcatccagatctccctgccggcggccatcctgctgtccgtggtctccgcgctcggcgcatgcggcgcgtccggcgtggcaggcggctcgctgctgctcatcccgatggcctgctcgctgttcggcatcagcaacgacatcgccatgcaggtggtgggcgtcggcttcatcatcggcgtcatccaggattccgtggaaacctgcctgaactccgcgtccgatgtggagttcgcggccaccgccgaataccatgcctggctcaagcagggccgtcagctgccggccttcatgtattccaagaaggaacgcgccaagctcggcatcgaagcttgattgcgtaccagcttagccgccgatgcgatatcgcagggaaccgctttggaagttcgcttccggagcggttcttccgcattcggcgtatttgggtggatatggggagcctttccaagcttgtgcgtggcttccgcatgacccgtataatcttatgatggtaatcgcaggcgaaatacaaaacggaggtccgtgggcgtggtgctgaaatcggcgaaactggtgaagcagctcatcgccatctgctgcgcgggcgtcatggcggccagcgccgccgcatgcggggccaatacggacacacgcacacagatcaccgtatggtcgtgggagccgagcatgaaacaggtcatcgccggcttcgaaaaagacaatcccgacatccacgtggtttggaagaacaccagcggttacgacaaactcaacaacgccatccaagacggttacggcattcccgacgtggtgcagctggaatattacgcattgcgccagtacgcggtcagcagccagctcgtgcccatcaccggcagaaccgaaggctatgccgatttctacacgcccggcacctgggcgtcggtgcagctcaacggacgggtgtacgggcttcccatggactccggcccgatggccttcttctataacaacagcgtgttcgaacaggttggcgtggacgcgtccaagatccgcacatgggacgactactacgaggccgccaaaaaactcaagaaaatcggcgtgtacatcaccgccgattccggcgacgccagcttctacgacacgatgatctggctcgccggcggacgcccgttctccacgtccaacgatggcaagaacgtgaccatcagactcaccgaagataaaggcacccgcgaattcaccgaattctggcagaagatgatcgatgagggtttggtggcaacaaacctcacgtcatggtcggatcgatggaaatcggccgtgggacaaggcaaagtcgcctcgctgttctccggcgcatggctgccttcgctgctcatgtccgacattcccggcgcggccggcctgtggcgcgtggcccagatgccgacgcccgacggcaaggccaccacatcggaaaacggcggttcggcccttgccgtgctgcaacgttcccgcaaacccgaagcctcataccgtttcatcgaatacgcctgccacaatgccaaaggcatcacaacccgcgtggatggcggcgcgttcccagccgacaaaaacaccctatccgactcgaaattcctcagcaagaccacggtgaccgacgaccgtggcatcgaagtgccctatttcggcgggcaggaatacaaccgcgtgctgtcccaggccgcggagaacgtgtcgaccggataccagtatctgccgttcgaagtgtatgcgcgcagcgacttccggtccacggtgggcaaggcctacaaatggtcgagcctgctgcgcaaagagcagaacaggctcaacatcatcgccgcaggcggtcaggtctccgacacctccaacatcggcgatgcgttgaagaacaccgaatcgtccgaccgcatcaaacttaagggcggcatagccctatggcagaaggacctgaaagaatacggagccaaccagggcttcaccatccaatagcgtctgtgtaattggtttaatcgattgcggcctgcggatagcgcattatccgcaggccgtcggttttcagattgccgggctatgatcgccggttcgcgtcgctggctcttgaatcagcggacgtttcggtcgtagatgtgccgcatgcccttgaaaatcaggtccggatcgtaaatgtcgatcatgttcgtgtcgtcggcgaacacgcggctcaatccgcccgtcgccaccacacggaaatccttgtcgatctccttatggaactgcgcgatcgtgcgttcgatgccgccgaggaagttgtagtacaggcccgcctgcatggccggtttcgtggacttcgccagaatcgacttcggacgggtgatctccacttccggcagctgcgccgtcccttcccacagtgcggccgcggcggtgcggataccggtggtgatcagtccggaaatcaccgacgcgtccgcggtgacgtagttgaacgtggtggccgtgccgaaatcagccaccagaatcggcccgccatactcgtaatacgcgcccgcgcagtcggcgatgcagtccgcgcccatgttctgcggattgtccatgcggatgttgagtcccgttttgatgcccggtcccacgatcatcggatcgatgtcgaggaacttcacgatgctcgcacggaacgaatgcatgaccttcggcaccacggacgaaatgatcacatcatcgacatccgccggcttgtagccgctcaaagccaggaactgcgtgatcatcagcccgtattcgtcggacgtgtggttcgccttcgtggtgatgcggtacgtgcccgcgatgcgcccatcgtcgatgaaaccgatcacgacgttcgtgttgccgatatccacagccatcagaagcatgttgcgttctccttcgcgttttgcggaagttccgttgaaatattgcgattattgcgattgatacggttattgcgattcgaaaatgctgcggttagcgccgttcgccgtccgcacgcatggctgcgagcttgacaagaatacgtttcgcaagtgcgtccttgcccatcttgctccatcgttcgatgcttggcctgtctgcggtttcgcccggcgtcagcaccgtcaccacgttcgtgtccgctgcgaaaccggcgccgggggtgcgcaggttgttggccaccagcatgtcgcaatgcttgccgttaagcttcttcgccgcgttggcctcaaggtcgcgcgtctccatggcgaatccgcacaatgtctggtccggccgcttatgctcgccggcccaagccagaatatccggattcgaggtgagttcgagctcgatgccgctgcgcccgttcttcttgatcttgtcccgggcctgctcgaccggacggaaatcgccgacggccgcggccatgacggtgatgtccgtgtccgagaaacggctcgtcaccacatcgaacatatcccgtgcggtcgtgacatcgaccacatccacgccatacggggcgtccaacgccaccggaccggacacaagcgtcacctgcgcgcccagatcgcgtgcctgttcggccaaggcataccccatcttgccggtggaatggttggtgaggaaccgcaccggatcaagcggctcctgcgtcgggccggcggtgacgagcacggcaagtcccttaagcggcagctcgccgtccggacgattcgcaagcagtagcgctttcaccgccgtttcgatgcgtgccggctcctccatacgtcccttgccggcgtcgccgcaggccagcatgccgctttccggctccacaatcgtccaaccgagctcacggcaggtattgagattgcgttgcgtcacggcgttttcatacatatgcacgttcatggcggggcacaggatcttcggtcccttgtcgtacgcgagtatggtgctggtcagctggtcatcggcgatgccgcaggcgattttcgcgatgatatcggcgctcgccggagcgactgccagcagattcgcccacttcgcgtcggccacgtggctgatctgcagcggaccgtccggtccgggtgccacgtcggccgtagcgccgggacgatgtccggcggcgaacatggacatgcgtgtcggcgtgtgggtgagggaactgaacgtcaggggagtgacgaactcctgtgcggcggcggtcatcaccacacgcacctcatgcccctgcttgctccaatcggaggcgagatggcaggccttgaacgcggcgatgctgccggtgacccccaaaagaatatgcgccatggatcaaccgtccttctcgttgtgacctgccgcgactgcgtcaagtatataaccgggccgaagcctccgcgcgctttgcgggcgaatccgaacgggccgcgggtatggcggacggtagaatcaggccgtggtgatcgacctcacgcaggcggtcaaccgcaatcacaacacataatcgaaaatacgaagaggagaaatcccatgtcgtcacctaccggtgcgcacggcgaagccgacgcaaccaaacaggagaacgaacagcagccgcagtccacggcaagcaccgacgccacgctgaacgcgcgtgcgaaatcgtcgaacggcgcgaaatcgcaaggcccgaagaagtggcttatcgcgttgatcgccatcatcgccgccgtcgcggtgatcgtcgccattgcagtgacgcgcggcaaaaacgatgacgcgaacacttccggcgtaactaaagccgacaccgtcaccatcgggctcaaactcgccccggtcagcctcgacatccgccaccagtccggatcggccatcgaacaggtgctgatcggcaacgtctacgaagcgctgctgtcgcgcgactccgacaacaaagtgcagccgggcctcgcgaaatcctgggacatttccaaggacggcaagacctacaccttccatctcaaccagaacatgaccttctccaacggcgacaagctcgacgctgacgacgtggcctggtccatcaaccagctcaaggagaagcagtactacaacgccaaccaggtggccagcctcgacaaggccgaagcggtggacgccaacacggtcaagctcaccctttccacccccgactccaacctgctgtggtatctgaccggacgtcctggcctcgtgttcgacaaaaacgccaaatacaacgcgaaaaccgaagcggtcggctccggcccgtataccgtcgaatccttcgactcggccagcaaaatggtgctcaaagccaatccgaaatattggggaaccgcgcacaagcccgccacccagaacgtggtgatccgcttcctcaccgacgacaacgcagcggtcaacgcgctgaaaagcggtgatgtcgacgtgctttctcctgtgaacgccacgctcgccaaatcgctcgataccaacacatatcgggtgtccgcggccgacggcagcgacaagttcgtcctcgccttcaactgtacgaacgccaaactcaaggacaagcgcgtccgccaggccattcgatacggcatcaaccacaaggagatcatcgcctcccgaggcaacgtcgactacgcgctcggcggtccgatcccgtccgtcgaccccggttacgaggacctgaccggcctgtacccgtacaacgtggacaaggccaaggaacttatgaaggaagccggttataccaccgacaagccgttgcggctcaccctcacctacgccaacacgtacggcaccgaactgggcgaccagctcaagagccagctcgccaaaatcggcatcgatttgaagatcgactatgtggaattctccacatggctgcagaacgtgcacgccaacggcgactacgagctgtcattggtggaccacgccgaaagccacgacttctacaagtggaccacgccggagtactactaccactacgacaacaagaacgtgcaggcgctctacgccaaggcgctcgcggccaccgacgaggaggaaagcaacgaatacctcaagcaggcggcgaaggccgtcagcgaggacgcccctgcggattggctgttcagctaccgcgtgacggtggcgtacaacacgagtgtcaagggattccccaacaagctcagccagacggtactgccgctatggcagatctccaaggcaaaatgacacaaggcggaatgatatgagattcgtggccaggcggctgctgctgttcgtggcggcgctgacgggattgtcgatactggtttttctggcattgcgtgtgctccccggtgacgttgcagccgtcatggccggaacgaacgcgaccgcagcccgtatcgccgcgctgcgcatggagatggggctcgaccggccgttgcccatgcaatatgcggactggctgaccggcctgctgcatggcgatctgggcgtatccgccatcagcggcaaatcggtcgccttgcaggtcggcgtgcggtctgcggtcacgttcccgcttatcgtactcagccttgccatagcactgctcatcggattgccgcttggctgcgcggccgttatcaccagaaacagaagatggcgtggactgctccatgtgatcgccattatcggcggtgccgttcccgcattatggagcggcctgctgctgattctgctgttctcgcgcggctcgggattgctggggcttttcccctcacagggcttcccgaacgacggctgggcgagcccaaggcgtgcattggcgtcgctggtgctccccgcgttggccaccggcatcaccgccggggccggaatcatgcgctatacgcgtgccgcattaggtgatgccgcgcaatcccaggccgtgagcatggccatggcctgcggcatgacacgcaaacaggcattgctgcgcgtcggattgcggctgtcgctgccgcagctggtatcggttatcggactgaccttcgcccaaatggtaacaggcgtgatggtgatcgagaacctgttcgccctgccgggacttggcgcaatgctcgtcaccgatgtgggcaaccgggatctgatcgcggtgcagagcgaactgttcctgctgaccgcgttcttcctgctgctggggctggcggtcgatatggcgcatcatgcgctcgacccaagactgaaaaacgcttccaccgacttgcaggaggtgctgtgatgtccactgctcgtgtggttatgcgctcgatatggcgcaaagccagcggcaaatatgcgctgaccgtgctcggcctgtgggtgctggtttcgctggtttcgctcgtatggacgccgcatacgctgctggagaccgacggattccacgcatgggcctcgccctcggccgcgcacccgttggggacggatggcgtcggcgccgatgtgctgagctggctgatggccggatcgcgcacgaatcttgcgatcgcattgctgaccgttgccgtgtccggcatattcggcctggcattggtggccgccatggtgtcgcgcaacaccgtgctgcgatccacgtcggtggtggtggtcgatgcgctgatctctataccgaccgtgctgatcgcattgatgctgtccgtgccgttcggcgcctcggcggcggtgattgtggccgcatgcggattcgcctacggactgaatctggcgcgtatcgcaagacctgcggccgtactcgccgcgcgttcgcagtatgttgaatcggcggtatggttcggagcctccggcatgcgcgtgttcgtcaggcatatcatgccgaatgtgatgccggtgctgctggtgcagttgtcgatgagcgcgggaacatcgatactggccgaggcggggctgacctatcttggtgtcggcgtaggcgccggcgtgcccagttgggggcattccctcgccacatccgtgaaattcatcagcatctacccgctgaccgtgctatggccgggactagtcgtaacgatgacggtgatcgcattgcatctgttcggcgatgcactgcgtgacgccatcgacccattgaccaatcccgagctgagggaggcggcatgagcattgaaattcgcggactgaacatcgccattggtacgaagcccatcgtgcgcgatgtgtgcatgggcatagccgatggcgaacgggtcggcctggtcggttcctccgggtcgggcaaatccatgatcgccaaggccctgatggggttgctgcccgatacggcatggataagcggttcgatcatggtcggcggcaaacagctgatcggattggacgataccgccatggccgatttgcgcgggcgttatatgggtatggtgttccagaatccggctgccgcgctgaaccccgtgatgacggtcgcccagcaggtcgggctgccgttgtatctgcattacgacctgtcgcttgacgagcgtcttgatcgtgtcaaggcgatgcttgacaaagtggggctttcccaggatgcactgctgaaatacccacatcagctttccggcgggcagcagcagcgtgtcggcatcgccaccgcgctgatcacttcgccgcgattcatcatcgccgacgagccgaccacggcattggattcgatcacgcaacgtcagatcgtcgacctgctgacgtcgctggtcgacgatgccggcgcgtccatgctgttcatcacccatgatttcgcggtgctcgcacgcgccactacgcgctgttatgtgctggacggcggttcgatcgccgaaacgggtacgaccgcaagcctattgcaggcgccggcaagcgaacccgcgcgacgtttggtcgatgcggccaggttgcttaccctgccgcatggcaacagtgctggtagcagtgttggcagccgggaatccgcgagagcgcaatccaagcgggagacgttcaagaacacggcaatcatgaggaaagacgacggcaatgagtgacatcgtgctgcaggggcgtggcatctgtacaagcttcggttcgaagcgggaacgcaggcaggtgctgttcgacgtggacgttgacgtatacgagggggagtgcctggcgattatcggcgcttccggttcgggcaaatcgacgctgacgcgtgtgctgttcggcttgggatccgccgattcgggcgagatcacgtatcgcggccagacaatggggaagcggggctctgccgtgcgccgcatgctacgcggacagaccggcctggtgttccaggaccccttcgcctcgctcgacccgcgctggcgcgtcgcacgttccgtagaggagccgttgcgcttgcaccacaagggcatgggcaatgatgagatcgcctcgcaggccgagcatgcattgcgtgtggtcgggcttgacccggcggtgttcgccgcacggtaccccatggatctttccggcgggcaggcgcagcgtgtggccatcgcgcgtgccatagtggacgatccgggcatcattcttgccgacgagccgatgagcgccatcgacgtggccgcacgcgtgaggattctggaggcattccgcgccatccgcgcggcaaacccgagcatgtcgctggtcatggtctcgcacgatcttggcgtggtgcagcatatcgccgaccgtatcgtcgtcctacatgacggacgcgtcgaggaaagcggtacgaccacggaaatactgaagcatccctgttccgcgtacacgcgctcgctcatcgaagccgcgtccatgcagtcctgatcgcaggtcggatcgatgcaaggtaggcggctgggccggctgaaccgactggatcgcctgaatcggctgaatcggctgaaccgactagaacgtgaacagtctgcgcaaccagtcatacagggcgggattcgaaacgttccagctttcgctccgccccggggtcataagccatagcagctgcaagccgatgccgacgataagcagggcgacgatcacgacggtcagccaccggcgcccattttcacgcgcatccgtgttccatacgaacagcaggcacatggtgccgatgagcatcagccatgtcatatcgcacaggtaacgcgcgttcacgccgaacggtccgtcgatgcatgcgatgaggacggcgagaacgaggaacgtgagtcctatcgcaccgcactgtgttgcgtgggagttttggctgcgccgcagtcgaatgaaataccggatggccgcgggcaatgcgagcaggcagatcggcgacagcgcgacgagtccgccggcgaactgttccggaatgatgttccgattacggaacaggaatccccatgggtttgcctcatccagtgagaacacgtccatggtgtaggggaattccctcgtgaaaccgattggggtgaggaacagcaggaggacggaatacaggcgtgctttcagactgacatgccgttgcgtcagatcgcagccggtgagattgtaggctgcgccgaagtcgaacgggtcgtcgaaacgggccgtgttgtatgccatcatcgcgcagccgatgatgaggaacggcagaatcgccgcgatggtggagaggatggcgtgtctggaacgggtggacaggatatcgcgggttcggatttgcggccataggaggatgatgccgaataccgcggtgaggatgaacgccggtctgcaggcgatggtgagcgcgacaagcgtcgaaccgatggcgatgaacggagtgcgtggggtgtgatggccatcgctggaagagcgtgcccacaatgcgatgccggcgggcgcgagtgcgagcgatgcgaggatgggaatcgaatagaaccatgggacgagcaccagatacgtcaatccggatgccgctacgattgcggtgcaggcgaggaccgcgagccatctgggggtgccatgccaatagcgcttccacagtgtttcgatgaggaatatgagcgaagcgcatgccagtatcgcaaggaacgcgcatcctgcggcggtcggcagatcggttccggtcagtgctttgaacggcgcgaagagcaggagcgccggcagcgggccgaaatagcagtagtaccggccatggtagaaagcccaatcccagcgtgacggatcgccggtttgcgcgccgagggttcctctggcctgctcgtcgtacggattatccatggccgcaagccaatcggggacatgcgcgtcgatccaggttctgccatgcaggaacgcgtcggcgagctgctggtactgcgaacggtccacgaggaaggtgccaccttggtattgcagggtgtacacgctatcggaaggatgcgtggacaccgtcagcagtacgagaatcgtcgacatcaccgcccagagaaccacgaaaggcgtccatgcgcgatggcgtttgcggttggtgtgatcggtgcggtcgatgcaatcggtgcaatcggcttccggcgtgaggtggggacggtcgttgttccccgtcgacggtcgtactcgatgtgcggggaatatgaaagaggttcctctatacataattgcactgtatatcacgtagacgcgatgatatccggtggggtgttgggcgctgcgaaggctgttatatcgcaggttattgggggcggagcgagcccgttccaggaagctgatacggttcggatgtccgcatgatgaacgcgggtgacatgccgatgtccgggggagtggtaatgtaagccacatgttcaatcgctcttgttgttgctgtcgctaaccaaccgcccgaggggcgcgtggttcatcgacgcataacttgagataggacattccagaacgttcggcgtggtcgccagaacttcgattttccggattcccgtaacgtatcggcatgatcgccaatcttcggcatacggcataccgtaaccgtatacggtgatccccgcacaagcgcgaaaatcccaacaggtcctgtttcaaccgctgcacatgacgacgcggcttcccgggagcgcatcccaaccgaatccccgaaaccgcaaagccccaaaggaaacgtcatgaccatccacaacagcaccgcagaactcatcggcaacaccccgctcatccgcctcaaccatgtggccgaaggcatcaaggccaccatcgcggccaaagtcgaatacttcaacccgggaggctcctccaaagaccgcatcgccgaacgcatcatcgacgccgccgagaagagcggcgaactcaagcccggcggcgtgatcgtcgaaccgacctccggcaacaccggtgtaggcctggccatggtcgcccagcagcgcggctaccgtgccatcttcaccctgccggacaaggtgtccgaagccaagcgtgcggtattgcgcgcctatggcgccgaagtggtcgtgactcccaccgacgccggtccggacgacccgcgctcctactaccaggtggcggaccgtctcgccaaggcgattcccggcggctaccgtcccaaccagtacgacaatccgaacggtcccgaaagccactatcacaccactggtccggaaatctgggaggccaccgaccacaaggtcacgcatttcgtggcgggcatcggcaccggcggcaccatctccggcaccggacactatctgaaggacgtgtccaacggcgcggtgcaggtcatcggcgccgatccggaaggctccatctactccgacccgaacgacgtgcaccaataccagatcgaaggcgtcggcgaggacttctatccgaaggcctttgatcggagccttcccgacgagatcgtgcaggtcaccgacgcggaagccttcgaaatgacccgacgccttgccaacgaggaaggactgctcgtcggcggctcatccggcatggccgtgttctccgcgctgaaatacgcccgcgagcacgacctcgacgaaaaccagctcgtcgtggtgctgatgcccgattccggccgcagctatatggagaagatcttcaacgacgactggatgcgagccaacggattcgccgacgtcgtggaacgcaccaccaagcccagcctcgccgaacagtacctgtaaaagaccgtcaaacgactgtccggcagcccgatcgcacctttgaaaccaatgccaatcatccgaacaacccaaaccatccgatacttccaaggagttcccatcatgaccatctcgaccaacaccgaagccctcaacgccaccgctctcgccacccgcgccatccacgcaggccaggaacccgacccgaccaccggagccgtggtcacccccatctacatgacctccaccttcaagcaggatggtgtcggcggtctgcgcaacggctacgactacagccgttccatcaacccgacccgcaacagcttcgacgagcagctcgccgccgtggaaggcgcgaaatacgcgttaagcttctcctccggacttgccgccatcgacgtgctgctgcgctccactttgaagcccggcgacaacatcctgctcggcaacgacgtgtacggcggcacctaccgtctgctgtccaaggtgttcgtgccgtggggcatcggcctcgacgtggtggacatcaccgacacggccgccgtctcagccgcgctcgccaagaagcagtacgcgtacatctgggtggaaaccccgtccaacccgctgctcaacatcaccgacatcgccgccaccgcggccgtggcgcacgcgcacggcaccaaagtggtcgtggacaacaccttcgcatccccggtattgcagcatccgctcgcagacggcgccgacgtggtcgtctactccaccaccaagtacatcggcggccactctgacgtggtcggcggcgcggtggtcctgaacgacaaggaaacacgcgacgcggtggccttcctgcagaacgcggccggcgcggttccgtccccgttcgactcctggctggacatccgaggcctcaaaaccctcgacctgcgcgtcaagcagcacagccgcaacgccatgaaggtggcccagtggctggagacccgccccgaagtggaacgcgtatggtacccgggcctcgaatcccacccgggccacgagatcgccgcgcgccagatgcacggcggtttcggcggcatgatctccatccagatcgccgccggtttcgaagcggccaagaagttcgccggagccaccgaagtgttcaccctggccgaatccctgggcggcgtggaatccctgatcgagcatccgggcgccatgacccacgcctccgtggccggcaccacgctcgaagtgcccgccaacctgatccgcctgtccgtcggccttgaggacgcggacgatctgatcgccgacctggagcaggcgttccgccagatctgaattccctatttccgatagaagcatgaaacggccggcatgggcaagacccgcgccggctgtttcgctctccgcggtcaacgcatggcattgctacacttggaaaccatgacgcaagctgttgattccgccgattccgtagacccccgcgcattggaggcgctgaaccgctatttcggctacgattcgttccgtcctggacaatccggcatcgtctcggccatcctcaccggacacgacgtgcttggcgtcatgcccaccggcgccggcaaatccatctgctatcagattcccgcagcgatcctgccgggcgtcgccatcgtcatctcgccgctgatctcactcatgcgcgaccaggtcgacgccctgaacgacgtgggccttccggccgcgttcatcaacaccactcagacgccggacgaacaggatctcgtcttcgcgcaggcgctctccggccagatcaaactgctgtacgtggcgccggaacgtttggaaaccgaacgattccgcaacttcgccgtccgtgtgccgatctcgctcgtcgccgtcgacgaagcgcactgcgtctcccaatgggggcaggacttccgttcctcatatcttggcatcggcgaattcatcgccggactgcccacacgtccaacggtcgccgcgttcaccgccaccgccaccgaacgcgtgcgccgcgacatcgtttcgattctgggtctgcacacaccgtccatcaccgtcaccggtttcgaccggccgaacctgtatttcgacgtcatcagcatgccacgtaaagacaaagcatcctgggtggcgtcctacatcgccagccatccggacgaatccggcatcgtctactgcgccacgcgcaaggaaacggaagcgctcgccgaatcgcttaacagcgccgtcgccgaattgcgtgccgcagggggtgcggatgtgtcggatatcggcaccatcgccgtcgcctaccatggcggtatgagcgccgacgcacgagagaaggcgcaacgcgatttcgtcaccgaccgtgtgcccgtggtcgtggccaccaatgcattcggcatgggcatcgacaaatccaacgtgcggttcgtcatccaccacaacatgcccgaatccatcgaagcgtactaccaggaggcgggtcgcgccggacgagacggcgaaccaagccgttgcacgctgttgtggaacgaatcggacatcgtcacccgccgccggctgctcgattcggattacgaaaacgaacgattgactcccgaagagcaggaggccgtacgcgcgtcgaaacgccggctgctcgacgcgatggtcggctactgccgtaccacggactgcctgcacgcgtacatgacccggtatttcggcgaaaccgcgggcgcggcggcgaaaacggacggcaaatgcgtgggcggttgcgccaactgcgagcacacattcgaaaccatcgacgtcaccgacatcgcccgagccatcagccgttgcgtgcacgatgtgaaccagcatgtcggcagcggtaaaatcgtcaaggtgctgcgcggctcgaaggcacaggatctaagctatctcaaccccgaaagcctgccgtcgttcggcatgctcgacgaagtgccggaagcgcgcatccgcgacgtgctgagccagatggccaccgacggcttcctgacgatcgcggaaggacgcctgccgatcgtcggcttcggaccccgtgcggcggaaacggtcgcacccgaattccattacgacatcaagaagatcaaacgtgctgacgcccgtgcgcgtcgaacgcccgacgtgtccactcccgctgtcggatcgtacgtgccggatgacggcgacgaggcgctattccagaagctgcgtgcgctgcgactggacatcgcgcgcgaactcggcaaaccgccgtacatcgtgttctccgacaagacgttgcgtgacatggtacgggtcaagccgatcactgacgaccagttccttgccgtcaacggtgtgggggaaagcaagctcaaacagtacggcgaacggttcatggccgcgattcgggaggattccggcgacgaggcttgaaccggccataaccgacacgcatggcacgacggttgacgttgagcccgcgaaccgtgaatagtggaatgtgaacacaacaacgaaaggacagaacatggcggaagacaagccggtggtggaaagcttccaattggaccacaccaaagtaaaggcgccgtatgtgcgctacatcgatacggaaaccggcccccacggcgacgtgatctcgaactacgacctgcgattggtgcagccgaacgagaacgccattccgaccggcggactgcacaccatcgaacacaccatcgcggtgctgctgcgcgaacgcatccccggttacatcgactgctcgccgttcggatgccgcacaggcttccacctgctgacgtggggcgagcattccaccgaggatgtggctcgcgcattgaaggaatcgttggaattcatcgcctacgaggccacatgggacgacgtgccggcaaccaccatcgaaagctgcggcaactaccgcgaccacagcctgttcaccgccaaggaatggtgcaaggacatcctcgccaagggcatcagctccgacccgttcgaacgccgccttgtgtgagcgttaccatgcctgtgcggtgggcgtggtagtttggacggctggaatgcttgagagaggtatacagtcgaattgaggtgaaagggttgagcgaaaccacttccgaacgtcggttccgtcgtgccaccatggatgatctgcctgtcatgctgaaaatctaccagcatgcgcgtgagcttatggcggccaacgggaatcccacgcaatggggaaacacgttcccacgtgaggaagtgatccttgacgacattcgccagcagcgcaccatgctgctggtggacgaggctgacggcaaggagcgtgtgctcgcccagttcgccctgtgcacgggcgaggatcccacctacgcgcatatcgacggcgcctggctggacgatgactcgtatgtgaccatccaccgcatcgcctcgtcgggaatcgtcaaaggcgcggccaaggactgcatcaactggtgcatcgaacattacggcaacgtgcgcgccgacacgcatccgaacaacaaggccatgcagcacgtgctcgaatcgaacggattcgcccgctgcggcctgatccaactgcttgaccgccccaccgataccacgcgtatcgcctaccagcgtcacgaatggtgattgcgcatacatagaaacatagaaaaaaggacgtctcccgtaaaactgcgggagacgtccttttccatatgaagggatgattagaacagtcccggctcgttaagctgagaatgcttgcggctgtacgtgaaatacacgaccagtccaagcgcgaaccacacggcgaaacgcacccacgtctcccaattcaaaccgaagatcagaatcaggcagaagatgatggcgcagattggcgtgaacggcacgcccggcgcacggaagccacgatgcgcgtccggctgggtcttgcgcatccacaggatgccggccgacacgatgatgaacgcggacagcgtaccgatgttcaccagctcgaacagcacgttgatgttgatgaaaccgccggcgatggccgtcagaatgccgaagaaccacgtgcccttgaacggtgtgcggtacttcggatgcacttcgccgaagaacttcgggaacagtccgtcgcggctcatcgcatagcagatgcgggactggccgtacagctgcaccagcatgacggtggtcatgccgatcaacgcgccgaggttcacgatgaacgccagccagttgagaccggtctcgagaatcacgcccgccaccggagcgtcgatgaacttcgcgaactccttgtacggcaccacgccggtcatgatgagcgtcatgatgatgtacagcacggtggacacggccagcgagatcaggatgccgcgcggcagcgtcttgttcggattgatggtctcctcggcggaggaggagacggcgtcgaagccgatgaagctgaagaacacgatcgacgcggccggcacgatgccgtacggctgcgtcgaacccggctggaacgtgtagatgccatacggggagaacggtttccagttggcgggattgatgtaccagacggtgcacacgatgaacagcacgatgatggccagcttgatcatcaccatgatgtcgttggtcttcttcgtctggttgatgccgatggacagcacccacgtgatgataagcacgattacgaagccgggcagattgaaatacgtggtgactcccggcgtggtgccgtatgcggcggtcagttcgaccggcagatgcaggccgaagccttccaacagcttgttgaaatagcccgaccagccggcggacacggtggccgcctgcaacgcgtactccagaatcagatcccagccgatcacgaaggcgatcaactcgccgaacgccagatacgcgtacgaataggcggagccggaaaccggtgccatcgcggcgaactccgcatagcacaagcctgcgaagccgcagcagatcgcggcaagcaggaaggacacgcataatgcgggtcccgcggtgagcgcgcctttgccggtgagcacgaagatgccggtgccgatgatggcgccgatgcccagcatggtcaggtcgaaggttttcagtgttcgcttcagcggagtcgattcggagacaagttggtccaccgacttcttgcgaaatagatccatggtcgtcagattccctgtgattgtttcaaaaatgggctggaccggacggatttccgggactctggcacgccttaacgccagaaatcagaaaggccgcggcgatatgcgcaacagccttgtgtatggaaagtgtaaaaaacactgccggacaaaatcgtgaaaacatcgtgaatcgtctcaccatatgtccctgatgttccatacctgtcacatagcggcgcgacaatgggagccatgactttgagcgcaacacgtgaatgggatttctcctccgaacaaggcaaagcgaactacaaggccgcccagcggcggtatccggcgcaggccatcgtcgacctcgccgcactgcgcgacaacatgcgccatctggtgagtgtcgtcggcggaccgcattccggcaccgccgtcatgggcatcgtcaaagccgacgcgtacggacacggcctgatccccgccgcgcttgccgcgctcgcaggcggcgccacgtggctcggcaccgcgcaatcgcatgaagcgctgttgttgcgcaaggcgggcatcggccccgatcgctgccatattctgacatgggtgtacagcggcgccgaagtgccgttcgacgagctggtcgacaacgacatcgacatttccgtcggctcgctcgccggcatcgacggtgtcgccgcggccgcacgcaggcttggcaagacggcgcgcgtgcatgtgaaggtcgattccggcttcggccgtaacggcttcacgcccgccggtttcgacgcggcgctcgccaaactggtgccgctcgccaaggaaggcgtgctgcacatcgtcggccagtggagccatctggcggtcgccgacgcgccggacgttccggaattcgttgcctccaccgacatgcaggtcgaaacgttcaaggacttcacccgtcgtatggaggcggccggcattccgccggaaatccgccacctcgccaacaccgcggcgacgctgtcccgtccggaaatccacttcgaactgacccgtccgggcatcggcctgtacggttacgaagccgatccggccatgggcacgccgtccacgtatagcctgaagcccgccatgaccctgcaggcgcagctcggcaccgtcaaggacgtggaagccggccatggcatctcctacggccgtacgtatctgaccccgtccgacacctccaccgcgatcgtgccgctcggctatgcggacggcatccaccgctccgcctccggattcgacatggaaggcgccaagcacgtgaccaagcccggtggtccggtgcgcgtgatgaccgcggaaggcccacgcctgtaccacgtgtccggccgcgtgtgcatggaccagttcatcctcgacctgcacggttccgccgccgaactcggcatccacgaaggcgacaacgtggaactattcggtccgggccgcggcgaggactacgccgagccgacagccgacgattggggacgtgccgccgacaccatcagctacgagatcttcacctgcctgcgcaaccgcatcccgcgcctgtacgagcatgccacggacgtattgtccgccgaggacctcgccaagctcgacccggcaagcatcctgtaatcccgtaaaaagcggcggcagccgccgcacccataggaaggcggtgcatcatgacgagcgaaggatacagcgcgttcgacgaggagcgttgggctccggaaccacccaaatccagctcccgcaccgccttccaacgcgaccgcgcccgactcatccactcgtccgcattgcgcaggctcggcgcgaaaacgcagattctggtggccggcaccgacgatttcgcacgtacacggcttacacacacgttggaggtcgcgcaaatcggtcgacagatcggcacttcgctcggttgcgatcccgacgtggtcgactgcgcctgccttgcgcacgacctcggccacccgccgttcggccataatggggaacgtgcgcttgccgaaatcgccggcaatatcggtggtttcgaaggcaatgcgcaaaccttgcgattattgacgcgcctcgaaccgaaaatactgtttcccgacggacgttccgcaggcgtgaatctgacgcgtgccgcgctcgatgcggccgtcaaatacccgtggacgcttgccgaagccgccgcgcatccgaaaggggagcgcagcgcgaaattctgcgtctatccggatgatacggacgtgttcgcctggctcaaacaacacgcgcccgacaccacccgccgtcccgtcgaatgccaggtgatggacctgtccgatgacatcgcctacagcgtgcatgatgtggaggacgccatcgccaccggcgcgttcaatccgggcgtgctgcatgaaagcggcgtgatcgacgcggtcgtcgaggacgcgcgcgcctggtacggaccgcaatgggacacagacaagctggtggccgcgttcgcacgcatgcaccggcgcgacacgttccccggctatttcgacggttcgcgacgcgcgctcgccgcattgaagaacatgaccagcaatctgatcggccgattcgccggttccgtggaacaagccacgcgggacacgtacggcaacgagccgctgacccgatacaacggcgatctggtgattcccgaggaaaccagttacgaaatcgtggtgctgaaaggcatcgccgtgcatttcgtcatggcgcccggcgaacgcgagccgatgcacggcgaggaacagcggatcgtcggcgatctggtggacgtgttcatggcggacaatcccaaaccgtccagcgcgttggagaacgtgttcctcgacgattggcgcgaggccggcagcgacggcgaacgcctgcgcgtggccatagaccaggtggcgagcctgaccgacacgtccgccctgaccctccactcccttctctgctgaacgagctggtaggctggaccgtatgccgggaatgatcaagaaggaagacatagaaaaggtccgcgccaccgccgacctgtatgacatcgtatccgcgaccgtcacgctcaaaccctcgggaaccggcacatacgtaggcctgtgccccttccatgacgagaaaacgccaagtttttccgtgcgcccggcgcttggcgtgtggcattgcttcggctgcggtctcggcggcgacgtgttcggctacgtcgaacatcaggagaacatcgactttcgtgacgcggtggagctgctcgccgacaaataccatatcgaactgcattacgacaaagccgacaacgtgcccgcgcacaccggttcgaaacgcgcacgcctgctcgaagccaacgaggcggcgcaggaattcttcgtctcccagctgatgaccaaggaggcgctcgccgcgcgcaagctgttggacggtcgcaacttcagccaggccgactgccagcggttcggctgcggatatgccccccaaggatgggataacctggtgcggcaccttgccggcaaaggcttcacccagcaggagatgctcgacgcgggactcgcccgtcagggccagcgtggcgtatacgactatttccgtggccgcgtgacatggccgattcgcgattcgaccggccgtacgctcggcttcggcgcgcgcaagctgtacgaggatgacacgatcaatgcgaaatacatcaacacgcccgacacgcagctgtaccgcaaaacacaggtgctgtacggcatcgaccttgccaaatcggcgattgtgaagaaacgccaggcggtgatcgtcgaaggctataccgatgtgatggccatgcatctggccggcatcgacacggcggtcgccacgtgcggcaccgcattcggcgccgagcatgcgaagatcatccgccgattgatcgcggacgattcgttgggcgcggtgcagctggttggccccctgaaggtggaggggcaggcgttgagctcgcgtgtcgtgttcacattcgacggcgatgcggctgggcagaaggccgcgatccacgcgttcggtttggacgccgcgttttcgacgcaggcgttcgtcgcggtcgccgaagacaacctcgacccgtgcgatctgcgcatcaaacgcggcaacgaggcggtgcgtgcgctgattgccaatgcacggccgctgtacgatttcgtgatcgattcggcaatcgaccgtttcgacaccacgtacgcgacaggtcagatgggcgcggtcaaggcggtcgccccgctgatcgcgcaaatccgagaccgttcgctgctcgacctgtactcacgcaaggcggtgcgtcgcatcggcgtcgatctggacatcatgcaacgcgaagtggcgtaccggcgtcgcaaactgaacgtgcgtgacgaggacgcgtacgcgccgaaacgtcgattccaaaacaatgcggggccgtcggctgaaccagcatatgcggaacgtggcgcgaatccgtatgcgaatcccgccgcacgcaaggcgttggagcatcgtgacgcggccgggcaaagctactatcgcatcgacgacgccgtgttcatctgcgaacagcagttcatggccacgctgatccaggtgccgttggcagtcgatccgacgatgttcgccagcctgaccttgtcgagtttcatgacgccggtgttccgcacgctgttccaagcggtcgccgcggcgggcgggcttccaggggaagacgtgccgcagggactgtggatgcacaatctgacgaaggcgggcggtccgatgcttgaatcggtcatcaacgagctggccgtcatgccgctgccattgccgccgagcgaagcggacgcgaaccgcaatgcaggcgagtcgcaggaacaatcggcgcaattgcgcaagccaacgcaggaggagcggcggtacgcgtccgaactgatcgtcagactgcttgataccggcatcatgcgcaaaatcggcgcggcccagcgccgcatggcgcaactgccggacggtgcagagaaaatcgaactgctcggacagatcaccaaactggaaacgctgcgcaaggacctgcagtcgcgtgttttcggcaacaacgttgcgtgacacgcccatatggtgaatcgaaggcgaacggaagatggtttttagacaaaatcttggcgcacgcggggttaatttgtgaagatttgcgggccttgttttcggtttcgccggtttgcaaaagcatgcggcagtaagcaatagtggatgaaaatcgttggaatggtcggaaaagcagcacgccgagggttcgtgctagtcgcatttttgggtaaagtggtctaggcgtttgcatgaaaatcgcttgggttttgcaaggtgtgcaaggcggttgcaaacgagattgacggaggaatgcatgcggcgattggtcgtcaaggtcctgaagaacgagaccattctcgtagtcgcttccatactcgcactcatatcgtgcttcatcgtgccgccagacaaggaatacgccggctacatccacgccagcaccatctcgcagctgatttgtctgatgcttgtggtgtgcggcttccagcgcatcggcgtgttccgcatcatcggctcgcgcctgctgcatcacgtcaaaaccgcgcgtggcctggtgctcacgttgatcgcattgccgttcttctccggcatgctcatcaccaatgatgtggcgttggtcaccttcgtgccgttcgcaatcgcggtgttgacgatggcgcacatggaagagcatgcggtgcttgtcggcacgctgatgaccatcggcgcgaacgtgggcagcatgctcaccccgatcggcaacgcgcacaacctgtatctgaaagcgttgacggacatgccgacgtccgagatgatcggcatcatggccccgtattccgctaccgcagccgttctgctgataatcatcacctgcgtgattttcggcagcaaatcggtttccgaattttccgcgatcgatggttccgacatcgaacagaacgtactcgccccgcattccgaccggccgcagcctgacgagattcgcgtgaccggctacggtgccggttatggcggctggcgtacgatcgtatacacggcgttgttcgtcgtctgcttgctggcggtgagcgatttcattccgctgtggttgatgtgcgtcatcgtgttcgtggcgttcctgctatgcgaccgccgcgtgttccgcaacgtcgattggggactgccgctcacgttctgcatgttcttcatcttcatcggcaacatgaaacgcgtgccggaattctacgagctggccgcctcgctggtgggcgcgcatccgctggaagtggccgtggtgtccagccagttcatctccaacgtgccgaccacgctgctgctgtccggcttctgcgaccagtggcgtgaactgatcatcggcaccaacctgggcggcttgggcacgctgatcgcgtccatggcgtcgctgatcggctacaagaacgtgacgcgcgcctacccggacaaaaaaggccgttatctggccgtctacaccgcggtgaacgtgctgttcgtcatcgtgctcgtcggcctgagctggattatcgagtagcgtttggccgtcgaccggtttccctgaccgctaatctcaaggtcgccggttcgcaccttttgctgagattgcatgaaaacccttggaatcattggatttcaagggtttattgttacgtcggctgatggtctggtgctgtgataatctgtgccgggaagcgtgtgccgagaaacgtaggaaggctgaacatgctgcaaggattgctgggaattttctccggactgatcacgccggtgcagaccgcggtgaacacgcggctcggccgttccatcggctcgccgttgcgcgcctcgctggtgtcgttcagcgtcggcctcattgcgatgctgactttgacgctgctgcttggcccgtatccgctgattcccgccaccgcggcgaacggtccatggtggatgtggttcgcgggcgtgttcggtgtcactttcctgaccggcaatgtgctgctgctgccgaaactaggcagtctcaaaaccgtgatcatgccagtcaccgggcagatcgtcatgggcctgctgatcgacgctttcggctggttcggcactaccgagcagccgatttccccgctgcgcatcgcaggtgcggcgatcacgctggtcggcttcctgcttgccgtcgccggaccgaatctgcgattgaggcctgccatcgatcgcccggctggcggttcggaaaattccggcgattccgaaaaatccgaaactgacggaaaagccgtacatgtgccaggttccgcgaccgtgctgtggagttgcgcaggcatcgcgttcggcatgtgttcggccgtgcagacggcgttgttgggcaagctgggcgtcgcgttgggatcgccggtgaaggcatcgctcgcctcgttcgcggtcggtctgatctcgcttgcgatcgtcgtcgcattcgtcgaccgcacctacagcctcggcgacgcgctgaagaaaggcaatccgtggtggatgtgggcaggcggattgctgggtgcgacactggtgatgtgcaacgcgtacctgtccgcgcatatcggcaccggcatgacggtgatgctggtattgctcggtcaggtcggcggaggattgctggtcgaccgtttcggcctgcttggcgtgccacgcaagcccgtggccggcatccaatacgtcggcgtgctcgtagccatcgtcggcattgtgctcaaggcgatgtgactgccgtgtcgagttggcaaccgtgtgcgaactgactatactgtgtttagtttggccctgtagctcagctggatagagcatgtgacttctaatctcaaggtcgccggttcgagcccggccggggtcaccatcaagccctcgcgtcgtttcatgcggtgcgggggctttcctgtccattgaacggcaagccattggcttgcgaagataggggagaccatgaagcgaatcgtcgcgggcattctggcgcatgtggacgcgggcaagactacgttgtcggaggcgctgctgtacgctaccggccaagtacgcaaactcggccgcgtcgaccacggcgacgccttcctcgacacggacgccatggaacggcagcgcggcattaccatcttcaccgagccggccgtcatcgccacgcccgacctcaccatcaccctgctcgacactcctggccacgtcgacttctccgccgaaacggaacgtacgctcgccgtgctcgactacgccatcctcgtcatctccggcgcggacggcatccaaggccataccgaaacgctgtggcgactgctcaatcgctatcaggtgcccacattcgtcttcgtcaacaaaatggactcgcccggcgccgacaaaacgcaactgctcgcccaactcaagaaacgcttctcggacggctgcgtcgacttcaccgagccgattgacggcgaacgcatggaggagatcgccatgcaaaacgaaacggccatggacgcgtatctcgacaccgaaaccgtgccggacgaaaccattcgcgccatgatcgcccgccgtgagctgttcccctgctatttcggatcagcgctgaaaatggacggtatagaacagttcgtcgcaggtttcgaacggttcgcgcaagagccgcaatacaatggcgaattcggcgcacgcatatataaggtgtctcatgacgcgcaaggcaaccgtctgacctggctcaaggtgaccggcggcgaactgaaggccaagatgatgctaagcggcaccgcgcacgccggcgacgcggatgcggttgccgaagacggccaatggcatgagaaagccgaccaggtgcgcgtctattccggcgcgaaatccaccaccgtcgacacggtccccgcaggcaccatctgcgccgtcacgggtctgacgcagacattccccggcgaaggcctcggcatggagcgggacgctggcagtccggtcctccagccggtgctcacgtacacgctggaaccgggggagtgcgacatccacaaatgtctggtggcattgcgtgagctggaggatgaggatccactgctgcacgtcgtgtggcagccgcgtctcgaagaggtgcatctgcagctgatgggcgcggtgcagctggaaatcatccagcagatcatgcatgaccgtttcggcttggatgtcacgttcggtcccggcggcattctgtacaaggagacgattacctcgccaattgaaggtgtcggccatttcgaaccgttacgccactatgcggagacgcacgtgctgttggagccgttgccgcagggctccggtatggaatatgcgaccgtgtgcagcgaggacgtgctcgaccgcaactggcagcgcctcatcatgcagcattgcaaggaacgcgagcatctgggcgtgctcaccggctctccgatcaccgatatgagaatcacgctgctgacgggtcgtgcgcatctgaagcacacggaaggcggcgatttccgccaagccacctaccgcgcgatacgccagggcctgatggaagcgaagaagaagggcgattgccgtctgcttgaaccttggtacggcttccgtctggaagtgccgcaggacatggtcggacatgcgatggccgacatccagcgcatgtcgggcacgttcgacacgcctaccggcgacggcgaatatatggtgttgaacggcacggcgccggtatccgaaatgcgtgactatgcgatggacgtgaacgcgtacacgcacggccgtggccatttaagctgcgtgttcgccggctaccagccgtgccacaatgccgacgaggtgatcgagaacatggcttacgatccggaatccgacctggagaacacgccggattcggtgttctgcgcgcatggcgccggctatccggtcaaatggtacaaggtgcccgaattcatgcatctcgactacgcgtgggatggcatgcgcgaatagaaccgaaagacagacgggtgggaagcgccgattgcttcccacccgaggcatgttgtcggataccgacaaacggataaacgaaaagccccaccgaatcggtgaggcttcatactggagcggacaacgggactcggacccgcggtctcaaccttggcaaggttgcgctttaccaactaagctatgtccgcaaaggtttcctgccgtgagaagcaggaaaccagtgggtgatataggaatcgaacctatgaccccttccgtgtgaaggaagtgcgctagccgctgcgccaatcaccctcggctcgtcaggcccacgaaacgtatgattcttgctgtgggcttcggcatatgcctgtgccgccgactccttcgcctcgctgatctcgccgttcgccgtggtcaggtcgctcttggtctgcgcgatatccttccgcgcctgcgacaggtcggattgcgcctgcgcgagcgacttggacgccgaatcaagaccagtcctgttggcttggatgttcttctgcgcctgcgtcagcttggccgtattatcccgcaacgtggcgttggcagagttgatggccgactggttcgccctgatgtcagacttcgcggattcaagctctttcgccgtggccgactgcgcggcctgattcgcggcgatatccttccgtgcctgcgtcagcttcgcggtgttatcccgcaaagtctccttgttgtcagccaaatcctgctggattcgcttgacctcctccggcgacacggcggaagccacggtgacagtggcgactaccgaccagtcggatttattgcccgcatggtcgatagcacggaacgcatatgtgtgcgaagagccagccgtcaaaccagtaatcacataatcgccgataccggtcgcgacggccgcgatctccttgaaaacaccatcagccaaacgttcgccgagaatattcctatcccaatcgataggcatggaaccaccatcagcggtttttccatcccaattaaccgaaaccacgcccaactcggaagaaagaatcggcttggatggtacaggaggaggagtcgtatccttggcgacggtcaacgcgaacacgctggaccattcgcccatctggtcggaatacgatgggatagcacgcactctgataagaatctgaacaccgcaatccagattcgaccaagataacgtatgctcagtggtcgtgccagcggaatgccactcatacccagtcttgttcacacgatattcgaccgcatacgacgtgatgtccatggcggtgccatcagtagccaacgtcacatcatcccaacgggccgtaaccatgccacgcgcatacccgttcacattgatataagcgtcggaattggccgacagattctgcggagccttcggcacacgatggtccttttcaggagccggaatcgcaccggacgctccaccaagatgagcgccgccagtaataccgttcatacgcttcgtcaaacgaaccgaggaatcataattcttatcgttcagaatcagcgaagccttaaacccagtcgagtcgagttgcaaagtgacctgttggacacggaccttctcacggttcgccactgtaggcgcggtaatccaatcgcctatcgtgtaatcgatgagcggcagacaagacgcttcgaccacgttcacggatcgcgtgtactgtccgcgaaccctagccgcgttagccaacgtcggcttgatgagatgttcggcggtctccttcttgttcacaccctgttggcttgaatacaattcccaaccgccccaaggcttcggggcgttcggattatcctgccggaaattaatattgtcgccacgtacaaggatcgaggaagccagaccatcaatactctcatcgtcaggagcttcggacacatcctgagcaagcgtcaccacacacgatttagacaagtcacggcatatggcgacactatccgcgttccataacagcagttgccgggcatcagtacgccaatcgcataagccgttgttcaccagcgaatccaacacgtcctgtatggaaatgccaagatcgtaatatatgctcggcagcatgtagccccactgtttgccagcggaatcggcactagaagtgaaccggctgcaatcaactttcacgccgccacgattccaattctcatccatgaacgtgcgcatgatcgtgccagcgttcgcgttcgcgaatttacgggtgcctttctcgtcgccgctggtctccaatctggacgtgtccagattcaaagccttcttcaacagccacccgtaggaaacgccggtcaacgacaccgtgtcggacacgtccaaagcgttccttgaacgtgaagcgataacaaaccggccattatacggttcaatccagcgtccaccatcagacacttccacggcgatttccaagccggtttcaagacgccggtcaagaatctcaccacgcaaagctttacgcgaatagctgacggtcaaagcacctacagcatcatgagtgaacgacacagtataggaagtcggctcaggcagcaatccaagcttgcttccattggcctgatatgcgacaagacgagattttagagtcttacccataagcatccctcaacttaaaaagaaagaagccagtggaaatcaccaccagcttctcttaaacctgcacgccacattcccggaaccagtggccttaactgcaatcctgtagtcaccagaaacatcaggattgacttgcaacctaccggaaggcagataatccaatccgactgtctcgttctgagaaccgccagaccatgcggaatcactatcggaactccatgcagtcaacgatcccgcatccaaatacaagtaaggccgagcatccacgcgcgtgccagaccatgtgataccggtaccggataccgtatccttcaccgttatgcccgtaacatctttcgggaaacgaaacaccatgtctgttatgggagcgtcaccgcaactatacggaagttgagtggaaagcacactcggactagcgttcggaacgccctgccagaacgtgtagtatccggcggacggcatcaccgaaccgccggacatgaccttcccaccgttcaaaggcagtgagacggtctcatgcgtgacggaacgccaccacacgtcaggcatggcgaacacggcagtgaacggaacaaacctgttcggatgactctttgaatcgtcaggactcaaagaggtcaactcgacacgggtacgctgctcgacaccatcgacaatccgactcatgacaagattcggcatcgtgcacaaccgcatcagcctggatgattcaccaagcacatcaggctcccaagcgcatacctgcaacgacaattgacgttccgaaaacctaggcgtcatgccggaagggatagaaccatgccgttgcggaaccgtcgaaacggtacggtcaacactgatggcgctcaacaatgtcgaaccaacagtaacgatgcagttctccgaatcaagaggaacattattcaacttgtagaaacacgtggaaaaagccacgatactcccctctcacatgccgatcatcgcagccttgtccaacttctgattcgtctgaaccgagattggcgtgatagtcggatattggaagttctgcgtgatgttgtatgtagggccgctttcaaacttgacatcgtcggaagaacctgccgaatagtcagaaaccatggaaggcatcgaaacacgagtcatacgacgcgcgttcttcaaatactggcttggaatgtcgccactcgcattgatggcgctcatcactcccttgccgtacagagcctccatgctatgcactgcggcggcacgcacaacatattcaccggtggacacgtcagtggaatcgttcaaagcgatggaatcgctcgtgttcgttccgcgtccgacgatcctgccggtgcgagtcacattatcgccctcgacctcaccgcctgtcgcacgccttctcttggttccgaaaatagcgttgaacgtcctgctcgcccaacttctgccctcggcccacaaagtgccgagcattccccagaaactaccggaaatatttccgccgaactgtgcgttatacgtgcttccattccattggttcgcggtgcgctcagcactgcgtttcgccggctgggtgttgtccctcgcgccgagtgacgcggtgggtctcaacgaaccgtaggcgttggcgtcgcctttcaaatagtcaatggtcatcgaagcaagatcggaagccttcagattggtcgtatagccattgccatcagtgcctttcttgaacaggtcggcatgtttcctgacctcatcggtagcgacaacggcctgattgccgtctgcgtccaacacgatggtgtatttgcctgaaccgtctgtgctcgcattgttcatgagattgttcacggttgattgaacctcatccgcgctggacaatgctccgctgttgatgccgtcaaggaccgtggtgaagatggccgtattgccctcgccggggaacaatgcccgcaaatcagacaagtaggatgtcagattctgcttcgactgttccgtttcggtcttgaacaatgtcttgacctcttcaggagtcaacccatacagttgttgcagtttctgaatctccgactccggtacgcccatcgccttcgccgtctcgtagaactgtgttgacaattcctgctgtttcgcattcacctcatcggttgacgcgccggaagcgaccaactgttcaagccaatcatggcctgtcgtagcgagattctgcaagctggtctgagccaactgtccagcctcggtcatgttattgaacgagtctgcggcactgtcccaaacgttctgtacgcccaattccttgatgcgttggatggaatcacccaaaccgttgtaaatctgaccatattccgttgcgacactcaaagcgttctgctgcgcggtacgctgattgttgacaatgtcgttgtacttctgtgcggcactgttcaacatctgctgacgttgagattgagtcgcaatggcgatggaaaccgaatcggaatcctcacccatctcgatcaaactcttcgcatagccggcagcatgaccattcgcgacggaagtcgcttccgcattatcgatgtactgctgacgtgccttttccattactgctataagcttcttggctgcaccagcttcattaccgtaattctgcgtcgcggtagccgaataagtgctgtgagcatcatatgtggccttcaactgattcatcatcgagttgtaagccttcgtactgccgctcgcagccttgctcaggtcagtggtcgaaacaccaagcttgtcggcggcttcggcagtattcttgaatccagttgtccaatcatccaaccagctccaaccagtctcagcataattaccgtccttgaacgcatcctgaatcgcggaagcgacattggataacgcgccggaagcttcggcggccgaatcaggaatcttacccaacgctgccgcaatattctcggaagcacgctcagtcgcctgagctttcgcattgtaatcggaatacgctgcgactgctgccgtaatggcagccacgccccaagtcaccggattggaaaccgtagacgcaagcatcccacccaaaccagacgcaacagccttcaccttgcccatcgcgccctcagcagagccgacattcgacacgaacttagaaacagcgggattagacgccgcccacccctgagcgacattcttcaacgtcacaccagtaccggcggaagtcacgcccaactccatcaaagccttctgccattgcagcgacttcatcgtgttctcaaccacggcaagcttcaccgtgtccaaagcggtcttgccagccttgccgaacgtggcgaacacgcccaacgcggcctgaatcggttccggcaacgcgctgaaagccttagccacagcctcggcggcggtagcgatagcctgaatcagcggagcagaagcacgaagagaagcagccaatgtgccgccgaacgtcttagacagttgcccgacagtcgaaagcagctggctgaacatcggactcacatcgccaacagcgttgaacaccttctggaaaccatcggaaacaccagacgagaaatcggaaataccaccgctactgttcttcaacaggcggctcacattcttcgtgaacgaagcaatcgtcctaccggcatcaccgaaaacatttcccacggtatgccgcagagaatagccagcgtcaccaatctcggagaatgaatcacgcatcgcggactgcgccactttagcgccaacggcccacgacttcaacgtgtcttggaactttgccgaattgacagccttatccgccttctgcaactccttggagaagctttggatgccattctggtcctcagccaaagcggaatacaagccggaagcaatacccatgagcgctttcacggaattcttcaaatatccagcctgttcaatgacacgctgcatcgacttctcaatctcaccggacgcgcgtgcgttatcgacccaacgtgcgaactgatccgcaagctcactcacataccgtgtggcacgagggagatactggctagttgaatcgccaagattcaggaaagccttgacaaggctctcaacacccggttccaaataagtcaacgacttattcacatcgttgaaaatgctggatacgacgcttgtcttatcggcttccttgaccatcttggtcatgccgacgacgattcgtccctcatggtcggcaagagttgacatttggggaatcaacgtgtcggcaatggaatcagccaatccacggatggccggacgggcctgaccgtagaacgcgttaaccacgctgtcggacagcttgcctaactttgtggatgcaatgtcgatctgctcgctccaagtggcgcccttttcgccccaaatcatcttcacggacgcataggcggcgcccaatccaacgagagcggcaggagcggccaatgcggccttcgacatggaaacaatcgaagagccgacgccgagcacgctacgggacatgttgatagcgccagcggaaacaccggcgaacacggtacccaatgcggagaagaatggaaccttctcatccagcgagtccatgaaattcacgaacttctggaattgattgtttacagcacgcaagcctgtcgcgccatacgtcatgccatccagcattttgccgaaatcagtggcatggagtttcgcgtaaatctcgatggaacgcgggcgggtgagcatggcaagatgagtacgggcaccagccgttttaaggtcgatgtccatttcaagcttcttataatcctcttgaagcttcttggccttctcacgcgcacgggtcacatccaaatcaagattggcctcatagtggtagttcttatccttgccggcatggaacgcagcaagattcaacttgtcgatggctgaccggtagtcggtctcgatgtcgttcggaagactgcggaatttccgcttcaacgcctccagttcgcgttccatgcttttcgcgccgtcgagatagaccttcgcatgggcgtccatcccatcgacctgccgcaaacgcttggacacgttctcaagaacgttgacaacctcggaaacatcgttgacgtcaacacggatgctcgccttgctgttgcgcttcaactgctgcatcgcattgtcgagctgttcgacgagacggttggcgcgagccatcgagacattgttggaactgcccagaggcttgaccttctcgatcgcatcctgcatactacggatgtgcttcttgacgttatccaaaacgtcgatctgcttgttcgcgtatgccgtggtcaaccgcgtgttacgtttcaccgcgtcctgatacgatttgcttttcagcgtgaccttgcgccaagcatcgccaccattggcgatacgcttgttcatcgcggaaacggccttgtcggaagactgaacttgcttgcgcatcgttcgcagatcacgcaaagcgtcggtcagctcgactttcggggatactttacgtttatcaatgtcccgaagaacacgtttcagatcggagtcatcgccacgaatctcaacattctggacgatgccatcatcctcgatacgccttttcgccgcacgccaacgagacatgtcaacgtcaggcgtcacacgaacatcgaaatcgtcatcggcgtacctggcgagcttacggcggagttcttcgccaaaacccttggtgttcggataaatatcaattccaacggaaccggcgagatactccaccataagaacccctgtttttcaatcacatgcccagaaacgccttcatcgactcgaagttggcggaaacacgcctatcaacgccatcggcggcgtgagggggcataatcggtttgaactcagggtgcttgccatccttgaactgcaatgtgccggaaaccagcaagccgacctgattgtaaatacccaacagcagactcgtatcctgagtgaacccgtgaaaactcaaaccggaatcactctcggactcggcgctggcacgctcatcaggatggttcagcaaccattcccgatacaacgactcgtcatagccggcaagaccgccgataagggtcaaaagaaaaccgccgtcatactcatgcatggcggcgggaagattcagattgtagaacctacggaaatcacacgtaagctctactttgcatttccggtaggcgtccttgacgcttcggattttcccaaggacgcaccatagaatgcgttaagcagagtgaacacctgcaccagaacagtcggagtcctgccagtgacccacttgtggtaggcgtcaacgtccttggcgatcttctcgaagaaactatcgctggcagccaccatcctggctatagccagacttgaatcgacatcatcggaagtcttcttgcggaacacgccgtaactgtcggacgccacggcatcgacgaccatgaaatcgcatgtctgcgccacggagaactcatgagccggaacgaactcagggcatccggccagttcctcgtgctgttcgacgaactcagccagcgtgtcaggaatctccggaacggtcttaacggtgttcttatcagttttggaagccataatctgtaatccccatcaaaaacccatctgccaatcgttggaaaggattgcccccgcacggatgggtacatgcgggggcaataggaaatctcagcctttcgaggtcaaacccgatacggtctgggaggagtcacccggattcttaccgctggaatccgggctggttattttgacacgaacgtctccggggcgaaaatctggtacgcgccaacctcaccattggcaccggccttcagcacgctagtggatttcacgacggcgttgaagctgaactccgcgaaatcctcatcggcgaggctgacgttatcgaacgtgaaatcggtctccggcagatacaatccgaagctcagcttgtcggaatcatcgtaggcgagaacgaacaacgccagatgctgcaccacgggctgcaacggcacgacgatgccgccctggtcgccggcccagccgccagtgaccttcgtgattgtggccgaatcaccctgcacggacgcgccggacacggtgatggtcggggcttcggtagaactcttcgcaccggcgacaagccacgtgtccttcgtggtggtgtccccgccatccttgctgaagctgatcttgttgttgttggaggtatggccgatattctcccaattcgcgacggaaccgctgccagcggcggcaacagtgccactattcaacaagaacgaggaaactttggtcggaagagcggtcttcgcgggagccgtgaacaacgtaccgcgagacgcctgaatcagaccatcggcattaatagccataatggtgcctttctacttgaaattgataaaagaaaaggcctgaccgataccggtcaagccttgaacgaatcgcgggcagtcacaacagccgacagcccatactccttgacgttcttgccttgattctcttttgaatcagactgcctcttctgcgccgtcacagacacggtgccaaccgtcccagctgtcgtggactcctcgaacggccaaccctgcaccgtcttatacaagtgacgtgcaaaaccgtgaggatcgttacagtcagcggccaaaaccgtgaacgtcacaccgaaacgccacaatccacggtcaaactgttcgggagcggaaacataatagagaagaacctgtccacgttcaccgtaagcgttcaaaggcaagtcaagctcgctgcaaaccttcacatcaggccactcctcgcacggatacgcccgattcaacagttcataaaccaactgttccgcatcaatcgactcacgaacatcaatggcaagacgctgaaaaatgttgtccgtcacaatctcacccgactcaacgaatcaaacatgatatgttttcccggaatacgcgctctcggatcacgaggcccatacttgtgttcaagccaccggttgaaatagccgaactccaaatgcggagcgacctgcgtgccatcacggcccatgacggacatgacaatctgatgatgccagccgactttgcgaacggaaacctcgatcctatccgcaacgcttgaatgcgtagcggcctcattcgccttcgcgcggacggcagacacgctatgcacggcggcgcggcgtgtaagttccggcccatacatcttcgcaatatcggtagcgacgctacgccgaatcgtgacccttcccaacgccacccacctccttcacccattcaggctcggaaatgccgccatcaagataatcgccaataacaacacgacgtgcacgaacctcccaatgccgggagaaacgagaaccactcccacgccacgtaggagcgccgtcagcatcgtaataatcgcccttataccagatccgggaataaatgtcgccgggccattccctcgcaataatctgcaaaggagtgacctcttccaaaccgccggggttatccgaagatggcgtcttatcctcagctccagaaatagagaacatgccagcctgctgcgcacgaccctcaacacagcagatgaccttcaccggatcgccagtctgcacatactggccgccgtgcgcgtcctgaacatgcttgcgaggaatcacaacgacataatccgtgtcgaacagctgtttctgaccaccgtaatgggtttggtcatcctcgtagaggtaatggcgttcattcgtatcatcgtcaaacagaaacgccatcatcaacctccataaccggggtcgaaaccaagactgatgtgtgacatcgtgccagcggattcagcgaaaccattcagaatcgatttctcagctttcgacaagaacagccggggacttggatcatagccaggctgattctgctgcggatcatgctccgtgtacgagtaagaaccgttcgcttcggttttgaaccggttgaaacgtactacgcgtaacaccatttcgcatacgaccgacgcgaaatcactttcagagagacgccctttcttcaagcgtgtccggacaatcgggcattcgctcaaacagatgagagcggccttgcggcattgagcggaaatccaatcagtgtcgaaatgctcttcaaatgaatccgcgtcggcggaaccgtagacgcgcatatacttcaaccagtcgatgttgtcgatgattgccgtgctcatacgcgcctcctacatcatgcggccagtacagtggccttcaaggtgctgttggactgcactagaaccggcaatgcagtaccgttcacgtaagcctcgtatcccggagtcgaagacggggtattcagcacggctccgatagggccagcgttcttctcacggctgatgccatatgcaggagtctgagcttcagcggtcggccccaacgcggtgtaacccatgttcacgtcaccgaaagccggaatcagcaggatggtgttctcagggaagaagctcttgacgccgcccggaagagtaatcttggactggcgggcgaaatcacgatacctttcgtcaacaacgtaaatatcctgaatgccggtgtacaggctcaaaacgctcttcacatcattctcggaaacaagagccggaagggtggaaccctgaccacggaacaagtagttgatgatggccgcgttggacgtcaaagcgttcacaaccttacgggtggtgaccatgatggtaggacgcgcacccttcttatcgtcgataaggtcggaccatgcacgcaaatccttgaccggatcaccagtcttgtcccaagtcttcgtagatgccaaagaagtggatagtgccgaatcacgcgcataatcccaagctgcatcctcattggattctgtgatgccgagcttcgcgtcaacagcgacagccacacgcgccttctccagacggtaggccaattccttgcccaactgaacgaaataatcgctcagagtggtcttcaaatctccgttggccatggaaatgttgccatttgcgatgtccttttcggacacgcgcatacgcttacgcaacggcagcatggaagtgtaggacagcttctcaccgccaacagtacgaccatacggtgcctcagcatcccaagtggagaacttcatctcatcaacctcaggatcatcctgattcggagtccattcgacagacaagccggtgaactggtccggcaggatggaagcgaacggcaaagctgccgtagttgtctgataggctcccagcacgatggcggaagcctcgtcgggagtaatgatgtccttattcaacagactcattgaaaaaccttcctaatatgcgaaaacccgccatgatgggcgggtttcaaacgggtagaaactaaactcagtcagtatggctggtgtcacttggatgcggcggcagttgccggattcaacacggtcacatgcggagctgcggcgcccttgtcataatcaaggaacaatccctccaacttcgccttgctgaaatcaacggtgtacggcagattcttcttatcgataacacccatgtagcggacgccgacagtcggatactgatcctcgaaaccggtacgagtgaactgcacatgcacctgagactccaagaagccgatgatcgtgccattacggccatcgacggcattcggatcgtacgggccatagttattggttccagtaatctgagccagcggaataccggatttagtccaagcctcgtaatcatcgtcggtaatggacgcgaagtaatcgttctcatgcgacttatccttggtgaacgtagacaagtcaagctgcgcttcacgcacaccatcggtgatacgattgataagccaagactggtcatccttcggagcggtcttggcgacagtatgaaccatctgattggccatatttatctccttataaaactatttcttgatttcggaatgcttcacgccgtagttgtaagcgtcggaaacgcttgactgcggcttgcacacatgcatgtttctgctctgcaactccttcgccaactccggcgatggctcacatggagcattcccatcattctttttctgcaccgcttcaaccgtttcagtcttgctcggcatgaacttcacaaaagcgtcagcccattcggaaatcttttccggctcagtctccccacacaaagtgtcgaaagcctcgtcggtaatctctggatgcagtttctgcgccttcaaacgggctatctgcacgttcgccttggcaagagcgccctcagtgtcggcaagcttcgcttcggcggcattggcacgatcacgattctcatacatcttctgctcgttctcacgagcctgatgcttccacatgcccaacttctcggaaaggtcatccgcaccattcttttgagtcgcggtatcggcggctacaggagaagtggcagtgtccttcggctgcgcgttcacgcccgtttcaggcgcattcgtggatgccgccgtttcagcggtattggtattttcatcagccattaggcttgaatcctttcaatagtgttatgcggcttcgccaagcatcgaccgcatctggttgagcatggtcttctgccatgccatagcctgtttcaaattcttggaaggcttgaacgtgaacgtcctaccctcatagcggaaagtcaccggtttaccggccttctgcacttccttgtaacgccgattgaactcgattgcccgattctccatacgacggcactgagccaacgtggatttacggtcaggcgtatgccaagcgtcagaagccttcgacggaactggactgggcgtatccttcgcatcctcggcaagaagcacagggcccaactcgccatgagtaatggtcttgaccttcacctgcttcaacgcggacgcggtagtaccaccagcctcggcgtacaagcgtttcaaatccttctgattcaactggaaacccggatcgtaatcactgccagccggtgccacaccacaatgacagttagcgtgcaacggcaacaagtcagccgtcgaataccatcggtcagccgccaccacgcacaagccacaagaacccgtcttggacagttcgggatgtaacaccctgcgatactccaacaccttgctatccttgtaccgttcaagcgtggcgctcgtctgcgccctcgaaacatcctcgtcaacagtggtctgcaaacggttgaacgcctgttcaatccacttatcaacctcgctgaatatctcatcggtcttgctaggccacgtttcaggacgaatcgtggggtttttcaccgcaagactccgatacgtgtcagccggacgttgcgccacaagccacggatcggtattgtcacgaggaaacaccaaactaggcacatcccccttcggagtgacgcccacaagcttcaacgtctcattcgcataggagacgcccaaacggcgcacctgctgaatcaacgccatctccaacaacgccatacgggatgcgacggcaaacgtcataccatcattccaccagtcagcgggcgtcagcatgtcccacattctgtgggcttgactcacatactggttcaccagcgttgcacgagcctgttcaagcgtgttagacaacgattcaagcgacttaccggccatcaggactcggactcgccttcatcgacaagctcaccctcgacgttcggcaaaccatccacagcggactgggtttcatcatcccaacccgtagccggttccacagcagcaacaggcttcgcattactcttattagcctggccggaaatgttgaactggtctgcaagacggttcatatcatcctccgacacatcctgagcggtgaagcccatcttgtgcgtgagaatcgtcctacgcgccaacaagccactctgatacaacaactggcaagcctgagcctgttccagcgaactggtcgtgtccatcggcttccacaccatctcaaactcggacgccgaagcattcgcggttttagacgcggccaaagccatacgcaccatacgcacgataggctcagaatccaactcgttcatcgtctgcactttgaacttcaacgtctcacgcttcaactcagcaccattggcggaaccctgcacgtcaggcgaaagaatatccaacggaatgccagcggcggaagccaactgcttcacatcggccatgatgttgttctgcaaagaaccggtatcagtggtctgagactcccaaatatcaacaccatcaggaagcttccacaacgccgcagggccaaccgcgaacgtggatgccaaatcaataggatcaccagcctgcttgtctccgtcgatgacttcctgatcctcttcggtgtacgtggttggaacggtgcctttgatggcacgctgtcggaatgcttgcatcatcgtgatgcacaaacggtcgaacgtttcacggtcgatacgtttcagcatcggcagatacggctcgaacaatccctgcccgtcaaccgtgctcaaacgtacgatagggagcgaatcgcatccctccgcataagagaaatcagatgcttgtgaatcctcagcccactcccaatcgctaccaggctcccaagctttcgcatcagacgcgaacttagcaaccgacgaaacatcgttaggatcaacaacggaacgatcatgttcacgttgtgccgtcttggaatacactttcgtcgtggtcttgctgtcatcaacaacaagacgatacaatcgaatgacttccttgttctcgcggtccagatacgtgtattggatagcagcagtctcaccaacatccatccagcattcccaagggctgagaggcgtgatgaatcttccacgtccagcattggaaaccaagccaaacgagcatccgtaatcgcctttgtctggcagcatattgcgacgaagaataaaattcaggccgcattgtttcgccatcctatcggcatcagtgtccttcaacgaggaatcctcgaccttacggaaaccattaggctgctgacggtcggtcacgctctcactgatacgacgggcgagattcacgacacccaactggcgcatcagcttgtacactggggcagcgttcggatcagtgccttgaggcacactgttcgcatccaccatctccctgccatccttgaacagtttcaattcggcaagatacggcagacgagcgccccactcccgcgccagattggtaatgacgtaagcatcatcgtcatcatcggaagcgttcttaatcatcaacgagtcagacactcgaaatcaccacctagtagattctcatcggagcggaacggcgtttaacctcagccaactccaaatactttccacgagccgtataagccaacaggccagccatgcacgcatcaatcttgtccggcgaattaggagactccttataaatcgcatacccggtacgagtctcacgcctacgagcattacggaaatgattcaccaaccgcggatcagcaagcaacgctatatcatccttgaccggcttagacttacggtcaggctccgtatacgggtaacggaacgcggtatgcgcgttatccaacgcgacctgcatgtccttataccagttgttagtccagaacttgatcttgtcgccgctcttacgcggcccgaccttcaacttcttcccgtaatccttctcccaaccgccaatcatctgctcgaaatacgcgacatcagcgaagaagccgaccacattgtagttgtccatcatccaacgggccatgccgtcgaacgcatcacgattcacacgccaagtggccttctcaggcccgtcaggagcggactccaacttgataaggaacaacatgccatcggacacgcggcaacccacaagcgccgtcgaatcatccgacacggaaccatcgaaccccaacgtgataggctcacgtttcgtcacgaaccgttgccacgcgccatccaaacgaatcgaattgaacgcggtatgcatttcatcccgatacagcatgtgggattgaatgtcggactccgtaagccaagcatcatgcacgctcgacaaagtgttgaaatagtagcgcatcgaatccgcagggtctgaatcaggctggtaaatctgatccatctgaccattcaggtcaatccacccatccttcgacgggccaagctcaccatcccaatacgtgtgcccctcggggtcaacaccatcggcgttcaacacggtcatacgaccatcgggcaatatcagatgatccttaccgtccgaactcttcgcactcgcaccatacgcgacctgcaaggcgcggagaaccttcttctcgtcagcgaaatcatccaagtcgatgttcgcatacacatggtcgaagtagatgccgctacgatgcttgatcttgcccgaagcggtatcccacgcatacttgtacgatgtttcagcgatggactcttcgcccggcttgtacatggtggacgtttcaagaatccacgggtctgcatcacctttacgtttgccgaggttacgttgaacggtcttgtacatgttgcgaagcttgttcgtgttgtacaagtgggtttcatcgcaggcggcgaacgtttccaaaccgccatccttggacgcggcaccactcgtggtgggaacaatctccccaccttccggcaagccgatacgggtacggccaacatcaaggccgacacccttcaactggcttaaagggccttgatcgcagttgtagtaaatcgaatcgaagatgttaccagtctgaccttcggcggtagccaagcagagaatctgcggcatctgcaccatacgtccgacaggctcacccttcgcatacgggtagacctcgcccagaaactcgtaagtctccccttcttccgcccaatggtcgaacctgcaaggagccaaaccctcgaacgcgcaaatgccagcggccttaccggacttgttcttacccttcgcacgcgaatagaacacacgattgaaccggcgggtaccccactcggtcaacgcataggcgtgaagcatgaacacgtactcgtccatgtcgaacgtctcgggcaagccaacgccgccaccacgacctacacggaagaaagtctcaatccaccagaccgcgaacattcccatcgaacgagtcaaatcctcgccatgcaattcgggaatgcgcgtatgcatcaggcaccaccgtcaatgacacgcaaacccaatgcggaagcacgctgcctgttccgttgaacgttacgagcgccctcggtatcgccctcatacgcggaagccttcatatcgtcaggctgcggagcatcgaacttcaaccgcacccgagcctcgggtgtaatgcccaacgtggcctcacgctgacgaatctcggaagccaacatccaacggcccttagtcttcggacgccagaaatcatccttcaacaacgccaaatcctgaaccgcgtaccagtcggcctcaacacccatacgctgagccaacggactgacacgaagcgactcataccacttcttcgtccgttcaagccactcctgcccatcagggcgaacagcaggaaactccaaacccatcggactatcaggcgcacgaagaatcggattcttcgacttctgcgcaccacgaccattaccagccacagccagcctcacaatccgcccgtttcaggcaatacgcgaagctaggacgttccaccctcgcaacgcttgtgaaccagcagacgattcgccaaagtcgcactatgcgacttctccaacggaaccttccacacgaaagcggcaccatcggcaccactcgaaccaacatcaaccggctcatggcatttcgcgcacaagccgccacacttctcaaccacctgagaatcagtaaaagactcaacaacaagctcggactcaagctcggacacgtcaaccggacgcacgtacatagtcgtttcaggcttcaccggcaacgacttatcatcatcacgagcacgcttatacgccacacggcaacgcccagaacaaaacaactggtcggaacgcttcggatcaaaccacgtatggcattgaggacacatgcgctggcgcaacggcttcagcggagaccccgaataccggtcacggtcgtaatgcgaacgacacaatcccttcgcacacaccggattagcgcaaccggcaaccgcgcacatgaactcattcacttgaaagccgggtgagaataccaacgcttctccctccgactcctacccttcgcacgacgaacctcagcagactcaccctcggtcttccgctgatgatgccaacgacacaacacccacaaattctcaggacgatcatcatcatggacgggattacgaaccttatggtcaacctcattcccataccgtccgcacaggcgaacattcccgtaatcatccttgaccggccactggcacctatgcccatcccgttcaagaatcatcgcacggacacgcggccaatcaggattgaaccgttcatcacgatgggaactagaccacgccacagtgacctccacaaaaacagggttggccggtgctgagcaggaaaacacgccaaaggggaaacatcccagcaggaaaagttctcagatcaaccaacccaagtgctccgggagggattcgaaccctcacaccctacaggtagcgcattttgagtgcgccgcgtctaccattccgccaccaaagcaaaagaacaagcgtctcacactccacccacaacaggagcatgggacgctcgttcaacccccagagagccataaggaaccaatggcatcatcacaatggctttttaccgccagccacggcgtgcggatgctgagggagtcgaacccccgaacccttgcggattgccaccttagcgaggtggtgcaataagccactctgccaagcatccaaaatgcaagagccgccgcagcgactcaggagactgttcccgcagactaggcgggtcagctaaaactagagccgccacaagacgactccgaagacctttcccacaacctgtgggtaggctgagcacagcatgttggactcgaaccaacatcgacggttttggagaccgtaatgctaccggttgcaccaatgccatatacccgacttagttaacgtccaagtcggaaagacgttcggcatggtggaatgggctttaccaccaacggcaaggaacgtgaaacatctatgcacccgtttggccgtgcctccccttcggtcatcaaccacctgattaaggcagggagcctcttatcccccacatgttccagcggagatattcgagcaatgccatcgatctcataggcagctaccccatgaaacctagagcaaaccccgggaatcgaacccggcaaccaaaaggctgtgccaacaggattgcagaccagcccaaaataataggtacgagtccatataggccacgcccgggatagaccggtcggactgctgaccgtaccgcatctagaatcctcacactccccttgtgagtggacggtcagacgttgatgtggcttaagctagcttcaccgccatcaacatcaatccaaggaacattatacacaatatgtagggtgcaacaacggttgcaaccactaaatatgtgaagacttcgtgagtaacgggtaatccaaaaatgttccagcgagcattcagcgtcagcactagagagccagcggccccggcttttcaacccggggggaccctcccccacccgggggtttgttgtatatgcaacgttggaacgtttgttcggttgacgtgttgcgtgtcgtatggtatcgcgcgggcacgttcctttgtgtgcgtggttgcaggtgacgtgactgtgcatgatcgtggccgtgtcgtgcctgtgaccgtcgtgcatggccgtcgtgcctgtggccgtggtgtcgtggccgtcgtggtctgtggtggtcacgtcgtggccatcctggttgcgtgtgtggcgtctcacgtctgtggcggtgtcatggctgtgacgtggtggtgtgacgtgtcgtgattatgtggtgctatgcgtggttgcgacacgccgatgaatgctagtgtttccaatggtttatgcggtgtctgtgttgtatcgacttgccattcagctgaatggcgcgtatagtgatagccatcaagcaaacgacaacgaaaggaacagagatgaacgagaggccaccaccacggagaccaccaccgcaaggacggtgacacgaagccccccctaacgggcgcggcatggatgattgacaactgaagagtggacgcgacaatgaagcggcggagtgcgactaggcatgatgcaccctcacaccatgcaaggccgaaccgtcgtcgagtcgccaacgtggcgcggtgtccggcatggaattgtcccgcgctgtctgagtggtctacaatggcctctaatccaagttaggagtagggccatgagtttgaaagaattaagaatgaaacgcggattaacgcaacgtgagttagaagaacgcagcggcgtgcatcacaacgctatcgctaagtttgagactggcgagagaaacatacgtgacgcgtcgcttgatactgccttgcgcttgtgtgacgctttgcgtgttgctaatccgcgcaaattgcttgattctgattctaagtcttcggcggagtgatccgccacagggctagcgtagtctttatggcacgtctagcccacgaatgagtagagccggatagttgcagctatccggctcaattgctcagtaaatgtatccaatcaattaaccaagcggctctaagtctagcagggccgctagataggagtatcaaaatgtattcgatcgatgagacttacaagaacatcgaagccgagtttaagccccgcagcaagtgggaccagggcgtgaaggaaaccgcgctggccgtgcttgattcgctcgacatgcccgaaacggttcttcccgaccacttcggatcgcgtcgcgcgctgttgctgaacggcgcggacaattggcgggaatacagttacggcgggtgcgctctcgtgtgcaacgtggatatcgccgcccggttcttcaccccgtccgaaatgcgccggtacatggctgatggtcatgatgcaagcatggcgttccgtggcgagcctctgcttgacttgcaggcgcgtgccctcagccaggcggagcgtgttatcagccggtacgcgcgggaacactgaggggcaagtcatgtgtgagaagtgccccatcgatcaacgttacccgtactacggttttcctgtgacgccagattcccgcaagctgcgggatgaggccgagcgttaccgtgagatcgctatccgctgtttcgttgccgagagcgattgtgccgacgtgaagctggcggatgcgctgtggcgtgagatgtgccgtgccggtgatgaggcgcggtttctgtgcagcaatgcgcgtcgtttggagatggaagaagccctacagtgtcgggctatcgaatatcccaattgtcctaatcgcaagcgtatgcgctgacttgttccaggctttcgggcgtgagcctatcaatcacgcccatatagcccgttcgggcattacattccaacacaatcgaggtgctttaaaaatgtcttttgttacagttgattttcctgatattcgtgaatctgattccgcagagtatgcgtatctcgccaacgtgtacaacactacgtattcacacaatcaaaacgcttggcgttcgcctgatgaaaacaggcttgacggaaccacgtatgccgcgtggtggttgatggatgaatactatacgcgcggtgaacatgccatgattggtgagtgccgccgcctgttaacgaaacgttgccgtgcggaaatgcacagcgaacacaatagagagttttgcaccggattctacacggttgttgattccgttctttccaagtgaggtgttcgcaatgcgtaagaagattactctgcttgttgccgtgcttgttggcctgttggctttcagcgtggcttgttccacagcgctttccgatcagccggttgccgatccgcatggcacgccagagcagcagtggacgtggtggcgtgagacttatgccacgaaggattacaaccaagctgacctagcgagctaccgcgagttgtcagccattccgcagtgcggcatggaggacggtagcacttcggacggttacgagcgtatttgcgagtggcgtggaagcgttgacggcaatcaatccggcacgtcatatgtgctcgtgagtggcagcaaggttttggaatggtgaaaccgctcagggccgtgcggttgaacggcccaatcaaataatcaagttttttatacaagggagttttaaaaatgtcgaacaaagttaacggcctgtgggcagtcaattcgtccagtgtcttcatgtttttcgattccgtcaatagtccgagcgtgtggcgtttcgagatgaaggatggcgttgaatcatggcggatgattccgggcgtgaagaatgctcaggcggtgcgtggtgtagctgccgcgtatcgtgctgacggtggtacgtggcttgaccctaacgggtctgattatgctcaggccgtgagtgagattggtgacgtgccgttgatcgtggaacgtggcgattgcatggtttcccctgattgtggggattatacggcgcatggcgtgagcctgtcggacgccgatagggagcatggttgggaattgtcttatgaggatggcggcatggttgtgtcacgtgacatttcattcctcaccccggccgagcgtgaccatcctgagatgtgcgagacttacgatgatttgccggttgtcgcccctgaaccgcaggcggttgagcctgaaccggatacggttgagattcccgaagtgccgccgacaccttccaaggatacgccgaaggtgattgcgcagcatggcgtcaaggcgcgcgtggtcacgattccaggtggcaagtcggtcaaggagttggctgacgtgtttggtggatatgtgcataagccgcgtggcttccgtgattccaagggccgtcgcgtcgcatatgtcgcgttcgacggtaagagtggcgtggttgcgtaccgtgactactaccagcgtggcagtgaccaaacgttggaagagtccgtggccgcgtacctcgctcagcatgagattgtcgaggtggcatgaaatgtcacgtgtcgtcatcacagcacagcaggtcaaggccgctttggaggctaccggctattcgtccatcgagtcgaatgttcaagccgtgttgagggagattggcaagcgtcccgcattgataaccgcgtatctcagcacggttatcaacgcggctgccgacaatctgcctgatccgcgtcatatggattgcctgttctgaaaagtttggccggacggtatgcctagtaccgtccggccattgcaaacagtaattaactcaaccaaaccatttgcaaggagattctaccatgtcccgccattattacgctgtttattggccttacggtgtcaacactttcaatttcgaccatgagccgattggtactgttgtcccattcgatacgactaaagcgcgtgacgcttacgttgctgctgaccggttcgacggtaattttcataggagcgcgccggattatcgattgacgcgcaagatgatgcttgaggcgctgagagagttccgttcgttggattccaagggctacgaaggttggcgtgtggatggcgtcttctatgagtctcttggtgatgcgtacaaggcgatgttcgatgctgatgcgcagttgcgttatgaactgttcggtgacgttgattcgagggaggcgtgagtgtcatggaaacattgaaattgtgggctgattttcatgttggtcagcaaatgtatgcatatgaccattttgatgtggtcgagcgtaagcgttattggcgtcccgtgtcgaaaacgtatcttgtgtgcgcgtggctgcgtgacttgattcgtgggatgcgtgatgcgcgcttgggtggattccagggttggttgtactgcgttgtcaaggatggcgggttcaccactcaggagttcatggggttcaacgatgaaatcgaggtgttgtgatgattgacgtgaatatgctgccacgtgagcttaccggctatgtcggtcatgtctgcggcctgtggttcggcagttattttattgattttgagcatgtgttcgtccattccacggcgggcatcatcggtgaactgtacgaatacctggtggatacggttcaggacaattcgatgaatggcggcttggattatgaggatgcggaagagtacgcgaagttggcggctaccgttccgtggtctatggaagagattgaccacgtggcggaacagtctttccgctacgtgtctgaccgaacgttgcaggtggcttacgccttgtgtgtcctcacttttgatgcgatgttcccgcagaaaatcgaggttgtcaaaccggacgtgcgggagacgttgttgagcgtggcgttcccgcatgattggcagcgccgcatggcggagtctgaccatgatcgcgtgagcgtctaccgcatgggtttggaatgcgtgacgaaagcgtatgacaaggttttcgaccgtcttggggaggctgactgacatgacgcgcagtaggaacagacggcttcgcctcatcccatcgcaccttccgctgatccgcgacaaactcgcggaatacgagcgggtcgcattaaaggaggagatggctgcgcactctcaatacgagcggagcatggaagcggcttggaattccgccgacaatctcgccgtcgcgcagctttggtggatcagccgagacatgacggcgctggcggaagataccgtccaggcaggcgatttcccgaaaatggacgcgccggcgcaaagcgggcttatcttcttcgacgggggtatccaaaccgtcacattcaccgtgatcgacgatgcgacgggaagtaaggtcggagccgcccacgtgtcggcactcttctggcaatgcgacggcgacggcgatatcgaactgatgggcttcacggaccatccatgcggccttacggaatgcgacgcgaaatcattctcgctgccggtcgtcaaaatcaccagcgacgttttcaacaggcatgtcggcggtatccaatggttctacgatctgctgcacgcggtatgggcgttgagcgcggaaccgcatatctgcgaggcaaaaccggcgaaacctaatatggagcatccactgccgccgcgtttcgaccccgaaatacgcaaggtcaagatgctggtgctgcgcgagaacctgcatcgtcctggcggaagcgccgatgatgacgagcgggtgcgacgtgagtattcgcatcgtttcatcgtgcgcggcttctggagggatcaggtgtatggtccgaatcattcgctgaggcgcaggcagtggattccgccattcgtcaagggtccagccgataagcctttgatctgcaaggagacggtgcgcatatggaaacggtgagcgacatgatcgccggttttctcgccggcctgacgccgggtacaagggcggggtatcggagcgtcgtatcgcgatggctccgctggtgtgcggataacggcatcgacatgctgcgggcgaagcgcacccatatcgaggcgttcgccgcctatgacggcggcatgcggccagcggcgaaaaacacggtgtgcaggaatctgagcgtcgtttgctgcctctaccgctatctctgcgaggaggggtatatcgactgcaatcctggcgagcatgtgcgtaggccgaaactgtacggtcattcggatggcacgtacctcacccgcgagcaggctaggctttttctgaccgaagcacgcggtatgggtgcgcggacggatgccctgtgcagtctgctgctgttgaccggtgcgagggtcggtgaggcgcttgggttggatgtcgaagactgtcatctgaatgacgggcgtccgtgggtgcggttcgaccgcaagggcgactggtctcagcgtgtggccattccctccgatgcggccgaagctctcgcacgactcattggcgaacgtaggcgtggtgcggtgttccgtgaggattccggcgcgcgtctgcggcagcagaccgccgtgggcatcgtatcgtccgtggcattgcgcgtgggcgtgccggatatttcgccgcattcattgcggcgaacgttctgcacgctctcccgtgacgctggcgtgccggacagggacatcatggccgcaggcgggtggaacagtccgcagatgctcgactattacgacatgtcccgtcgcgggctgaatggcaaagctggcgacggattgcaggattatctgggcaaggaggattgatttccacaacacgcccgacttgaaatgttacctttggtaacatatattgtagttagcaacaaacgggaagcatcaaggcatccccacaatcacaaggagattgaaatgattaccattcgtatcgaaaaaaccagaggccacaagtggaatgagactggcacattcgcactggagttcccgaagtcggaattacgaaagcgcgtctatgattgccagctcgacaaggacggcgaaaccgaagacgcatggctttgcatcccgtccgaacggctccgtgccaagtatgagcggctcgtcgctgacgaggagtccacgcaatccgattacgacaagctgtacgaagagctttcggcttactcagacacgttgaccaccgagcagctcatggactggttcatcgacctgaacgatcctgaaaccatcagcggatggaccgagcgcatcgaagcccacaacgcctacatcgacgtgatggagccgaacaatgcggtgctcaggaacccgcttgacgtggattcgacgttccatatccgcatctacgattacttcatcgatttccatgaggatagggagattgtggacgacttggagttcaccccgtccgacgtggaggcggatgattggacggaggacatcaaacggtgtcttgaggaaaacgggtggcgtcttgactccaagatcggaacggattccgatgattccgatttgctggtgttcgattgcgtcaaggcgtgacgtattccgctgaaaatcgttgttctgccggttccagcgtgtttttcatgctggaaccgacgttttccgtgttttcatgattgtctggaggtttgatgacgtttggatcgaaggccgcttttcgcgcggcacgggaacgctgcggcatcagtcagaagatgcttgccgaccgtttcggcaatgccgtgttgacggtgaaacgttgggagaagcctggcgaggcggaaccaccggcagacgtgcaggcatggttggaaagtatgctcacgcagcatgtcgaagcggtcgaggccgcgttggatgcggtggacgggattgaggaagtccaaggcaacccgcctgaccatgttgacttgctctactatcgttcgcaggaacactacgaccgttacggacgggacaaaggcgattacgcgatcgtcaatgcccgcagcagggagatagccgcgatccttgaatcgcagggtatcgaagcgcggttccgttatcccgaggatgatgaagccggtttccaacgtttggcgaacactcgctaaacgcatttgttgttaacagggccattgtagaccactcagacgttgcttaacgcggtttgtagccagttgtccactaattcggcttcgttgactggctcgaaacaccatgcgtctaatccgacgttgatctcattgtgatgcctgccgaactcaagcgggtcatgcgcgtgcgtgtgtccgtgcaggagcagagtgttgttcatgcgtggtatcgcgtattcggctaattccggtgcgttccaattggttgagactgcgcctaggggtttgctttgcgtgaagtcttcacgccattggtagtggcttaaaaataccgtgtgtggattgttgccccactcgtctctgatttcggtgatgccgactcttccgacttccacgaacacgcttgccaacttttccagcgtgcgggtggagctgtgtatttcgtggttgccgagaatcagatgcctgttcttgcgtggtacatgcaggttttggatgcgcattatcgcttggtctacgctccacgtatcaccggaactgatgtctccgaggatgtagagttcgtcttcctcgccaacatacgtgttgattgcgcgcacgatgtcggcatcatgcttccgccagtcaacacagttcttaagcggcttatgctcacgttcggcctgttgtttgatcgatgcatccttagcgtatccaggtagcgcgtatccgcgtagcgcggccacgaacggatgcgcgaaatgcaagtcagcagtaaaccacttcatgcgtcctccatgtttttcaaatgcccgtatttttcatcccatttgtccaatgcttccagcacttgcggtaatccgaaatcccaatacgtttcgccatactcttcgccttttctggtgcggtacgagatgactaacgtttcagggtcatcaccgcacgtttcgcagacttccggcacccattcgtggtaataccagtcggtgacttccacaggcgcatcatcagtgccgtcgaacagttccggtgattccatcacgagcacgcgtagcatgagttctttagtggtttttccactcatggtttccccttatttatggcatgtacaatcgcgttaaccattcgatttcatccttcctcttcgattctcagttccttgtcgccattcacggttgcggcgatatcgtcgttgaactggttcgacaattgaaggacgatgcacgcgcgcgtctcgtaccgcaatactggtgtgaaaccggttgaggatgtgaagcaaacgtcggatgtgaataccggctggtttcccaaccgtgtttcaaactttttgagcgtgccggacatgaccacttccccattgtctaggatgctgacgcgcttaccaaaatgcgtggcgttgaggtgatcagcggtgatggtctgcttgctcattcctcgtatcctccaaggtaggttttgcaatgcgaatcgagtatggtttcaaaaatgtctacgactgcacaccggtgttcgcgttctacgtcgtgtgcgcgtgattccgcttggtcgcgcgtcttgtaagagccaatgagagtcagctcttcacctctgtacggtacgtgcccatctggagtcatgtatgcgattacaagatagattttcatgcgtcctcgattatgattggcgtgtcaccgtggatggtgacgttgatcgtgtctcttgtggtcaggcggatttgcgtgtcgatgcggacgatacgtttgccgtgtgttggttcgggtggcgtgtcttcgccataactgttgacgcgcctgtatgtgacggtgggcacgtagtttggtctggatgtgaattgttccagtctgccttcgaccactatcgtctggctgatcgggtctaggatggtgatgggttttcccacgttgtcggctttgagattagctcctgtggtttcagttgatgccactgctaccgaatcctttcgtgccgcgttccgtatttttttcaagggtttcaacgtggtctaagggcatgtgtggcgcacattgcgcgaacacgatttgcgctatcctgtctcccttatgaatctcgaacgcctgttcgcccatgtttcggaggattacgcatacttccccgcgatagttggggtcgattacaccaggcgcgttcatcacggtgatgttgtgtttgagggccaagcctgagcgtgggcagatcatgccgacgtatccggctggtatctgcatgtacacgcccgtgtgcacgagtgcctggctgttggcgcagactatcgtgtcctcgttgcttctgaggtctgctcccgcatcgtttgggcgagtgtagccgatgttttctctgatgccgctgaattgcattttagttgaacctttccgaaatgagtacgccgatgatgccgatcagccatgcgagaagcatgatgaccatcatgattaggatgatgccgaatggaatccagacgggtgcgaacacccacagccacgagtaggggaattgtcccccgattttcaatagggcgagaatatctgtcagcaacactaggattagcgaacagtcgatatgcaccattattcctccgtgtagaaggtgatcgtgtggagtttcttcttcacgtcgaattgttccccgaacatgcctgattttttgacgggttcgatcacgtcgcgcatgtgatgcgcgtgataggtgatggtcttgcccttgtcggtgatgctgatggtggcggtcattggatgatttcttccactaggctgatgttgcttgcctgaaccgtcttgctgatgccgttgtacaggtttttgaacgtgaatgaaaatggtttcatgcagttctcatcttcgaagtcgatgatgcattccatgtcatcccaacagtcaatccacggagagccgaccagtctggggctggcatgagtgtagacgatgacgcctttctcacagtcggtatacgagtatgcgaatccgagttctttaagcttgacggcgtatggcggattcgataggtcgattttcactttgcatcctttccgacgagtccccaaatatcgtccactggagtggtttgctgcatcagcatgtacacgtccgcgatacggtagatgggatgccgcccttccttgcgtaccggggtgagcttgcccctgtgcgcccacgatttcaacgtgttcgcggatacgaggtatccatcctgttggagtttgcttctaatgtccgaagcagtccccgtgtaagtgctgtgtttgatcttgtcttgcatgagtgtcctcaaaaagttgatgttccaaacgttcctgcatccacggcatttgacttgttttgccgtctcgtcagccgatagtggcatgttgcagtcggtgttggggcaattgcccaagctgacagtatggccttgattcaacaggcgctggcacttgtcgcgtgcgatgcggatttcaagcgcgtacacgggtgttgccgttgagcatagacacgcgggttcgccttgcttggttttcttcacggctatccgctgcgccaacacgttcaacggatcgtgattcaggtattcgacgcctaagcatttagcgaacgcggatagtgtgccccacacgctatccatgtgttcgtcaccctcatacaacaggtcgaacacttgctctcgcaatggcggattatcagagtatcctcccccgccaccgttagcgtcatggttcttgttgatgcggttcatcttgtcggtttccaaaaatccgatgttcttcgtgaaccattccaagtcggctaggagccgctgttcacattcagggcagagttgcctggtatcgtctcgttcacgcccgcaccgcaacagtttgcagtcagccaatcgcacgccttccaaaatcatggtatgttgattccgcaccggtgcccgaaggcgtgcgattaatgccggaacatgtctagtataccggttgcacccaaccttgcaaccggtattggattaacgtctcaaacagtctcccgcttccgttttctcttctcgggatgaagcaggtagtagttgcgttcgtaggccgcctgttcctcacggctgaaatggtggaatgtcggacgatgcgcaagcttgtatcggcggttgcattccaagacttgctcacggtgggccatccgccactgtcgcgtgtgctcacgtttccgtgcgagctgttccgcagtaagcttgaccggctttttcgacgctttcgccttcttctttccgactggcggcttctcagacggcttgcgcctaccacgacgaagaaccgctatgtcaaccgcgaacattttcatgatctcgtcggcggtaggctcattcattccgtttgctccaatgatgcagtagtcctctcgatcacgtacaacacgacggcctcattgttgtccaatgccagtgggttcgctgccgtgacgttgatgattttccacccatcatccagatagtcgatgagtttagaatcattctgcacacgcacaccgttaccggtgaacttcgtgtatacggggattagctcatgttccattatttcgtttccccgtccttgccgctagcattgtcccaatcgcaggaaagaccgcctccccccttgtagacgttgaacctgatgcatgtcacggccctaccgtcgtgcaactcgattctgcactcatcgacagcgaagtcgcctcgcacatcaatgcagtcactaccgccttcaacatcgtcagcatccgcttcgttctcgcatccggccagcgggaaaaccatcgctacggccataagcacggccattagccctcgttgaatattcttgtttcctatcatttcgtctccttgattgtcttatcccgtcgatttcgacgggtttgaatgtggtctagaagtgttttgccatccagtcggcgatgaacaacgcgacgatcgacgcaaacgacgcgaaagaaagcaaaccgaagacaatggtgaaaacaatcaaaacagccttcattccgtcaccgccttacgtgccacttcgagcacttctttcgcccgcgcgatgtagtcttcctgatatccgcagatttcaccggcgtaatcccatgcatcgtcttcgtccttcgccacatagtcgctttcgatgccatcccattcgcagctgttccagcagagccgtttcgccacggcctccacctcggcgtcggttggtggagcggaacgtccggccatgtacgctgtaccggcaagctcacgaaccgtctgaaaagtcaaatcatcatccatgccacgctcgtaagcgttggcctcgtcaagcatgatgctcaattagtcctctttccgttagctttgaccatggcccacaggatttcgcttgccggacgcctcctgtatgacaggttcggctcgtcaggcccacgaaacgtatgattcttgctgtgggcttcggcatatgcttgagccgccgacttcttggccttgctgatctcaccattcgccgtggtcagatcggacttggtttgggcgatatccttctgcgcctgcgtcaaatcggtcttggcctgtgccagcgtcttggacgccgcgtcaagattcgacttgttggcttgaatgtccttttgagcctgcgcaatcttggaggtattgtccttcagcgtggcgttggccgtgccgatggccgactggttcgccttgatgtcagccttcgctgactcaagctccttcgacgtggcagcctgcgcctgctgattcgccgcaatgtccttctgcgcctgcgtcagcttcgcagaattatccttcaacgccgtctgattgtcggccaaatccttttgaatctgcttgacctcttcaggcgagacggcggaagccacggtcacagtggcaatcgcagaccagtcagacttattgcccgcatgatcgacagcacgaaacgcatatgtatgcgaagagccagccgtcaaaccggtgatgacgtaatcgccctgccccgactgggtggcgctgatgacctgcattccagccgcattgatgccctcgcccacctcgatatggtcgaagtcaggctccatctgcgcgccggcagcggtcttgccgtcccagtggatggtgaccacgccaagctcagaggaaagcaccggcttggatggtacggcgcatggcgtcgtatccgactccacagttgccaccacgacggccgaccattcgccgagcttgtccgaatacgtcggcacagccctgacgcgcacctcgatttgcgtgccgcaatccaagcctccgaaaccgagctgcgtcttgtcagccgtgccggcggaatgccagggcgcgccatccttgtgcagcttccactcgaccgtataggtggagatttcgattgatgtgtcgttcgtggcctgcgtgaccgcgctccacgaggctgtggccagaccatgcgcatagccatccgagcctatataggcgtcggtctgcacgacaagtccctgcggggccttcggcacgcgatggtcacggtcggacgaggcggtcgtgccaccctcgctgccggccaacgcggcgccacccgtgatgccctttatcttcttcgcctgcttgaccgaggcatcatacttgatgtcgttcagtgcgaggctggcggatagtccctcgccctggcgcatgctcaggtcgatttcctgcacgcgcaccttctccccatgggagacggtcggcgccgtaatccaatcgccgggatgatagtcgacgagcggcagactatccacgtcattgacgatgagattgcgcgtgtactggcctctcaccctcgccgcgtcatcgagcgtggattgcatgaaagcctgcgccgtgtccttgtcggacacgccaccctgcgagctgtaggattcccacttgccccacggcgtcggagcagccggattatccatgcggaagaggaggttattgtcaccctcgacgaggatggtggacgcgaggtcggcgatggactcctcgaagggtgcctcgctgatgtcacgtgcaagctggagcacgacgctcttgctcaggtcgcggctcaaggcggtgctgtcggcattccacagcttgagcgtcctgccggacgtgcgccagtcgcagccgccaccattgacaagagcactcaggatggtctgcaaatcagtgccgagcgaatagtacagagtgtacttttttgcccaattactgccagccgcgtccttggccgtgtcgaagcccaaggtcaggccggtggccacgccaccacgcgcccggttttcgtcaagcatggtcttcaaaatcacgcccggattagccgaataaaatggcctcttgcctttgttgtcaccatccgcgagcagatgcgaagaatcgttgttctccgccttgctcagcagccagctgatcgactggccggaataggtgacggtgcgcgtccggtcatcggtcttgccggaacggcccgtgatgacgaaacgcgcgttgtcaggctcgcgatagccggttccgtcagacacttccacggccacctcaagaccatcggtaagctctcggtcgaatgcctgcgcgtcaccggacagcagcgagtattcgatgctgattgcgccatcatcattgtggagcatggacgcgctgaagctcaccggctcggccagcacaccgatgcgctcaccgaatggacgataggccacaagacgggcatgaagggactttgccatgaatcactcccaggattgcaaaaaccggcagaccacattgtccgtgccgccggtctgtttgatggtgatgcgataatcgccggaatcgatcgcgggccacacttgcagtggctcggtggtccagtcgatgccattcgatgcgtccgtaccaccggaccatgcgtcggcattggccgccgtccacaccttgcgattggccgcgtcgacgaagagataaggtcgtgaggcgtcacgtttgccaccccacagcagattcgtgccactcaccgggtcactgatggtcacaccagtgactgcgccgaaacgcaagaccagtatgccgattggcgcattggacagccagccgtccggcatgatgtcgaaaagctcggacggactggcgttaggcaatccctgccagcgcgtccaatacccattgctactcggcttggagaccccgcccggcagcagcctgccgcccgacgcggccaacgtcgcctcctgccactgcacgccacgccaaaacacgtcaggcaattggaaaactgcggtcatgacgcgcaggtcactggacggcctctcatcatcgtccggctcgcaggacgtgcacacgacgcgagtgaccatgctgcgcgacctgccgtcctccgtggtctccaccctgccgagcgtgagcttcgcggcagacaggcacatggcacggaaacgcgagatcagcgcatcggaatccgcaccccacgccgccaccttgactgtcagctccggagcatccaacaccggaatggacgagccgacgatgaagccgtgccgtccaggcacctgcacggtgtccacgatcggcgacagcgccgtgtagtgcgtcgtgcctacaagcacgcgcatccgctcggaatcgagcggctggccgttgagagaatagctgaccttcatccggattccttccgattaccattgcggcatggccgctgtctgcagcttctgctgcgtggaaatgctcgtcggcgcgatggccggatagttgaacgtctgcgtgatgttcgtcacgctccccccattgccgtaggaggcagcgttaacgccacgcgaggcgttggcgacgccgacggaatacgaggcgtcctgcgaaggtagaatgccagtcaatcgtccggcagccttcctcaccttcgacgcgctctcgtcgatgccgaccgccatgccctcgccgatcatctcaccgacctgatcgcggaacacgcgtgacggagaatggatgccaagcttgcgtttcacccaatccaacgcgttcgtggccgcgttgactgcggcggtcacgagtctgcctgccgcgcctgcgatgccggtcgcgatacccgtgatgatattcaggccgacgctcccccagttaaccgatgtgaaaccgcgcatgatctggccgaccacgccggggatggcgccgataagccgtggaaccgacgaaatgaaaccgttggccagtgcgaagagcagctgtacgccagcctgcaggatctgcgggagacgattgatgatgccaccgaccagttgtccgataaggatcggagccttgcctaccaagtccggcatggcgttgatgaggccctgcgccagtccgaggataagcttcaaaccgctgtcgatgatctgcggcaggttgttgaggatgccttgcacgaggttaaggacggcgttgatgccgatagggatgagctgcggcaactgggccgacaatccatccagcagcgtcgtcagcacggtcaccgccgtggacgcgatctgaggcaatgcctgcacgatgccctgcaagaggttcgtgaccatcgtcgatccggtttgcaaaaacgacggcagggtcgacgtgacccacaattggaactgggcgagcagctggggcaggctcgtcgagatccatgtcgtcgcgctggtcagcagcatcgtgccgagctgtcccaacgctccgagcactggcggaagaatctgcatgaccagtgccggcagcgtgctgcccaatgaggagaacagttgtggcagtgcggcggtgatgccggtgatgatctgcgcgatgcgcggacccacgttctcgatgaccgtgccgaccgaatctaccagctgcttggtcaatccgttgatgtcggcattgtccttgccgagctccgccagccagttctgccatgcggccttcatcatgccgacagagccctcgatggttgtcgcggcctccttggcggtggtgccgctgatgcccatctgctcctgcatgatgtggatcgcctgcaccacgtcggagaacttgtcgatggacaggtcgcccatctccccgttcgcctgcttgaccttgttcgcgtcctggatcagacgctccatctcggatttcgttccgccgtagccaagcttcagattgtcgagcatggcgtaattgccgcgcgccagagactggtaggtctgctggatggactcgatgtcggtgcccatcttgttggcgttgtccgacatgtcgaccatggcggtgttgccgagttccgcggccttcgcagtgtcgccgccgagcgagctgatcagcgaggcggaaaagctcgtgacctgcgtcatgtactcgttggcgctcactccggctgtccggtacgcttccgccgcgtatttctgcacggtgcccgaagcgtccttgaacagcgtgtccacgccgccgacggcctgctcgtatgtcgcgtatgcgtcgagagcgctcttgccgacgcctgccaaagccgcgacggcggtgccaacgcctgcaagtccgacagtggcaacacccttcaacgcgccgacggccttgccagacatggagctgatcgcattccatgcggtgtcggctccgcttttgagcttggagcctatcgcagacgcgacactgccggcggctccgggaatctgcgaaagcacgccgccgaccgcgccgccgacgttgccgagatagccgccgatggcattgctgacgtttttgaaaggcgctgggatccttgccgcgatggccgagctcatcgcggagaacttcgcagacaatggcgcggtaagacgtgacgcggtggattgcatggcagcgccggcagcgctcatgccgtcgcgggctttcgtggcgatgccggagaacgccgacgttgccgcgtttttgacccgtccgaacgcgccggagaccggctggattatcgccgaaccaagattcttgaacgccgatccaagcgaaccactgctggaagcgagattgtcctgcgcgtccttgagcgccttctgcgcatccttcaaccggttctcggcctgcgtcgcccggtcggtcatggtggacagcttcagccgcgcctgttcgagtctgatggtcgcggcctcggcctgcgtgctgccctcgccgtgcttggcgacggcattggcgacgctttcctcggcggcacgcacctgattcgccgcggccttctgctggagcatggactgacggtatgcggccgtggatttcgccacgtcacgctcataggatttcagcacgtccgcgccgaacgcgttcgccgactgtttgaacccgtttttgaacgcgcgtccgaacagtccgccgcttttgccgccgttcatgctcgaatcgaaggtcttcgacgcggccttgccgctcgcgccgacctccttgttgaccgtgctgcggaaacccttcatggaagggaacacgctgatatgcgcggaaccaagttcgctgccgaacgccatgcggaacctccactattcagttattcagtcttcgtaaagagtccggaataccgggctcatgcccttggtctgttcgcgcagccgctcacgctcggccttctccctgtccgcccgcaatcgtttcgcaagcgaatcgaaaggtttcggatactcttcgccgcccagcgcgtagatgaccagcatctcgccccaacgggccggatagtccaggccgttgagctccgcgcctgtgtaggttgacgggtctccaatgagctgttcgagcagcgctatcgcgtcgccgtagcggagcctgccgccaaggtcggtttgcaggctccagccacgtgccgtgaaatcggctcggatcacgctcccgtggtcggcgagctggcgggcgaaccattggattttcccagtgaggctccctgcgcgcgcactaccgcgtcgccgtagtcggacaggaggttgaacaccacctgcaccggttcgccgttcagcgctttcgcctgtttgtcgccagcgaaggcgcttagaatgcgtttgagctgttcgacgctctccgtatcgtcggacgtgttcgacagtttggtgaaatcgtcgatgctcatcgacagtggaagcttgtacgtgcgtccgccaggcacgagcgcccaatacacatcgcccttgatgatgtggcgcaccttgtagttctgcgcaatggaggcgaacgcctcctcatcgtttttctccgtccactggtcgaaatcctcgacggtcggcttgaagtcggtggaagttgaagtcattgtcttgtcctatctgcttttcgcctgcctgccgtgaaaaaagaagtcccggaccgcgcagacaggcgagatgggcggtccgggaagattttcgtccgccggtcaggcggcgcgtgtggtgacggtgaccgtcagatctggtgaggtcacgccgtcatatgtggcgttgagcctcgcgcttccggccttgacggcggttagcgtgcctccctcgacggtcgccacgcctgcatccttggacttgaatgtggcctgtccggtcacgtccacggtggtcttgtccacatgtgtggcgacggccttgagcgcgagcttcgcgccttggacgaccgacggcttcgtgttgccgtcagccgaggtcacggccaccgccgtcacgcttttgggtcgtaccagctttcgatccagcgggtgttcggatgctccgcatccacatacagcggatccttcatccattcgacggtcaatgcgcggccggtgaccgagccacgctcctgctggtccggctcgttgccggtgacctgcatgacgccggcacgacggtggacgcgcccggtgtcgaacgtctcctcttcgtacaccatccatttcgcgtcctggatgatgtcggccacgtggtagacgccctgcgcgtccggctcgccgatggtgatcttgcgggtcagcgcgttgttttcggccggactgaacgtctgcgtgaggctggtcgccaacggcagcttcttgtaaccgtcctgcaaaaactccagcgggtcgtcgccgtcgcgcgaatcctgattgccgccgtcggacttgacgagtccgatgcatgcggtcgaccgattgtaggcggccggaagttccggcgttgcattgcttgatgcgatcatctccggcgtgattttgttttcggtggagtacgggacgatcatgatggcggcggtgacgagcgcctccacctgtcccagatccatgccctgactgtctttggccatggcgtttcctttctatggttgtctgattccggccgtcgaatattcgacggtcatgtagtagcggcaccatgccgcgtcctcgctgaccgggtacgggccgttgcatccgtcaggcacgacggcgcagatgcggctgccttcggcgaatccgatgaggatgccgggctctccggtcagcacaccgtacacgcgggccgccagatcgcggcatggtttcgtatcgttgcgcgtccatccgagcacgttgacgcctatcgacctgtcgaacgtcacacggtcggcggattgcgtgccgccgtcatcacgcacgaccacgagcggataggagccgtcgtaaccatccggaatgcggtttccgacctgcaggcccgcgacgtccgtgatgttggagcgcagccatccggtaaggaacagttcgaggtctggtggaatgacgcttgccatcagaccctcgccttcctcaacgccttggccagattgccggtccgcgactccacgagcagggtcttcggatcgtggccgacgaccatgacggtcgttcggtgctcccttttgacctcctcgattccaaggccgtcgcggtatgcgccggtatctaccggagctgacgccttcgcgtaggcgagtgccctgttcgcagccagcgtggtgagcgacttgactccggcgctgttgagaatctcgtcgaagaatttctggttgaagttgaccgatatcctgcttttcgccatttgttcagccctttctttccgtcagacggcattccaaggtcggacgccagccggtgaacgcgttcgcgtccttcgaggggaatccgtcgacttcccacaagcgtccgtcgtcggggtctgcgcggatccggtcgccgattttcacgtcggctgtcgaatccgggatggtgaggtacgctgtggatgcggtttgtgtgtcgagcgtgtccggcgtgcgcatgctggagctggaggcgagggcgcccgtgatggctagctcgtccggaggcacgctccagtctggctcgttctgcgccgaattgtacaaattggccttgcgtttggcgcgcagtcgaataaagcgcgtggccccagccatggcggaaacgccgacagcggagttcaggtcgtcgatcaggctcacggcaaccctccaagcttgtagggtttgagcttgtcccgttcctcctgcatgagcgacacgacgtcgaagcttgcgctgctgccattcgttgactgcgaggtgataagcccaagcggactcatgccggcacgtttcgcggcgctgataagcaccgactgcacgtccggcgcgtcatcatagccagcatgaatctcgtagcggatggccgcgattccggcggggaagccaccggacaaggattcaaccaaacccgtctcaggatcgtaggcgtaagccagcttgttgccatcacggtcggtcaatgattcgatgctcgtcacatgacgcgcgggcagccgaatcaccatgccgccacgcgagttgagcacgccggacaattccgtgttcggcatgacatgccaaccgcattcacgcctgatcgccgactgcgcggccttaagccgaaactgcgcgtcatcctcgaaagccgaagggtcggcaatcatgtcaggaatcacattcacatcactcatgccgacccccacgcttactctgcagccatcaggccagccgcaatcagagaattgaccagggcgtcgaattcactcttggttggcgtgtcgccggcggccaaagccacatgcgttgcaggcttcactgcagcgctgccaatatcggtcggcttgccgttggccccgacgaagaccacatcggccacgttggcattcgggtcaagtttcgccgccgaggctggaatcactcgaaactgtcgagccatatcacgtctccttacttaagggtcagcttgacgaaagccttcggcttgcgcacggccaaagccacacgctccttggcgcgaatggtcaccagatcggaaatgaagtcggtgtcattggaattggtggcctcaaccgtcacaccgcccttgcgatagaaggtggcagcgcccttaaaggagccgacgatggctgtgccggcatcgacagcgggagtcaccacggtgtccagaccccagaggcgcggagtgatggtcaatgcgccaccattcacgccgtagaacggtccaccgccgatgaaattgccatcattgtccttcttcaatcgaatggcctcatagtctgtcggattgatgacaagggcatccggcatcatgccggtcgtggtggagatcatcgactgcgcgtgcagtacggcaacgtcattgccggcatcggtggcggtgtatgactggattccttcacgattcagcaggcccttgatgttcttgccggtaccgtcgccgttgagcagctgcttctcctcgacgatgctcaagtcgtagagcaggcgtccatcgatgtcggacttcaagaattcgaggtcggtgatcatgtcgttggattccttgatgaatccagcgatggtggataatgcgtcggtgtgctcggtggcgtcggcgtaatggatctggctgaattcctcgccttcgccgacggttttgaaatcgccttccttttcgccttccacgtagtagatgatggcctggccgctgatcgcgccgacaccgaacaggttggtgatggtcggacggcggtaagcctggacgaaattcggatccacgtaggtcaacagcgagccgtacacgccggacgggccgccggtaacctgcgtgtcagtgttgcccttgcggctcggagcccattccggtgctgcgattgacgctccggacactccctttatcttcgccagctgttcgccgatgttcttcacgacgaaatcgccaagagattcgtcggatgcggctccgctcttctgggtgtccgccagattgtcggtcaatcccgcgaaacgcttatgcaccgcatccaacgtttcgatggaatcctgcaattcgtgcgcttcggcgttcagccccttcagcttctcgatgtcggaagcgtcgagattatcctcgcccttggccagcaccgcttcgatggcggccttggtcttggcgagacgatcattgaaactcatttggtctccttgttgtccttgccgccagtgaccagttcacgggcggatttgattacgttcagacgctcggccttctcggcctccgcgtccctgcccttatcaggggcaagcttcttatcatcctttttctcgccggtcttggaatcatccggcttatcttcatcggaagtgctggaattgtcggaatcaatgccttccaacacctcgttcagcgacgccaatgcggcacgaagcttctcctcgttggcggagctgatggcgcgacctgacttgacggccaggatctcggcctgctggttcgcggccaccggcaccacgctgatctcgaaaagcttgatctgctggaattcggaatggccgccccacgggccgtcgcccttttccgtgatccacgcggtcttcgtcggcacgaagccgatgctcatctgatgaaccctgccatccttgagcaggtcgtaagcctgctgggcggtcggattatcctcgatatcgagctgggccgagatgagcagacccttctcgtcctccacggcgctcaaggtgcgtccgatgatgtcggtcggcttgccgtcctgatggttccaatggatcgggatgccggctccgccggcgtagtccttctccaaggtctccgcgaaagcgcccttggcgatcacgtcaccctgcaggtccttgttgccgaaagtgctggcgtagccgctgaaaacgccttcgccagcggaatcatccaaggatttcacgttgaatctgagctgtttgagattcactgtccttctccgttcactggattgttctgttgcgcgttctgcgtcctgccgccatcctgcgggctgggctgggcgcctgttgccacattcaagggcgtcaccaattcgtcgccaccatcaagcttcggatagttgaggatgcgccgcgcctcgttcgtggtcatgaagctgcgccccgtggccgtgctgagcgcctgatactgctcggagaacgtgccgcgcagcttcgcatccacattcgcttcgatgtaggcgtccggctggccgagcgcgtctggcagaagcagattgagcgactgttcgaaagccacgatgtacggcatcaattccacattccacatctgctccttgaaggaagcgatgttggaattcgtgccactgcgaaagccaagattctccggcgcgatatggaaggcgttggccacgtctatgcgaatcctgtccctcgcgtcgatgtcctgcatgtcaatcggcttgaacgcgtccacggtcttgatttccatgccgtcgttgagcaacggccagccaccggcaagattgcctccagccttgtagttcctcatgccctgcacgaattcgtcctgcgcctcctgcgacggccacggcatctccttcgggcgggagatgtacgctggaatctggccgccgttcttcgctatcgcacgccgatattcggccatctcacgcgcctccgccaaaagtggtgcgagagtgccggacaccggagaaccgccgatgccggacgtgctatagcccacatcaagcagaatctgcgggtctggcagtttgaaatactggcttccttccggctgtccggtactgatctgcacgccggtgatctcatcaagagtgttgccggaaagcgtgaaattctgcaccggaatacgccgcagccacaatctgccggactgcttgtcggcatcgagcaggcaaagccaccggtcattgagcaggccatcgcacagcaaagagtagaagaaccggtagcgggtcatgccaggaagcacgctcggcctggccatcaattgcgccaatgggcttgtggtgtcctccacgcgatcgccgtcagattgacgtcggtagaccttgaagggcatgctggcgatgttccgcgcgatatggtcgatgacggtacgcaccgccgcctcacgctcatacactccagcgccgaaccagtcgatgggaatctgcgccacctgtgaaatgttcactggcgattcggagaacttctgggccacggatacggggcttttcttgagccatctggaaaagaaacccatgaaacctcctcattgggtcatacgaccgcgaaatgcgtcacgctcggcgaatatttcggcgtttctgcttcgacctgcatggtctcaagcgcgtacaatgcctcgctctcggcgatgaggccgctgatctgcagggcgcttttcgcgcggtcccacacctcgacctcaccgagacgccttgtcacggccacgctcacctgctgttcgatggcgggctgcggcaggtgccggagcttgccttcgcgcacgcggtcgaggaagcggccgcagcacgcgcccaatcggaagccctcgatgagatgcacgttccagcctttttcggtgagcgggtcgatgaaatcgaccgccggacaacccttagactgcacggcaatctcacagacattcggccagctctcacgaagcaagtcaaggaaatgcggcacccacaacatgccgtcgcgcctggctataagctccacatgcgggagaccatcgtcacgaagaccggcggcggccacatacgtggtctggcggtcggccgaggtgtccaccgccaggaccacgcggttctcggcgggtatgcaggaagcgccatcggtgccatgcgcccacaatttcgggttgatgtagggcacgatgtcggcggtcacccactggcataaaacctcggtgcggaaagccgcctcggtcatgccatcgatgtcggagcgcacggaagccacggtcatcggcccgtaaccgagcgacgggttagcctggcggatcgcgtcggcatcatccaccgggcacttgccaggcgccgaccactcgaaatatccgaagctgccgtcctgctcgccattggcgaaagcctcggcggcatccacaccatcagccacatactgcttccaagcgtccacgagtttacggcccttgtccacctgcttgcggagcgcgacgctacgatagtcaccggcattgctgatgccccacaattgcgagctccacacggccttcgtggtctgcgagacggcattccagccatcatcattatgctgctcgcgcagctcgtcgaaaatcacacgggccgcgctcttggcacgaatgttcttgtcagcgcggacaatgtatttcgccttcgacttcagcacgatggcttcctcgccgttcgtgttcacgaatttctgcgtcatgcccgcaagctcgggcaccaccagatcggactcctcatcagtctcaggacgcggattacaccactccttgacctgactgtaaggccccttcgcattatcaagcgtctgagcggcgcccaccaccaggaacttcacgggcggcaccttatccgggtgcttattcgagtccacgaacagccaccatgcggccagcacacccatcagcatggtcttgccattctgcctagcgacaagcacaatcaccttgcggaagcgataactgccatcctcaagcaattccaaagcgtgcacgagcagccagcattgccaaggataaagatgcaccttcagcatgatttccgcgaacgcgatcacagcgaagccattagaagtgttcttatccaagggacgaagcggcggagtataaatacgcggcagggtcacaccatgcttctcatcatcgatggcgccgaaaacactcaaatcttccgacgccatcgaacgcctcctagccgaaacgcttcatgaaatcttccatctgcacaaccttgtcgctcttacgcgcctccggcttagattcaaccttcggcttcgcaggacgaccaaccttagccggagcatcaaccgtcaaacccaagctctggcaatacttcaggaacgtcggcagcgacacgttgtcgagcttgccgttctcatcgacaaaaccggaaaacgtcagataatcgatacgctcagccaacacgcgagccgcagcgacaacagcagaattcacagccttgaggtcagcgttcttcaacgaacgctccaacgcctccgccacattccgactcggaaacttcgcactcatcgaaaacaccccctaatctgccgtcgcgcgcgacccgccaacaatttcacttgtcggggagaggaagaccaaccacgcgggacgtcttgcgctctgtcgttggttttacgatttcaccgcccctaccccgtcgggtttggtttcgaatgctgttttgaatgctttgattgcgtttgtgaagcgtgtgatgagttcgtctgcgcttggtggcttgggcgtgatgagtgtggtgtatgcgtctccgactgtgaaggtgttgacttcgttgtgggtgacgttgattgggatgttgacggtgaatgagctgattgggaatgtcttgtcgctgattgtggcggtgagctctagtgtgactggctgctgtggcatcattgtctccttgctcatgctgtcttaatccattgcctgcttagtgttccgattggcgccggcggatcttggttgcctctcaagcggttgcagctggtgtggctcggtttgaagcctgccgggtcgaattggagttcgggatgcttgctgacggggaacatgtggtcgaggttgaagctgtcatcggtggtgttcttcgtggccgcatagtcgattggcattccgcatagccagcagactgcatgctgtgccttgcactgtgcgaagaatgttgctttgtctttttcgaattggcggctggtcttgcgtgctcttcctggcatacgatcaccgcctttggtgcttcgggctggagtcgaaccagcgcatggtgtgggatgcactatctcttatcacgggcattcaaagaatcatgaagccatggccggtctgttccgtcctctggtatctgtgctatccctcgtgctctgccactgagctaccgaagcgatatgaataatggcccagctatcattatgctgagccattcattctacgaacatacgacagtatagcattttaattgtgacagtcaagcatggctgtgagttctccgaggttgaacacgtactctcctttgtgttttgtcggcgtggcgtgcgacagtttgcctctggtgagccattggcggatctggtcgcttgtgcagtggatgtccattttggcgaggtatcttgcgacttcgactggttttccggtgtattcgagttgccagagtttgttgtcgcgtgtggctttgatggcttggactccgccttgccatttgcagtgcgggcatgtccattcgtcggcctgtggcgtgctggtggcttggtgaccgcattttgggcatgtgccgatgatgaccattgcctcttctggtgtcaaggccgtctcgttgcgtcggctgatgtgttccagtgctgcgtagtcgtcggctgcagtggtcatgtccaaaatggcatggcgattgcttaatatggcgagccatgctttgcgccagcggtagtcggcgtattgcggcctgattttgcccgcttgctcggcgagccatgcctccgattcggctatgagctgttgcgcgtgcgtgtcgattggcattggcgcgctgcctctgcttggcgcgtggcccgtggctccgatgtgcgcttgtttgagcatgatgctgctgagggcgggcagttggacgtgtccgagttggcggatgagcgtccagtaggtttcacggcaggtttggcagagcggattgtctgctgtcgttttcattggcttgtggcagtgctggcagtcggtcaaagtctggtctccttgtcgtgctggtggatgatggcggtgatttcggcttttggcacttgcggcacgagtctggcggtttcttccagggtgataccgtcctcatgccatttcaggatcatttcttcaaggattttcttcatttggtggcctccagatatgggttttctgtggtgtgtggcgggaagtcgcattcctggtctttccaaccggccgcgtagccttctcgccatgccttggccatgcgtcggtggtattcggcgtctgtgagatggtagatgagtttgggttctatcattgtgtgttctgctccttgttgagtcgttctgcgagttggcaggcttgttggtctggtgtggcggtttccttgtcgcgtccgagcgcttgcaggacgtgttcgcactgccacgtgtgcacatggcgtttcgacggtggtatgccgctcatgttggcgcggcgttggcaccagcctttccataggcgcgtccagtcggctatcgtgcggttttcgctataatgtcggcttaagaatgcgttccaagcgtcagtaacggcgagattcgcgtattccgctttgatcgccgacatggcggtggtgtagtccgtggaatcatggaacgcttcggcggtgatttctttggaagaagaaaatttattttcttcttctttctttctactcttactactactcctactactactacagtcgtgcaactgtccggaatcctccggagactcgcaggaatgttcctgcaactgtccggaatcctccggaatgaccttgtgtccacgcttgtcccagccgtccggtggcaggtagtggcaggtgcccggacgttggatgttctgccatttctcgaagccgggaatgaagaggagacgcttgccgtcgcgctcgtagcggatgatgctgccgcactgctccaattccgcgaaggcgtcctcgatggcatcgaggacggaatcgtcatacggcatgcactggccgcggaagagacgcggattgtcgagctgcacgccattgtcctcaacataagaccagaggttgatgaacacgagtcgcgtcttccacgtcatggagccgacgctctctgaactgtagaattcaggtctaatcgtcctgattctcattaatcctctcctcttgtgatgccgttgtatgccatccagattgcttcctgccgtggcgtggtgcagggcagatcggtgtagttggtgttcgcccatccgcttcccacgtgtggtttcgccatcgcatccaaggcttcggcgatctccaccaagtccggtggcgggtcaagcgtcaccatgacaaacccatcattacggcttgcttcgcgtccaccagccgatacccgcagtaagggcaggtgacgtaatatgtgcccaccgtctcaccgcagtgggcgcactcgacatatcggattgccttgctcattcgcttaccgccttccgtgcgatttcgagcatttccttggcctgtctgatatattcctcctggaagccgggaatctcaccggcataattccatgcgtcatcctcgcctttcgccacacagtcactttcgacaccatcccacttcttgcagcttctccatagaagtcgtttcgccacggcctcgatttcagcattcgtgggcagcgcttcacgtccatcgcagtaggcttcgtagaccgcgtcgcctaccgtgtaggctccttcgatgatctggcagcagtcgtaatctcgtgaattttcgtaggcttgcgcctcgtccagcatgatgctcaattagtcctctttccgtttgctttgaccatggcccacaggatttcgcttgccggacgcctcctgtatgacaggtatcaggctgatgatcgtgtttttgatcgtgtcacgacacaactcgtccatgcggtcgtcgattttcgatgtccgctctcccagtgtccttgtttttgcgaaatgctgggaaagtggactgtcatagggcaaccgttccggctgcacgtgcgagtacaggccggtcgccagcgcgtccaaagcgcccggccagactttcaggccgagcgtgatgagcgcgcacgcgccacccacaccaccaaaacccgctaaaaacgtttgaaacacatcacatctccttgaaatcgtttaatcttttggcatggtgtcgccatcgaaataattgcccggcaatcccaacgagacgagctgctgccactggtcttgaggcacgcacaagcccttgctcagattgaccgtgcaattgttcagcccgacgagaatgccgtgagtggtgctggcggcggtgaagacgtaatccacgcgaccattcgaagcgaccggcccactatcgctgccattggtggtgagacgcaagtgcggattgtcgccactcgtgggcagcatgtaacagacgacgctcacatggtatttcacgcccgccgtcaaccccgtgaaggtgatgtccgatggtgtcgtgttcttcgtcttgacgctcacaccgtctttcggcatgacgcagtgattaacgatgggagtcatgccaccacccccaatgcgagggtcaggcgcgcggcatcgtatccccgtcgaaatatccgatgctgtcgagcagggtcttgttcgcgagataatcggcctgcgtgcagatgagtatatttgtcacggtgacggtcggactgcctgacttgacggaataattcgctgatagcggactggaattgttgacgtacgtcatgtagctgacacgttggcgtgcgctgaattcgccctgtgttccgataatcgagacagtgccgcctgtgacgttcacatcgaaactgacccaatatgtcatccatctcacgctcggaacggtcgtgagacgcacccacttgtctgcttgcaaggtgatggtcgaggatgggctcgtgcataggttcgtgaccatcatcgggcaccacccgcccggcggacgctcctatgcgcgcggcatcgtgtcgcccgagaagaagcccggaagccccccccccacggctttatcgtaagtgtcggcgcgttcgatgagaatatcgctcagcatgactatcgcgccgaccactttgcctgctgtggtgcggatgatgagttcctcgcagtcgtccggcaccgttatggtcccgtcgacatcgaccgtcgtgccatccgctatttctttttgcaatggcaccgtatacttgccaccgaccctcgtgtagacgcggacgaatgcgttggcgtgcttcgcgaaggcattgcagtgcacgtggtaggttccagccggtggaagacggtcgccttgcagcgaatactgcgcgtaagtgtctccaacggtgagcacggtcgcgcgcagccagttcctgcgggccacgaccggaaaatccacttttatgatgctcggcgcatacggtttaaccgtcttcgtgatgttcgggtcggggaaccagttaatcctcaatgtcatcatccacccccttggctgcgtcgagcacgtcctgcgggatcagtttcatggccgccgtaagctggctggtcaggattgcgttttgcttgttgagagtgccgatttgcgcggagagcgtgtcgatgacctcgttcgcgtcggctggaatctgagtcaaaatgtctccttaaatacgaaacccccgcaatccgtgtggattgcaggggttgaaaaaattggaatgctggattagtcggctgctgtcatcgtatcgatgcgcgtaacggccttaagcccgtcgagcgtcaaagtgcggccgagattcgtcttcacgtccgtcaacgtgacggacgtgccggaatcgtcgaacgtcgcaagcacgccacgctggtaatcacgccacgattcggcggtgccgtcagcgctggaaaactccaatcccaaacggcacagttcagctcgcaccgactccttcggcggacgcaaatcaagcacgccagacggctcggcgggcgtcacggcaggcacggtatcggtagtggtagtggtctcagtggtcacatcggccatgatcaattctccttaattctgttggttttgtcttggcatgagggattcatagaagcgttcctcggccgcatccaaatccgaacgcatgacttcggtggcgaaaagccttccgatggccttggcgtccacgcaatccgtgtcgatgccggtggtcggtgtcgcatcggccgtttcaccagacagcatggccgtctggacggccgcgtccgcatcgttggtgatcggcggcagtcccaaagccgtcctcgtacggttgcgggcggccgtcatcggatcatcctgtacctcgccactgtcggacatcatggacacggattccgccgcggtatccgacaaggccgcctccaagccctcataggcggtcgtgtacgcgttacgtccggtctgcggatcgtacgagccggccgattcccttgcctgcatcatggccgcgcacgtttccgcgacgctcgtcgtgccgagcagcgcccgccatgcggcgatagcgtccatgccgcacacaagcccccgctcgccttccgtttccgctctgatgacgaggttcccgtcctcgaaaaccgtttgcaaaacatgcctcctttatttggtcagccaggcgatggcgttgacgtacatgtcgccatggaaggttgcggttccggcgttgtaccccataacctgcatcgacccagcgccaccggtgttgcacacgtgcatgaagatcgacccccagttgaggtcggaattgcagacgccgtagtagcgtccgaacttcgccggcgtccatgaccacgtggtctgtggcacggtggagtccgcggttagcgtcgcgttctggtagattcgccaattggtgctttggaatgtgtggcggccgttgatgccgccaagatagccgccaagatacacgtatccggtgctgatgtcggacaacatgccgatttcgccgttagcgtcggaggcggtgcagtatgcgcgggccttcgcgccctgcgagtgcacgccgacctcgcacaagctgccggaatcactgcgcacgttgagatacgcggaagcgccggaaccgccgacaccctgcatggtgagccgtgaggagctttttttcgacgggtcggactcgtcataattcgtgtcggcggtcagatacacttgggacgtgatgccgctgccggtgccgcctttcgcacgaggcttcgatttgagagacacgaacgcagcagggtcgtttttagtgacgtgtccgctccacaagtccagtccgcccatcgcgccgacctgattcgactggatgacagaagcaatggccggatgagagtaaaaagccgtcgaaccgttgtaagcggggaattccaggccatcaccaacgaaagtctcagtgccgccgatgatgtaggtctgataatccgggctgatacgcaccctgtgcccgctcgtgcgggtctggaacgtgccggtcagcaggttgctcttgccctcaccgtccaaataaacggtctggttatggctcgaatcccacatccgcaaagccgtgctattgagcttcatgcccgtgttctccgcctcggagctctggaatatcgcgccggtgaagacatagcccttgaactggcctgccgccaccttgtcagacgtgatagtgccagccgcgatcttgacagccgtcacgctgtttgccgccagcttgtcggcggtgatcgcgccggacactatcttcgaagcgttcaccgagttcgccgcgagcttgtccgcgttaaccgcgttcgcggcgagcttgtccgtcgtgattgcaccggacacgatgtcgcccgcctgaattttgtgcacgttcaggagcgccacggtcatatcctcagtgaccttgagcttcgcggtcgtcactgcgttggcggcgagcttatcggtaccgatggcaccggcctgcaccttgcccgccgtcaccgcgttggccgccaatttgtcggcgttaacgctgttggcggcgagcttatcggtcgtgacagcgccagccacgatatcggacgcctgaatcttatgcgcgttgagcaacgcgacggtcatatcctcagtgaccttgagcttcgcggtcgtcaccgagttggccgcaagcttgtcggctgtgatggccaatgcgacgatattccgcgcctgcaccgagccagcagccaacttgccagcggtcaccgcatcggacacaagcttctccgtcgtcacgctgttggcagcgagcttgtccaccgtgatcgcattggccttgaccttttcggcggtcacggaatccacggcgagatgcttcgcggccacggtcccagacgcgagaatgttgttcgccacgaggtcaaaaggttcgaagcgcgtgccgtcccacgtcagcacctcgataacgcgatccgtcaatggcacgagcacggacgggctagcgtttggagcgccggtccagtacgtgtaaaagtcggccatgaggctgggcgaattgttcttctcgcccttccagcgcgtccaatacttctgcgtgcgccaccacatgtcacccggcttcaacccatcatgcgcgggttcgtcggggccacggtagatgaggttctttccgtccgcggtggtctgtgcctttttcgcggcggcctgcgcctgattcgcctgtgacgcggcgttcgcggcggcggtctgagccttgtcagcggtggattgcgccgtctgcgcggcagcatgtgccttgacggcggcgtttgccgcatcggtagcggccttgtccgtcaccgccgcccaagccgacccgttccaccgtttcggcgtgttcgcaccattcgccgtgtcgatccacaaggtagtcggcttgcgcatcgacgtggccggtgctgtgctttggatgagcacgtcggccttgccgttcgccacgccagcggcggcggcagcggccgtattcgccttccttgcggcggtggccgcgtccgtggcggattgggccgcgctgtcggcggtggccttggcctgcgtggcaacgctcgaagcgttcgaggcggtggtcttggcgttggccgcatcggtcttcgctgcggaagcgtccgatttggcggaagccgcgtcggacttggcagcattggccgaagcgttggccgtgttggccagtgtttccgcattgcctgcggtcttcttggcgctttcggcggcggcgtttgctgcgttggcggcatccttggcctgacctgcggtggctgtcgcacttttcgcggcagtctgagccgcgttggcggtatcctgcgcggtcttcgccgcaccattcgccgtgtcagccgtgccctgcgcgtttttcgctgcggcagcggcattctcggcagccttcttggcgtcggtggtcttcgccgcattgtccgcgatatccgacttcgccttggaaatttcgtccgcgttcttctcgacatcggcatagccaagatggttccaattcgagccatcccacaccagcgtatcgataactcggtcagcaagcggcactagcacggaagggctggcgtttggcgtgccggtccaatacgtgtagaagtcagccaagaggctcggagaattattcttctcgcccttccagcgtgtccaatatttctgggtcttgagccacaagtcaccgacaatcagattgtccttcggctcgtcaggcccacgaaacgtatgattcttgctgtgggcttcggcatatgcccgcccctctcaatttcaaccagttcccccagcttacgctgttcccaagcgggggtgcggtattcttgtgaaagatgtgcagtcgctcgtggagccgcgcattttgccggcaccgcaatgaggagggatagatgaacaagcagcagctcgcttcgaaaatctgggagtccgccaataagatgcgttccaagattgaggcgaacgaatacaaggattacattcttggtttcatcttctacaagttcctttcagagaccgagctgatgcgcttgaaagccagcgatttcaccgatgatcagctgccgcagcttacggaggataatccggacattgtggaattcgtgcagggtgagtgtggctacttcattgcctatgacaatctgttctccacatggatcaaaaaaggtaatgattttgagatttccaacgttcgtgatgctctttcggcgttctcccgcaatatcaatccggcgcacaagaaagtgttcgacggtattttcgacaccctgcagaccggactttccaagcttggcaccgatgcgaggagccagtccaaggccgcacgagacctgatttatctcattaaggacattccgatggatagccgtcaggattatgacgtgctcggattcatttacgaatatctcatcagcaattttgccgccaatgcgggcaagaaggccggtgaattctacacaccgtccgaggtctcccagctgatgagcgaaatcgtcgcatggcatttgcaggggcgcgagcagatcaagatctacgatccaacatccggttccggctctttgctgattcatattggccagtctgtggctcggcgcaatggcaatccggattccatcatgtattacgcgcaggaactcaaggagaacacctacaacctgacgcgtatgaatctggtgatgcgcggtattcttcccgacaacatcgtcgcccgcaacggcgacaccttggaagacgactggccgtggttcgacacgttggagaacaaggaggaaacatacaatccgttgttcgtggatgcggtggtttccaaccctccctactcgcagaattgggatcccactgacaaggagatcgatccacgcttcagctatggcatagcaccgaagtccaaggcggattatgcgttcctgctccatgacttgtaccatctgcgtgccgatggcatcatgaccatcgttctgccgcacggtgtgctgttccgcggtggcgaggaaggccagattcgtaagaatctgattgaaaaccaccatattcaggcgattatcggccttccggcgaatattttcttcggtacgggcatccccaccatcgtgatggtgctgcgcaagaaacgcgatgacgacagggtgctcattgttgatgcgtcgaaacatttcatcaaggacggcaagaacaacaagctacaggcttctgacatcaaacgcattgtcgacgtggtgtcgaacaaccgtacagtgcccaaattcagccgtttggtgtccattgacgagattcgcgccaatgattacaacctcaacattccccggtatgtcgattcatctgagaatgcggagacgtgggatgtgtacgcttcgatgttcggtggcgttccgaagagcgaggtcgagcagcttggggaatattggaatgcctggccgagtctgaaggctgagctgttccgcgataatggtgcctgctatgcctgcgatcacgatgatatcgccactgtggtgcgcaataatgccgacgtacaggcgttcattgcctcgtatggacaagccatttccgacctgcctgctgacttgcgctcccgtttggtggagcatcctgaacaggtggatgcgctcgggcaggaaacggccattggcaaggaattggatgcgatgattgccgataccgcgctgatcgacccgtatgacgcctatcagaagcttgatgatgcatggaacggtatctccattgatttggaagtgctgggttccgaaggtttcgatgcggtaagagccgtggatccgaacatggtcatcaagaaaaaaggcggcaaggatgtggaagtgcaggatggctggattggccgcgttctgcccttcgacttggttcagcgtgagctgctgcacgatgatttggccgcgatcgaggcggacgaacgccgtgtacaggacattgattccgagattgaaaccattttggaaggtttcgatgaggatgacaagcagaatagtgatgcggttaatcaggacggtgatgccttcgttgctgccgagttgaagaaagcggttaaggcgatcggcaagaatccggcttctgattttgagcgcggcttggtgcaggcccaaaagctgttcgatgagtcaaagaaactgaagtccggtatcaaaaccaagcgaagcgcgttggaagagaagacctgcgatgcgatcaaggcgttgagtgatgacgaagccagaaggttgctggaagccaagtggattacaccattgcagaagcagctggaggcattgccgaatgctgtgatcgacgagttcatcggcaaagtgaacgcgttgaagaacaagtatgccaccacatatgccgatgtatgcggccaaatcgatgaagcggagaaggaattggctggaatgctgggcgatttgaccggcaatgctcgcgatatggcgggtctggaagagctcaaagcactgctcgggggtgaatgatatggccgaacagcatgaaaaagcgttggttccgcagattcgtttcactggtttcactgacccttgggaacagcgtaagctgggggaattagcatctaagcgaattgaaaagaatacgaacgggattaaggagacgttcaccaattccgctgagcatggtgttgtaagccagttagactattttgaccatgacatcacaaacgatgcgaatattggaaattattccgtagtgcatccagatgacttcatatacaatcccaggatctcggccgtagctccatgcgggcccattaatcggaataaacttgacagaaacggcgttatgtcgcctctttatactgttttttcagtggatgacacgatagacaagctatatctggagcattatttcaagacaagcagatggcatcaattcatgtttctcgaaggtaattccggtgcgaggtctgatcgtttttctatttcggattcaatctttttcgagatgcctatccagtgcccagtgttagaggaacaagaattaattgcgtcgtttttcggccgtctggattcgctcatcacccttcatcagcgtaagtatgacaagctttgcgtgctgaaaaaatccatgctcgacaaaatgttccctaaagggggttcgctgtatccggagattcgtttcgccggtttcactgacccttgggaacagcgtaagctgggggaattagcatctaagcgaattgaaaagaatacgaacgggattaaggagacgttcaccaattccgctgagcatggtgttgtaagccagttagactattttgaccatgacatcacaaacgatgcgaatattggaaattattccgtagtgcatccagatgacttcatatacaatcccaggatctcggccgtagctccatgcgggcccattaatcggaataaacttgacagaaacggcgttatgtcgcctctttatactgttttttcagtggatgacacgatagacaagctatatctggagcattatttcaagacaagcagatggcatcaattcatgtttctcgaaggtaattccggtgcgaggtctgatcgtttttctatttcggattcaatctttttcgagatgcctatccagtgcccagtgttagaggaacaagaattaattgcgtcgtttttcggccgtctggattcgctcatcacccttcatcagcgtaagctcgaattactgcggaatatcaagaaatccatgctcgacaagatgtttgtataggggtgttcatggcaacaatcacgttatttcacggttctccgtacgaatccgtgacccccgaatacggtttaggcaatgacaaacacgactacggccgtggtttctatctgaccgcgaatgtggaactggccaaggaatgggccgtgtgcaggccggatgaatccaacggctgggtccaccagtacgaactggacacgaatgggctgcgcatcctggattttcaggagcatagcgtgcttacttggctggctgagctgatgaagcatcgtgatgccgctgattccaagcgctatcgcgtgctggctacgaagttcatcgccgaatatggcattgacaccagcggctatgacatcatcaaaggctggcgtgcgaacgcctcgtatttttatatcgccaaagaattcgtccgagacaatgtggacgtcgatatcttggaggaactgctgtcgcttggaggtctgggcatccagtattgcgtcaagaccgcaaaggcgtacaggcaactgcgcgaagtcccggacggcctgctttccgtcagctacagcgaattcaacgacaaatacaatcagagggatgttgaggcacggcagaacatgcgcgacctcatcgattccgatgccaatacggtgaccaacgtgttcagcacgttgctctaggggtgatgacaatgcgggcatatccagaggtctaccgggatgatgtggtggaaactcaaggcaagctcttcgactacgtggcacagtcgtttccgggcaagagcacagaggatttcatcgccatgtatatgacgagcaaaacacgcaaaagcattgatgaggccaaagcctacgtcaacacgatggatgcgaaagagctgtggaagtatttcaccgagaccgagcactaccagttgaaggacggcagggcgctcgaagggttcatgcctgattggattggcgaattctacgcctactaccaatggttctacgccattcccagtgctgaagtgatcgccaaggtgccgctggacttcctgaagaaagcctatttcgggcttcatgatctcgatctggagcttgcggtgcggaaagtcggcgaagaatgacggacatcatctgcttccataatcccgatgaggagaacggatacctgagcaactggtatccatcgtgcttcgttgcggatgatgtcgagttttcctcaatggaacagtacatgatgtaccgcaaagcctgctgtttcaacgatgccgaaacagccgcgcggatgcttcgaaccagcgacgtggccgagatcaaacgccttggccgactggtggccggttatgacgaccacgtatggaatggcgttcgccaaatcgaagtctatgaaggattgcttgccaaattcagtcagaacgccgaactcggtgcgcaactcgtagcgaccggcaatgcgatattggcggaatgcgccgtcaaagaccgcatctggggcatcggcttgtcaatgcatgacccagccaggctcgatccagcccaatggcgcggtcagaacctgctcggatacgctctaatgctcacaagaaagaagctcaaccgcatacatgagcgataatgcggccgttttcccgtatcaatcgcccccccccgcttgggaacagcgtaagctgggggaactggttgaaattgagaggggcggtgaagcggcggcgtgctactctcccacaccctctcgagtgcagtaccatcgccgcgcctggccttagctaccgggttcggaatgggaccgggcgtctcaccagggctatgaccaccgcaaaaccgcgatcacggaacgacggccaaaacacatggcggccattccggccattcaattatcgtgtggcggttcgggaaccggctagcggacgcgaggcaaacgcctatcgtttaaatcgtattcgtgaccatcccaacgcatattgccgtccaggacgatccagcacaggaaagacgcggaaccaaccctccacaagggaaggatcggaatgttatgtcgccgtcgcccgttagtaccggtcggctccacccctcacggggcttccacctccggcctatcaaacacgtgttcaacatgcgggctacaggatctcgaagatccatggaatcctaatcttggagcaggcttcccgcttagatgctttcagcggttatccctcccgaacgtagccaaccggccgtgccgctggcgcgacaaccggcataccagaggttcgtccacccaggtcctctcgtactatgggcaggcctcctcaggattccaacgagcgcagaggatagagaccaaactgtctcacgacgttctgaacccagctcgcgtgccgctttaatcggcgaacagccgaacccttgggacctgctccagccccaggatgcgacgagccgacatcgaggtgccaaaccatcccgtcgatatggactcttgggaatgatcagcctgttatccccggggtaccttttatccgttgagcgatgccgcgcccgtgcgccggcaccggatcactatctccgactttcgtccctgctcggaccgtcgtcctcgcagtcaagcccgcttgtgcgattacactcgacacccgattgccaaccgggctgagcggacctttgagcgcctccgttactctttgggaggcaaccgccccagttgaactacccgccaggcactgtccctgacaaggatgacttgtcgaggttagacgtcaaacgagaacagagcggtatttcaccttgcggctccacgaatgctggcgcacccgcttcgaagcctcccgcctatgctacacaatccgcgcctaacgccaataccaaggtatagtaaaggtcccggggtcttttcgtccttctgcgcttaacgagcatctttactcgtactgcaatttcgccgagctcctggtcgagacagtggggaagtcgttacgccattcgtgcaggtcggaacttacccgacaaggaatttcgctaccttaggatggttatagttaccaccgccgtttaccggggcttgaattcaccgcttcgtccccgaagggattgacggatcctcttaaccttccggcaccgggcaggcgtcagtgcatatacagcggctttcgccttcgcatgcacctgtgtttttggtaaacagtcgctaccccctggtctgtgccacccaccaaagctccccgggctagccggttcaccccagcgggtctcccttataccgaaggcacgggagtgatttgccgagttccttgaccaggattcgctcgatcgccttggtattctctacctgaccaccagtgtcggtttggggtacgggcggccatggccctcacgccgaggcttttctcgacggcctggacaaccggatatcgagccataacggctcccatcatcacacctcgccatgcatgccatgcggatttgcctgcatgactggctgcgtgcttgaccacggaaaaccacctccgcggccggctcccattccgtgtcacccctgcgctgacctactgcggctacagtcccaacaccacgcggcgataccaacccgaaggaaggaaccaccacgaggcggaggttagtactcaccgtctcggttttgccggtccatggtcggtacgggaatatccacccgttcatccattcgactacgcctgtcggcctcgccttaggacccgactcacccggggacgacgaacgtggccccggaacccttggtcatccagcggacgggatcctcacccgtctctcgctactcatgtctgcattctcactcccacgaagtccacggcacggttacccggccgcttcgcccctcgcaggacgctctcctacccagcaaccatgaagattgctgccgcgtcttcggtggtgtgcttgagccccgctacattgtcggcgcggaaccactagaccagtgagctgttacgcactctttcaaggatggctgcttctgagccaacctcctggctgtctatgcgactccacatcctttcccacttagcacacgcttcgggaccttagacgacggtctgggctgtctccctctcgacgacggagcttatcccccgccgactcactgccggaatacacgtcaacggtattcggagttcggctgctgttggtacccaacaagggcccgcaagcatccggtagctctacccccgcgacgcaatcgaccgacgctgcacctaaatgcatttcggagagaaccagctatcacggaatttgattggcctttcacccctagccccaggtcatccccccggttttcaacccaggtgggttcggtcctccacgcggtcttacccgcgcttcaacctgcccagggctagatcatcccgcttcgggtccaggacaagcgactacaaacgccttttaagactcgctttcgctacgcatacgccacacggcttatgctcgccacccgccactgactcgcagactcatttttcgataggcacgccgtcaccccacgcagaggctccgacggtttgtgggcgcacggtttcaggaactgtttcactcccctcccggggtgcttttcacctttccctcacggtactggtacgctatcggtcagacaggtatgcttagacttacccaacggtctgggctgattcacgcgggattccacgaggcccgcgctacttgggacaacacgatcggaagacggctcacgtccaggtacggggctggcaccctctacggccaggccttcaagcctgttcccctggcaagccgttttatgactcccgcccggcccgtcggaaccgggacacgtgatcccacaacaccggcaacgcaacccccgacgggtatcacgcgcaaccggtttggtctgatccgctttcgctcgccactactcacggagtatcccttcctgcaggtactgagatgtttcacttccctgcgtaccccccgcccataggcggtgccggcccatgacggccggcgggttcccccattcggagaccctaggatcaaagccatgttggaggctcccctaggattatcgcatcctcaaacgtccttcatcggtactgtctgccaaggcatccaccatacgccctcgcaagcggcacaacagcaaaacaaattgtcattgccccacccgcgggtttcctgatagcaagatcgccagacgacaaatcttaacactaaaatgatcacaaaacgatcgatctcgaaaccaaactcaattgaagagtttggcgaaatcgcgataagcaaaaagaaacgttctttcagtttctcttgctcgcgtccactatccagttctcaaaccaccacgcgccacacgtttccaacccgccccgaagggaacaggcctactccatgtgggcatcgaaccgcaccacgatagaacaccgtggggtggcggtccgggagcccaaaagcatacccataccactcccggacatcccgacgggacatccaagcccatgatctcttccacaccagcatccccatgcgagaccgtggaaccattccacgagcacggggctcacaccggacacggaaccgtgtcctgaaattctccgtagaaaggaggtgatccagccgcaccttccggtacggctaccttgttacgacttagtcccaatcacgagtctcaccttagacggctccccccaaaaggttgggccaccggcttcgggtgctacccactttcatgacttgacgggcggtgtgtacaaggcccgggaacgcattcaccgcggcgttgctgatccgcgattactagcgactccgccttcatggagtcgggttgcagactccaatccgaactgagaccggttttaagggatccgctccccctcacgaggtcgcatcccgttgtaccggccattgtagcatgcgtgaagccctggacgtaaggggcatgatgatctgacgtcatccccaccttcctccgagttgaccccggcggtcccccgtgagttcccaccacgacgtgctggcaacacagggcgagggttgcgctcgttgcgggacttaacccaacatctcacgacacgagctgacgacgaccatgcaccacctgtgaacccgccccgaagggaggccccatctctggggctgtcgggaacatgtcaagcccaggtaaggttcttcgcgttgcatcgaattaatccgcatgctccgccgcttgtgcgggcccccgtcaatttctttgagttttagccttgcggccgtactccccaggcgggatgcttaacgcgttggctccgacacggagaccgtggaatggtccccacatccagcatccaccgtttacggcgtggactaccagggtatctaatcctgttcgctccccacgctttcgctcctcagcgtcagtgacggcccagagacctgccttcgccattggtgttcttcccgatatctacacattccaccgttacaccgggaattccagtctcccctaccgcactcaagcccgcccgtacccggcgcggatccaccgttaagcgatggactttcacaccggacgcgacgaaccgcctacgagccctttacgcccaataattccggataacgcttgcaccctacgtattaccgcggctgctggcacgtagttagccggtgcttattcgaaaggtacactcaccccgaagggcttgctcccagtcaaaagcggtttacaacccgaaggccgtcatcccgcacgcggcgtcgctgcatcaggcttgcgcccattgtgcaatattccccactgctgcctcccgtaggagtctgggccgtatctcagtcccaatgtggccggtcgccctctcaggccggctacccgtcgaagccatggtgggccgttaccccgccatcaagctgataggacgcgaccccatcccataccgatgaatctttcccagaaggacatgcatccaactggagcatccggcattaccacccgtttccaggagctattccggtgtatggggcaggtcggtcacgcattactcacccgttcgccactctcacccaggagcaagctcctgggatcccgttcgacttgcatgtgttaagcacgccgccagcgttcatcctgagccagaatcgaaccctccacaaaaaaaccttttcatgaagagacatcgacacgatgactctcgaaataagaaaattgacgatcgccttataaggaaaggcgcatcgcacaaaaaccgcgaacgtgcaggtgtggtcgtcgaacggctccacctcgcagaggtgggcgttccgtagcgcggagtttatggtcaaataaacccatacagcgtcaccaccaaatctgagcacctttatttgatcacataatgacagggttgtgaacctgtacatcagatacgtgcacagccctttatcaatagggaatctggggtggattaagtatatagtgtttggagttgggtttgaacttgaaaatggtgaggaacaattcatatggtgcatgattatgaacatccttggaataatccgagtgactcaggctctgtctgcattgctgttgctgttcataagccttaccgcatgcctaaagattctatgtacttgcctttgcaagttggtaaggcacttcatcctgaaatcgatttgggttttcagacggatgatactggagataacatctctttgctgaatgcgagttattctgaactaactgcattgtattggctgtggaaaaatagtgatgctagatacaagggtcttgcacactatcgtcgtcattttgcctcacattatatgcatttcaatttaggtgatagatttaatcgaatcgtaaagcacgaagagattaaccagctcttggagtcgaccgacatcattcttcctgaaaaaaggcaatattatatcgaaacgatgtattcgcattacgcgcacacattttttggtgaacatcttgatgagacacgttgcattatcgaagatttttccccggattatttgcctgcgtttaatgaggtaatgcacagccgtggtggacatatgtttaatatgttcattatggaacagcgtaaatttgatgagtattgcgcttggttgtttcctatcattgatgagttgaccaatcgcgttgattcatcacaatatgacgcgtttaatgcccgttatcctggcagggttagtgaaattcttttagatgtttggataaagacgaaggggtactcatatactgaattaccgattgtaagtactgagcctgtgaattggtggaagaagggaactggattcctgatggcgaagtttgacagtaaaaaatacacgaagagtttctagaggcgagctatgtcagttcaattaaacacggctgctggttcagtgaagagaactggtaactcagaaactcgtattaagtggattgacatcgctaagggcataggtattatgctggtcagtttcagttttggacatttgcgcaatggtgatggtcaaagtgttgtgttcggattatttcatttgaatgtaattgattttggttttgtcatccaattttacgcaggtcgagtgacagcgttgatgcttattcttctttgttatgtcttggtctatcgtgaagagtcatacatgttcccgaaaagaagttggaattatctgaaagtaatataatgactgtatactattttactttttttcttacttttgttttgtgctttatgtacgactatattgttagttttcgtcgtgtagagagaactaaagaattattttctaaagcattattttttatcagaaaaatacttttatttgcgtgccctgtaccgttaatccttattacaatttttagatacggaatcggatttgattattttcatacgtatgtaagtgattataaaatatatcagcagggaggaaggattcattctgatttcggctgtgcatttttgtataaaatatcacaggctatatcaaataatccgcaagtattttttataattacaggttttttaactcttgcatgttattatgctgcagctcagagattttctaaagtagcatgcctccccttcttgatttttattttggatggctccttctttcgttcgttgtcaatggtgtcgcaatactttggaattgcctttctattgctttcttttgcattactaaataccggtaaagtaaaaagaactaatgccattattgcttttattctgatttttcttgcagtatcagttcactcatctggaataatagtaggactagttcttatcgttttattctttttaaaagataaattgtctattaggtttttaataaaaatctcatgcttccttcctatatgtgtttttttattaaaatctgtaattgttagtatattgcttccgataattgagaaaacaagattctcgtcgtatattaattcagtttttgatggtcgctctgctagatcgattcttttaattgaattattcttttttataatgtacctcattcttattctgaaatataaaaataacgtaggcaagtatgaggcttttggaatattgtttgaatctcttgccgtaagttgtgctctattgcagaacgctttgccgctcatggatcggatggcttattattttgcagcgtttcatattttgacttttccgaggatggttagtttgatcaaatccccgatccttaaatgtttaagtgttgtgagcgtgtgctgttttttggctacctggttatatctgtatccgatttctggtaattacgataatttccaaccttatatgtctatttttggaaataccataattgaatattagaggtgttgaaatgcattttattgaattatgtaaaaggttctttctccatataaccgttttttcattctattatgcttttcttgaattgcttattgtattagatagacctatttctttaaaattacataagcctttttcgcataaattattaaggcttaaagagagatacattatttcttggctcaaaaaaaattttggtgatgttatcgccaaatatgaaaatatcgaagaaacagtcattaagccaaataaaataaatgaacttccaatttggatttgttggctgcaaggttataatttggcccctaattttgtaaaaaaaatgattaagaatgtcaaaaaaaaatcaaacggacatcctgttttcttgattgatgtagataactacatgcaatattgttctttgccagctaatatagtacgaaaatataaagcaggtttgatgccgcaacaacaatttgcagatattcttagagctggtttattgtctcaacgtggaggattatggatagatgcttcagtctttataactcgtcctattcctgatgacgttttcaatgttcctgtttataacattaaaaatataaaaccgaattattatagggatgcagtggcttgcgattctacaaagtgggaagcatattttattgcctcttggccgaaatccgttacatactcgtttattttcgaatgttttattcgttattgggaaaagtataatgttttaattgactattttcttttttcgtatcttgcaaaaataagtcgcgaagaaatagctgctggtataagtgagtattctttgattccagataataattttaattgtgaacagttgagtgactatttgatgactagtccatcttattctgaatctaaatatcgtgaaattataatgggtgacacttttgtgtataaactgacttggaaaggaaattattgtttaattcctaattccggggaaaaattacttgcagaaaaactatttgagttgtgaaggatttaattatgaaaaaagtattgttgataaatcagggacatactgctaatttaggggatattctcatatcgaaagttatgagtagttttttcttagaacaaggatttgaaattgagacactaccttacgatgatgttgtccaaaatagatttcgtctaccttttgacaagaagaatatacttccaagattaattgaacggattccttttgttatggattatgctaattttaagcgtatcaataatttagttaaagggaaaaaattcagttttgctgtaattggtggtggggaactgttggcttctcatcatggttttaattcggctcttcttatgtggtgtcgtcttcttgaaaaaaagaatattcctgtttatctttatggggtaagcggagatactgatatgtcttttttctacaaagcccgatataagcgtgcattaaaaacatgtaggtctatatccgtacgtgatcattcgacagaatcaattctgcgtgattattataaaattaaagcaacatattatcctgatgtagttttttcattctggcatttttttaagaaacctcagatagataagaagaatagagttatttgcattcctaaacaacttactgatagacagcttcgaactttaggtttacgcaatcatgttgatttctatgactatttaattaatctagtacaaaaaagtggtgcttctaatataattctcacttcgacagaggcggaagatagagatgctatattgggattttatcgatattgtgtaaacaatactcattataatatcaaacttatcttctctccttctgttgaagaattcataaatatgcttgctgcatcttcatgtgttatttcatgtcgtatgcatgcctgtattcttggccttttgaatgatactgacattcttcctgttccttttaaagaaaaacttgctgttttcgcaaaggaatattctgataagagatatgctataaaggccatggaacagtcatatgtaggtttacttagcattattaaagattttaaggagcttcactaagctttcagtatctgcgataggcatcgatttgtttggaaggttgttttgttatgactgatgcggtggagtatcccgatctggtggttgtttgtgttcaattagttgttgcgggtttagtcacgatgatttttcgggtttaggcagagcatgccgaccacggaatggtcttaactggatggtgcttgtatctccgccagaaaggaccggaaaggattatgatcagcatgccccaagtacagtctatccgtcgtttgcggcggaacggggaatccgtcgcgtcgatcgcgcggaaaacacatgtcagcgagccgacggtgcgtaagtacctcgcgaaggaggatctgtcggccgtgccgtcggtgagaaagccgcgcgcgtcggtgatcgacccgtatctgcccgtgatcgagcagtggctcgcggaggatcgcgcgaactggcgcaagcagcggcataccgcgactaggatctgggagcggttgagggacgagcatggcgcggaggtctccctgtccacggtgacgcgggcggtggcgcggctcaggcgtgagttcgcggcggagcgtgatgaggcgttcatggacctggtatggcatccgggcgaggcgcaggccgatttcggcgaggtcgacgtgctgttgcgcggcgtggtgcagcggatgcatcatttcgtgcttgatttcccgtattcgaacgtcggtctggtgcagttgatgccgggcgagaacgctgagtgcacgtgcctggcgttgcgcaacctgttcgagtggctgggcggtgtgccggagcggatcgtgttcgataacgccgccggcgtgggccataaggggtacggggagcgcgagccgcgcctgacgcacctgttccaggccttccaggcgcattacgggttcgattgttcgttctgcaacccgtattccggtcatgagaagggcgcggtggagtccaaggtcggcatggtgcggcgcaagctgttcgtgccccggccgagcgtatggagcctggagaactttaacgccgggctgccggaccggtgcctggagctggccacgaaaccgcattaccgcaaggacacggaggaacgtggcctgttctccgaggaccgtgcggcgctgctgccgttgcccgggaagcgtttcgacgtggtcacgtggcggcatatgaaggccgaccggtacggcgtggtcacgctcgagggacggcatcgttattccgcggaccgggcgaacgcgggcagagaggtgatcgtgggcctccgcgcgctcgaggtcgaggtcctcgactcgtcgggcaagcacctggcgacccatcctcgggcgtacggccaggccagcacgaacagcgaggacccgtccatgcagttggcgctgctgtgcaacaagcccgcgtcctggcccaacagccgggtacgtgacgcgttgccggacccgttgcgggaatggctggatcggcaggacagacagacacgcaacgaggcgctgcagaccctcaaacgcgttgacagggaatccgggtgggcgaacgcggtcgaggcgatgctttccatcctcgaatcgaccggcggggcggaccgcgccggtgtcacactgctcgcggccaggctcgccgagggcgtggcgggtatcgaatacgacgatgacaggccggatctgagtgaatacgacatcgcgttcaccgcggacgtcggcgtgcagggaggcgggcgatgaacacgaagacggacgaagggctctacgagaaggcccgcaagctgttcatctccaaggcgagcatcgacgaattcgccggctgggccacgccccgccaggtcgacgccgtccaccgcctgctcgacacggaactggcgaacagggaacgcgcgaagcacgacaggctcctgcgccgcgcccggttccccgtcgtcaagggtctcgacggctacgacttcacgaacgtcaggctccccgacggctacatgctcgatgagctcctagggctcggtttcatcccgcgcgcgcaggatctggtgttctacggcaagaccgggcgcggaaagacacatctcgcgatcgggctgggcatgaaggcgatcgacatggggctgggcgtgcggttccatcagaccgccgagctcgtcctccagctgggcaaggccaaacgcgacggcacgctcgagacgatgctccgggacatcggccgtgccgacctgatcatactggacgagttcggctacgtacccttcgacatcgacggggcgcgcctgctctaccagatcatcgcgggcagctacgaaagacggagcatcatattcaccacgaacatcgagttcagtaaatggggcacggtcttcgcggacgacaaactcgccgcagcgatcatcgaccgcatcgtgcaccacgggcggctcctcgagttcaccggccagagccgccgcgtcagtgaggccctcatgttcggcaggaacacctccgcgcaaccggaaaaataaggaaaatgcatgcaactgcctaaacccgaaaaaaatacatgactaaacacgaaacaccgacttgacgaaatacattccgtaacccagccatggaaacctccatacacgaacagcagactcactctatgtcgcgtcggacgcatcgtcacgatcaacggcaacgtcaagttcgacggcagtggacagcagaactactcgacggcgaatgagaccatcccagaagcgttccgcccgctcgccgaccagagcatcatatcgttcccgtcctgcggtttcagcctgcttgtcatgcgtgatgggaaggtgcagatgcttggcgacccgaaatccgcttactccacggcgcacggctgttggatggcactgcaatagctttccgtaacccagactttgattaaatcacagtatggcaccgtgaccggcgtgaagtctggcaagatcgcgcagattagcatcaactggaaaagcgcgagcactgactcgtggggcagtggacagttcggtacaattccggagggttggaggcctgcggtcgtcacgcatggtacgtggtcggggcgtgatggtggcagccagcgtgatttcattctggaaacgaatggcaatttccgttatgccaattgtggcgcggtgcagaacagcggcacgttctccgggacgatgacctacattctcgcctgaatagctttccgtaaccctttccgcgccgaacacgaactggaaagtggattaccgcaccgccttggtcggcaggatgcttctagtcgcattccacgccaatcgcctcaacgccgattggaacgcggcgaaagagtgggaggtgtcacagattctcaaactcccagccggtttggaggcggcgttcgaggtacattgcgccgcaatatctaattcgagcatcggattgcatggcgtcgaagtgcaggtggcgcagcacaccatcgccttgcgttcctcgggaaagatgacagtaagcgcaaacttgggatgggtcgaaggctgtatcacggtgccacttgtctaggagaacgtcactccactaggaatcggcatggaaaaacgctgcatcagaatgttctccctgccaaccccgccaagtaacgtaatactgccatccggattccaattcgcttgcttgttgtagcgcggatccgcaagacttgatccaacacatcccagtccaattgtggccgatggacgtatccctgactgatataaccagaccgtatagttcgagacttcgacggttgatttgaaagagctcaaatcgacatacagcatgttgcccttgacggtaatcgtgttggatccaccatatagggcgccaacaaacgatcctgtgtcctgaaacttaaaggtagcagtgagggctacggaaagctagaaatcatgggattgggaaacaaagcgtgccggcgcaatcctgattgctgccaacgtttcccatgttcgccactcggatagttccatcagctttggccgtgaggcttcgcgccgtttgcccatttgatacaaggcagacagtcgacaagtcaacgatgggacgataccaggactcgagctttaccggacattcaacagcatcccaactgcccgaaccgattttcccactgaacttgatcaaaatcatcctgccgttacgtatgatgatccaattggaatcctggtacagggttacggaaactttttgaggagtggttcgacctgctgctcgtacgcggtcaacgcggtgtcgatcacgttgtgcatgtcgtaatacttgtacgtgcccaaacggccgccgaacacggtcctcggctcggccttcgcgagctcctcgtacctcgcgtacaacgccttgtcggcctccgtgttgatcggataatacggctcgtcgccacgctcggcgaaacggctgtactcctcccacaccacggtcctgtccgggttctgcgaagccctgcgctccgggttgaagttcttgaactcgatcgcgcgcgtgtacggcacgtccgggtcggagaagttcatcaccgggcagccgaaatggtcgccctcgtcgtaacgcacctccctgaagtccaccgtgcgccacttcagctcgccgagcgagtagtcgaagtagcggtccaccggacccgtgtacaccaccggcacgcccgccgcggccaaggccttcctgttgtacggctgggactcgtcgaagaagtcggtcctgagggtcacgtggatgcgcgggtcgtcgatcatgcgctccatccacgcggtgtagccgtccgtgggcaggccctcccacgtgtccctgaagtaccggttgtcgtagttaaagcgcaccggcaggcggttgatgatgcccgcgggcaggtccttcggatcggtctgccactgcttgcccgtgtagttcttgatgaacgcctcgtacaacgggcggccgatcagcgaaatgcccttgtcgttgaggttcttcgggtccgtgcccgccaattcgccggcctgctcgtcgaccagggccttcgcctcggccggcgtgtaacgcgcgtggaagaactggttgatggtcccgaggttgatcggcagggggatacacctcgccgtcgtgcgtggcgtacacgcggtgcacgtagtccgtgaagcttgtgaaacggttcacatagtcccagaccctcttgttggacgtgtggaacaggtgcgcgccgtacttgtggatctccgcgccggtctcctcgtccatgtagctgtacgcgttgcctccgatatggtcgcgcacgtctatgatctcgaccctcgcgcccagatgctccacagcctgctgggccacggtcaggccgaacaggcccgcgcccacgaccaccagatcgggatactccaccgcatcagtcataacaaaacaaccttccaaactgcctcgaccaagagacgtggaaagctgacctcaagaccatgttcagcgagtgcttccgcgtcctgaaagagcatggagtgttgattttcaaatggaatgagacacagatacccgtatcgcagattctcaagctcacagcgcacaagccactcttcggcaacaagcagccgaaccgcacgggaacacactggattgtcttcatgaaggaggacgcgaaaaatgaataaacggtacaaggtttgcccacttttttggagtgattacggctgtaaacgcaccttgatgaatatgggtgtgtttgaagagttgctgaacgaggggtggaagattctgcgggtggataccatgccgccaacggaattgcgtgataacgccgtcacagcgacgaacgtctacatccttgagagggaggctaatgatgattagccaatacgacaaggacatgtgttgcctgtatatcgctgaggggatgacctacatctggcaacaacgagggaaccaagagctttcccgaatacttgaatcattggccgataggaagctcatgaagcgtgtccatggcgggtatgcgatcacactcaagggcctgttggcagtcaaggtgtggagacttcacctgttcctgttccatcacggtgaatacaagtacttcaggaggaagaaatgagcagggctgaaaccaccgccatgctgtccaagctggtggagaagaggttgaggaatcagaccgctttttgggcgagcgaggtcaatttcgaccgtaacacgaccgacgaaaggcgcgtggactacgtgggcttcaagccctggaacatcaacggtgagccggtgcccgcaagcgtcgagaaaggctgcttcgagttctacgaggtcaagtcatgcatggctgacttcactagcggcaacggactgacgttctacggcgatcagaactatctggtctgcacgaaggaactgtgcgacgagatcgtatggcagaagatggtgccgccgcgagtgaacgcgattctgacaccggattcgaccggctcgaaactgattctcgactatgtgcagtcctacaacgacctgtcatacaggaggcgtccggcaagcgaaatcctgtgggccatggtcaaagc
